United States Patent 6,812,339 (POLYMORPHISMS IN KNOWN GENES ASSOCIATED WITH HUMAN DISEASE, METHODS OF DETECTION AND USES THEREOF) - sequence listing, part 70

SEQ ID NO: 16600 - DNA, 298336 bp, Human
  misc_feature (1)...(298336): n = A,T,C or G
ctcttcgttcaggaatgatttttctttcctaggtgcataccatttactctgctttgagtctgtttggatgagtagaaacatttgtgccagtctgaggcctggtataagtgaaaagcagctgctgaaagaagttgctctgtacctctcctttgaacacttggaagctgattcctcctaaaattaatttgtgaattggtttggctaatgtgcagtaggtatctgaggccttagatttgtgtggtgaaagggttctcctacgtggtaatgtagagtagatctcagtagatgcccttgattcaatttaagctcactttcctctaactttaaccattgcctaccaaggaggatgttaaagattcgaagagtgttaggtagggagagtgttacatctgtcttggatgtttttatgaagaggtggacatggagtgggtctaagtgagatttgacatagacctctggtgtctttttttttttttttttgaggcagagtctcactcagtcacccagaatggagtgcagtgggggtgatcttggctcactgcaacctctgcctcctgggttcaagcaattcttatgcctcagcctcccaggcagctgggactacaggcatgtaccaccatgctcgcctaatttttggtacttttagtagagacagggtttcaccaatttggcaaggatggtcttgaactcctgacctcaagtgatccacgtgcctcggcctcccaaagtgctgggattacaggcgtgagccagagtgcccagctcctggggtctcctttagacgatatatttttaagacagccactttgaaggattagcaattggaaattgatacttattaactgcttcttaggtatcagcactatgctagaccctttctgcagattgcctttttagaggtagaaggctaccatgctgcctcacatcttgaagggtttgtattacattcgtattccccaagaattcatccttggctgtaatggatcaatgctttgatgaggccttgagtgctttttttctgcttaattgactacaggtttttgttatttaaaacattctctctcttgctactgagaacttggttcttcttatcataacttcctaataacatctaggttctaggatcttggtgtcccattcatggctctctaagtctgaaactccaagttcagtctctgttgcttaatttcttgatctgggattaagaacctctgtcttaagccatcgtggagaagagattatgaaatgtggtcatgagctgcttagatatttgttgcagactccatattttgcctgaagcacttgtggcccatccagtatgctccagaaagaacctttgcttgaattctcttgggacatggaggaagtcaggctgactgctgtgacagtcatggctgtggggccctggatcacctgcttcccatcctactctgcctttttgttagtctcctcaaagaacggggaaaaaaatatcatttaagtttaaaaatatcttttattataaagttgactcttttaactcaatttatcactgcttgctagaccatccttgaaaaccttgttaaaatgtagaagaaaatatgaagacgtgccatttgatttcagttgctcattacctcatgcagattacatatgctggaaaggaaaaaccgtgactcatgtttctgcagggcaccctccctgctatccccagggcctgggtttattgtaggcagccaatgtgtattttattgaacttaatagctgttacaaaagaattgaagaaaacattcctaggaaatactatcataattgaaattgggaagttctgggtaattgccgagtgcctcatattagtttctgtggggaaaatacatggcatgatgcaaaatgggttaatactgtagaaggaaaactctcaagagataaatcagaagcttcacctgtctgcctacgatactcacagtgggaatggtactgatttgctgataatatgtttttattattattattattctgtagcctcagacgatacagcagactctcaagaggacactgcagtattatgaacatcaagttattgggtaagtaaaaattgatttcggttattattggggacaaattaaaggtaattactcaaacatagctgttgagtatgtgattttctgctacccaggtcaacctgattttatagtggctatgttttcatagtgtggggcgtgaaggcttattgggggagtcccttggagtgatttcttttggcttatttgtgcttaattcttttaaatgaaattactttctggtattgcttttcttttttttctcagtcttctcatgttcttactcttttattccgatgttgaatcatataattatgccttactaatgtggtgagctttattggtaccaacccagatgctttgaatgggattttagaatccttaagtagagtttgataagaatcactacagccttaacacagttcagtgagaggaattagtttacttagagtcacgtgctacatatttttctttattatcatctatttcttgaagtggttgtgatgtggtgtaaagtaagaagacttgatgtcaaaagacaggacttcaaggcctcactagcaaatagatcttttactaagtaactttatctcttttttaaactgtgatgataataataactaaatcaaggattagatgtaatgattaaatgaggtaatttcaatgaaagcattttgtaaacagagagctccaaatgagtatgaggtacacctctaattggctgtggcagaaagcagctggcaagtatgaaagcctaaatttacctactcatgcaatctagcttttagattaaatttattgacattagaggcaatgtatatattttaatttaccttgttagtattctttatatggtacagtgatttatctttgtaagattttaagaacttttgagaagtcaagattcaaactgtggtacttcttgaactgctctcaggatcatttaacatttatggctaatagccattgccatagggatcaataacataattttgattattacggtatagtgtgatttttttttcacagaacagaagggaagaaatcttaatggaaaaataatctcggtacctagtacaatgccgtatactttaagtgcttgatgattatgttaattgtcatttaaaagggaattgctttgaaactttgtcatacttatcctcaagagtgtagttctaggaaaaacatattatttaaactcatgagatggcttttagtttgaggccattagtgatttaaaatggtttatcctaatggagataaagaatgtcaaattaatctttctccacatatcctgaaataaaacttaatcactctcattgaatttgccgctttccaagtatggtgtttggattaaattagttagtatacttaaaatagttcctcgtatgtggtgagcactacatacctgtttgcttttatgtttatcgttattattaatatttttatgacaatatccatcatcaaagtctaattttctgggattatgaatgctctttcgctttcgaaataaaataactgatgaaatattctcatttttgaactaaagtataccttcaaggcaaattggagtgggactcttataatgtgatcaaaatagataaccaaactatattgctataatcagaaaagttttttctccattgatagaatggagggagttcccttttatccagctggctgcctcagccctccccttctacctatgtagacatggtctgtggtgcttctttgtctattgcatgaatggtcttttcctagttctgtttattgcatacacagtataaagaaaacagagagtttgactccagtataaagaggggtcttgatgtctggcatgattcaaataggcctattaacatatttttgcttgggtgttggctgatttcttggacttgaagtacctttgctcactgactttatttgcattcatgctgatgcagacaaagggggcctgttggcagcaattttgtcacgtttgcctttcttgactgtattcccctttcttgccttttttctcattgatgactttcctgtccaacttcctcttttgccttttattctccatctttctactttctatttctcttttcacaatcaagaaagcagagcagctaatatcactcaccctcgaactaaaaagtgtttacagctgtatgttgttcctcttaagaaaatacaatttaaggcttcctatctctaattgtgaaaaagaatgtgtttcttacagttaaagggattttgaaatccctgtattgagaattgagagtaagtgccgacaagcataattttagttattttttggcaggtgagggtgggaaggagatgcttttcctaatctctgaaatggggcttgcttaaagctgtcttgaaataactcagcatttaaataccttgtgttgaggtgttgaagcagaacaggtaacagagtatgagctagcccttctctttttaatttcttaattatccttcaaccactaaccttcttttcctttccttgaaaactctgcccttaatctgttttatttatcagagctctaggattgtacggttctgctccttggattcttatactggttgcccatagaaactctctgaggctttttgtgtctgccaagactgagacttcaacgcggagagcagctgtttcgaagggtcacagacagaaggactgggagggagtagctgatggggcttcctgttagggagtaagatagcctctctgtactttatccactttatctttaaacattattctgttccttaatttatccattcacttgttcatttatttattcatagagatcattcaagttggggaaatgagtgctaaaataatttattcatgcaatgtgataaatcttctcttcatctccactatcgtcatcatctctcaccaagacattctggtctaattttctggtttctacttttgtccgccaatatgtattttcaccacagcaaagcaattaaaaaattacatcatgccaccttcttatgtgaaaccaatggttctcaaatgttaatgtgcatcagaatcacctgccagccttgttaaaacacgtattactgggccctgctcccagaggttctgatttcctaggttcagatagggctcaagaaactggcatttctgtcaagttcccaagtaatgctgatgctgcttgtccagggatcacactttgaaccccctgctttaaactatatgatggcttattatggtagaataaagtctaaattctttctgtgatctggcctctgcctacctctgtaatttcatccctttccactttcctttttttcactccatttcaaccttctgttggtttctcaacttaccaaccttagcttcagggcctttgtatgtatcgtttcattcttatgcaatgctctttccccagatgtttgcacggcttattctttatatacatataggtctctgttcaaatgtcttctctacaggaaagcctgccctgatcaccccgtctaaagtatctctccatcacctacctcaaactccaatcgtgtcaggttgactttgtggaaaattttgattactatataaactctacatattcatgctcacttggagagcttcttgttcccatagcactgtctttcctccacctagaatgagcaagggggcattgaatgtgcatctttatgttagttgctctttaactcaaacttctagggaatggactaactttctgggtggtgtggggtggaaagattagtgaggagcagaagaagtcagtagcagacaggcaggattcactttagaaattaaaagcaactgaggatagaggaatgtctgtttataatggtactttttttctgatataattcttgccatagtgccctttcttctctttgtatgttgtggaaagattgtgttttgtaagtagacatatgaaacttactagacatatagtcaggttttgctatgaataatcttgggaaggttacttaaaatacctgagcctcagttttctcattttaaaaatgggaataataacagggttgtggtgaagtttaaatgaaatcttaatgataataatgtatgaagtcatataatcacataaagtagttagcatagtacctggtacacaaagataatcaataaatgaattgaattattattactactgttagtaaatgactcttttgcaattcaacttttgtggattgtcttcagtttatcctcctgctgcaaccttttcctgtcttccttgggccttttaaagtttagaatctgttgtttagcatctggtggtgaacatgcccagttcgtgttctaactgcagttttcttctcacagagaacatctttttcgttgatttttttttttttgactgaaatttctgtctctagagggcttgacccaactgctctcactcatatttctactacatgattcctactggtctatggctcacaaaaatggattgccatggcagggtagacgaagcacagatttcttcagtgaactactatgagagatgtgataatctttctgagatatagtgttcactcactatatattttaaacaataaagaataaagaaatatgtattcagaaccatgccagtaattttatctttttttttttttttgccagaataagcattgctgtgttaatatcatggataggactgttgccaaactcatattagtctgggacaccaattcttatagtcatctaaaattaaattgtattgctccaattattaatgtgggccctatgtttgttttatacagccaaccttctgttctctttttcttttgacaattgaggagaaattaagccagaataatttcagtagaacactagagtgaaattaagaatgggtgaattctgattactctgagaaacaaacttcaaggatattacttaagctttcatgatcagattttgtggcttattttaatctaaaaatgatctagcttcttttttatatatttacatagaaaaaaactgtatctttttgaacataaacaaattagacaaaagctaatatctcttgattgcttactatgtttgaggagatatgctgggcactttccatcttttatttaatcctaaaaatattgcataagagtactgtattaagcacattttacagatgaggaaattgaggttgagagaaaaaagtacttttttaaggtcattctgataaaaatggtggaggttgaattaaaaataaccctgtggttgcctgtgtttaacatctgtgctccctgttccacctcttgagtgactcctgcattctggaaactgtagtaagcattttgcctaactggtttattggagtctgatctcaatgaggtgtacaaacatgaaacctttttatttttccctccactcacatcaagcatgctaggatacatccccttcgatattagcttagacagattgctctgttttccaagtatttccaagaattatgaagttcactctagaccaatttaaatttttactctcatatctagtctgactctaatgttgctttctctgtctgggtcaggacttggcctaagagacttggaatacaggacagagtgtatgatgtgggttttcactcctcttctccaggccattcttttctgtgtccctttctcttcggatgtattgggtgaggcatgaatgaaatggaaaatggaaaatttcattggggttgtagcagtcctctcttggctgtcatgccctcactagggtgcatgtatgagttccgccctgacacttttggatgccccagctcctgcacctaaggacttcactctcgtggtcttgctagtgggagccctgtccctggctggcagcctctagattggaagagcaccatgacaaccagacaactcaagcttgcctctctcttccctaacccatgggaaattcacatatttgccctgccaaacggtgggcctttaggttgctcccaattttgctctatttcttttccttgtcgataactttctccagagtcttcttcctcttatcagtcagacaggggagtatgatcaggaaatccactgcctctgcagatgttcactggggaatgagatgggtaatccccaatctctaccagctgtggacccccctcaccaactggacttctgcagggaacactccccttttctccttttctaggaggggagggggaaaagtaccatagcactctcttcctaggccaactcctcactcttctgaagattttattttgaagtctttctgttcttttgcttctgtaagctggtggtagagtgacaggggcagtggctgtttagtctcctcttaagtcctgaagaagagctctggtcttcttggctacccctttggaatgtgggaggatttggcctttaatgtcctcagcttttttgtcttagctctcattcagaggcaactcaaaaagtcccagccaatatccagttacaggcattgtgttatttagtcctcacaagaactctagaaggtacctccattttatgagagaggaaatttagactaacagagattaggttacttgctcaagatctcacagatagaaaatggtaagaccatgactcaaattctgccaggtgtatgttatttatacaccatactgctatcttcttctttttttttttttttttttttgagacggagtctcactctgtcacccaggctggagtgcagtggcgcagtctcggctcactgcaagctccgcctcctgggttcacaccattcttctgcctcagcctccagagtagctgggactacaggcgcctgccaccacttccggctaattttttgtatttttagtagagacggggtttcaccgtgttagccaggatggtcttgatctcctgaactcgtgatctgcccgcctgggcctcccaaagtgctaggattacaggcgtgagccaccgcacccggcctatactgctatcttcttgactgtgacaaaagttatggtgtgtttactttcaacaccattgaatgccaggacaccaaattaacattgttaacttttccttttctaggcagcttccttatagaaacagatcactagccttgatgaagtgctctcagagtgatacattagctgtacaaagctgatatattttttgttctcttcaatttttttcacacatagctttcttgttaacagttgcctccagttccaggtctacactgcaaatgctgatgtgaatggtgggttatgccagaattatgtctcaaagcttcacttattttaaaatgtgactatgatgaaagcatagactgcgtgtgcttgtgcgtgtgtatatgagttgcattcgcagatgctttcaaaaatttctccttatgctaattttgttttcttcttagttacagggatgcagaaaagaatttccacaatatctctaacagatgctcctatgcagaccactccaacaaagaagaaattgaagatgtctcaggaattcttcagtgtactgctaatatactcggtatattaactatatatatttatatggatgagagagaatgaaagagagggaaagtcgaggtggaagtgtttcatgttctaccaaagagagatgtggagaatatggcaagttgagacccagaccttgtgaagtgatgggtgttaactctcctgaagatgtttgagtggaaattgcttgcatgccacttacttagagatggaaaaacatcaaaacaaaaatacttaaattccagggaaacaatttcagatattcacatgtgaatagtattagctctgtataatccatatttctttggcccttattctcagctaaagttgtaggatctttttttcctctcagtcatactctattacttctgggaggtcctggttggggcagaagggtggcccacaggtactgttaacactctacaatccaatgttcctttctgtggccttgtcagtgaagcaggtcatctcctgaggtgtctgtgccctacttggggttaggggagtgtccatcttaaagatatttgtacttatgacagaggggctgtttttggatgctccaacatggctaaaaggtactgttgtaaattgcagccaattatacagccgtaagctaccataactgagctgtactaccatactacctgacgttcttggtgtgtgagagctacattgtattccatgcaatgtattctaaaagaaatattttttttcctaatgtcttacagatgtttctagtgagaaatttctctttaagttctttttggaattcttttttctttatgacccagataggaatccatggggtgctggagggtgctagtggggaataataaatcttagtgagcgactccacacagaatgcagaatctcttttggggtcaggtgatggacaatagggcaaaccagtttgcatgttctttcttttcctttatagtattttccctggaggcatctgagtttctcctacaaacagtttccaggttaccccaacccaagggtctatcagattttctaaacatgtcagacttctagaggtagacttcttttacattcaagctgggaatccagctgccggttggctacattttcatcctaggtaacttttgtaaacacaaaattgtataataagaaaatgtataccttttgtgaggggatgcatatagatgttagtggtttgtctataacagcatgcaggacagtgatgggtagtgaaaaggaggccaaagattcatcaccttaatcttagaacaactgcagggatgtcacaatacccaagtaaatcttatgactggagaaaataagggatgggattaaaagagacattacccaagagttgtttaaagttttctgattttatattttcaaggactctcctttcagtaacatacatttctcttaatgcattgtgatttcaaggggtggggtgatgatgccacactaaaagggatgtatcagaatctcagtgaagggatgtttaatattttgagaagttgcttcttatccagtttctaaacactttcctgaccctcacgtctttcttctttatgctccctatttttagaatcactgagttagagggaataggaggtgttcaaagataatgattatattggggtgctaaaggcagttggactgtggcttgtaaatgagtgtgcacaatttccacggagagaaaccctgggtcaaaatttgaaatggttttcaggggacactgttggcccagcacagcttagttgcccttcgaaggttgccctaagatgttggataagtagtgagtgagaagaacagcaggcagtgtgctgcctgatgacattagggtgagtgcagtgtttataacttagaaggtgatcatgtaacagggtttagatttccatgaatagtaactttttctacaaaagagatactaggtctgattattttcttcctctaagtaatgataggttgttttcaagatttaaagcacaatcttgtaaagtttaaatttctgaagattaacattaacattaacatttaatgcctgccacctgtcaaccagatgctggcacagaggtagctgttctccttgaataatgtctttttagaactcttgatatattgactctctgaggacagcgttagcggtcatattcaataaaagctttgtttttaagaagtcactgagctatggttaatcttggcttgtttagatttttatctttttttaaagttgtgtttaaattctcttctgtaatcatatatgagaatgaaagaattggtcagcttactggacagaaaagcatgacataaattgttttttgggaggttgttggggggtggcacaggaaaacaacatttcaaccaagataagaaaaattttgatgcctgggaacctttttttttggatggcagaaggcagtgttccaactccatggtttatatttatcacctttggggagtgtgattagaatattggtggactgagattggcaaacatatatttctcttaccttcttaacctattacagggttgtattagagtctggaaatgtgttcgtttattcacttatttgtatattatttatacttcatcatcaaaaaagacttgaagtcatagatcacaagatatgatcatagtagcaatttttctccttccaaaatgagcatttctacctacttagtataaacaactcctctagaaagtttggtcatttactggctcttcaggttgaagtttgcatttagagggtggcatggaataaaaacgaggacctgaggagagggagaaagtgagttggagaagacctgttatgcctctgtcactcatttgttctctcacctcttccatgggactccctgggagcacatgttgtgccctacaaggtgtttcatgcctctggagtaatgggaaagaactgcttccagatatcaaaatgtttgatgtctgtttccctttcgttggtttagaaactggttgtttctattttctgtctcatcatttacaaattacggatattgattatggtctgtttcttgccatctcttcaccatattttggtgctttgccaattgctgtgataatggaggctgggcccttgaaactctggccatgcaaagaaagatagtagacagtgccctccctgctggaggactttagagttaaatttattgctttatttggtacataatgtcttttgcataccaaaatgatctaattttagttgtccaaaaaatagaaaatcttttctagccctaatctgcaaagcctatttttagctcaaattaaatagtagaaatgtgtttatgctctatgaggcaacatttagtattttcttggaaattgtaatggttgaatggtatgatgaagcatgtattaaagcatgtgtaccatgttttctgctgaaatgttgctacttgttcttatggattgggtttacatagtgttgtaggcagggagacaaagtgagtaggagagttaagggagaaggatgataaattgcatagtctcctttgtcataataagttaaatataaatgaggttatgactatttcagttttaacaagttctaatactattaagggtgttgtgggtgtttcagttgttgtagagctttaaggagctaccagatgggggagttggggtgtaggaaaaagacttcccacagtagtttagagaacaaatagaaatgagagctctaggttaattcatttactgaggagttatagcatataaagatttgcaggtttaggaagcatcagttatttgctaagtattgctcaaagtatagttttatactgcccttgctaagtgcatttcctctcaaaatagtcaggaagtgcatagttctgaaaagatattcattgatgttttctctgttttaaaggtctctctctgtcagagtgttgctttatcttctctaaaaatgtaacacatttaagtcagaatgggagcaatgcttatcatgggattattttattgggagagggctagtaaggaggatagaggaaatgacctttggggcttattcctcacaatattttcttagtatcagggatcctgaaatactgtgaaatcatttataagatgccactgattccacaatctttagctggtatggaactctctgtttttttataagtaatgattttttgcttatatgtcaacttgtatatacttttttgtttcactgtgatttgtaatgtgtatttaggagccttttaattagtcataaaattgtgaagaattagcttaaggttaggttaagactaacttggagattttctgggaataactctaaataatataattgtttagtagataagaatatgtttaacatatttgttatcttggagaactagttagtgtagtaacaacttaccatatttattggtgagttaagattaatagcaataaataacttctgccattatagttcttgttactataacttggtaactgatcaatttcctctttcattaaaagtaaatattttcagtattttactagaatgaattggaattaaggcggttgaaggggaaataacttaataatgttactataatgtagtgatttagagcaagactggagccagactacttgggttgaaaatgcatctcagctacttactagctgcacgaactggaatgatttacttcatctttccttacctcatatttcttatttgcaaaatggagataatataattgcacacttcctagagttgccaagacgattaaatgagttaatttatatcaagtacatacttagaacagcatggtatataacaaacaaatggaacatgaatgtttgcttttattattattgagtattccccaaataatgtttgcatcagatgcagaaggtttgcttacttttttaggtgagaaaactgatactttgcaaggttaactaacttgttgatatctttggtcagagttaacaagccacagaggcagaatttaaattcatttcagtctgattccaaacctcatgttcttctcattactttgtgctgccttccagagttgttgactgtgtcatcactcctctgatgctaattacacaccacctttccagttctctgaattcttagaatcgtcatgatgtcacattttgcttagtgctttgctctttcaaatgtacttgggatacttgcttgtatgagacaaacttcttgtcagtattgaggaaagttcagttgtgttgcaatttggatcatttcagtttagaaactaggattgttctttagattttaggtgttgaaaatgctaactaagggtgatggtgtttcccatcacaacacaaacgtggtttcatagctatgctatagtaaacactgtgacagtttttttgctcatatttcaagctgatcttgctacgtagctggcctcatgtgttagacatcattaggccagcacaaaacctgcaaaaaggctgtgtttctgatgttgttgatttcttttaatggaaaagtttaagaatatcatcatataatcttattaaacaattcctaaacagagactttaggtagtggctctgtgtaaattagagacaacttctgtattctgctctctgcttacatactttccctgagatagttagatacagtagatagtcctgagaaagaatgagaccattgtatatggacactgcttcctatatgtaaaggataaacactataatacaaacatatccttaagttatacaagtcagttttataagttacaaggatattgagtatgtagccttttcgctggcttcttttgtttagaagtgtgaatttaagactaatccatgtctttcacagagagctcattcctttcccacaactgccctgaaaaatattccatttaacatgtaccacagtttgcttatccattcattgattgaaggataccttgattctttccatttttggttattggatattgagtggaatgtggcatagtttccctcttctcctagatattttttctcttttaggaacatcttcttctgaatcttgtgacagactatttcccatttgtcctgctaaatttctccagacatagcttttcttttttgctggaagaacatggcagtcctttttcttaattttaaatttgtgtttctgtgtctctaaagcattgtttcgctatcactagcagctttctgtctagcacctcttctttgtgtgaagggagaacaacccttcagattcctaaattcttcaggttgtcttttgttctcttttctgaactcttcagtaggttggtgtttatttttcgtttccctttaagttttttttaaatgaagttttaatgtagttttaggtttataaaaaagctgtgaagatagcacagaaagttatgatatatcccacacccattttccccatttgacatcatacattaatatggtactttggtcccaatttataaaacaatattgataggttattattaacaaaattccatgctttatttcaatatccttagtttttaaccttttcctgttccaggatttcatttcacattacatttagttgacttatctccatagcttctcttatctatgacaatttctcagacttatgttgtttttgatgaccttgacagttttcaagtgtactggtcagatcttttgtttgtttcctgtttgctttggtatgtggcaatatgcccatcattggcctgacatatgcccatattgtgtgtgtctgtgtgttcatagtgtgttttgagcacttccttacttcccagcactataagatgttccagactcatctttcatactttctgccccagttgtctagaatgagccatttctctcaggagccctgataccttttattggagaatggtattggaaaccatgacctgggcattggttgtactcattgctattggggtgttttgcttctacgccctctcagctgacagagcaagagaatatatgtgtgtagactaactcatatatatatgcccatctataaacatttttatatgtattcatcatatgctaaatatgagttaatactgatgtctccaactttactccattaccatatggatcattctaacctttccctcttgcttgtctatatccttctttctaacaaggagaaacctgactccctttagccatccatttactgaattcttcaattccagtgtacgtttatagttgtttcagaattgttaacagaaactcccaggggaaacaattttatcaactaaaatacagtgcctatgggcagtttgggagtatgtagttatgtataaagctttatagtgtccactcatatccagggttacttaggtaagcacctttctaccccaccacttccagtaagatttttttcatatatttgtaatacagctagattcttttattatagtcttccatcctgtgatactttgacctcctaaacacacacacacacacacacacacacacatttaaatttgtatacagtaagtttagctcttctgctgtaaagttctatgggtattgaaaaatgcataatgtcatatatctgccattataacatcataccaaatacttgcactcttctaaaaaaaatcccgtgtttcacttgttcaaccgcatgtcacctccaaatccctggcaagtaccgatctgtttgccatgctatagttttgccttcaccagagtgtcatataaatgtaatcatatagtatatagccttttcactggctccttttgtttagaaatgtgaatttaagattaatccatgtctttggcagagagctcattcctttccccccacccccctgaaaaatattccatttaacatgtaccacagtttgcttatccattcattaattgaaggataccttggttccttacatgtttggttattatgaattaactgctataaaacattcacttgcaagtttttatgtagactacattttcaaatcagttaggtaaatacttaggagtgcaattgttggactatgtttaaccttgtaagaaactgtcaaagtgtcttacaaagtggctgagccatttgcctttccaaaagcaatgaatgagacttcctattgctcttcatcctttccagaaattggtattttccattttttagattttagccattctaatacatgtgccttcctccttgaagttttaataaacaaaagcagcacctgttatctctttataatttctgcatataccaattataattaagaattttgttttctggttttgtcattctaaatacttttcctgatattatgactgaatttagaaactgcttaaaaatttattagtgatagcaatgattgcccatgatactactgtaataggtagactctttctcttttgcttagtaacaataagttcctggaatgaagttattcagcatttattcactgggaaatgaaatattttaggaatttcagtgtaactttgaggtgatataaccaacagggtcccatttgttgaaggtgttgaaatataagatgtccacaaatggtctttgttaatatcgttatgctctcctaacccccagcttgcctgagttaagattcctttcaacactatcaacagccagtgagtcaaactcacttaactaaagctcctttactcaatacattctcataacaaaattctcaaatttcttagaaactcttctatttttgttttctcaaagatagtattactgccatttaaaatctgcaaaactccttagttggataaaacaaaacagaacaaaacaaaaacacttagctctgacttggagcagaagaaatggaagcacagctaggtcaggctgcttgcatggggtcacaccattagcctctggggagggcagtgtttgaactatgaggctgtgatggtagagcctgctacattacttattgacccctcaactgcttctgttaccaaacagtaattgttattattgctttttctctgagttagaaggaagattattcttcccttactatgtgagaaacatgattgtgggcctgtaatcacttcatatgtcaaactcatagcttattttgttgccatctcatggagcagatttatagtgacttgtcacatttgctttttgaaatactgtttttttttgtctttatttctttgaatcttttagctcaagtgagcataccaccttcctttctcccccaacccttttcttttgtgttagaagacttttgttaagtaaatgaattatttcccattcatgaggctgatgtttttgtccattgtgttatctctctgctttcattgttctttgatgcataactctgactcaactacaaattttaatagcattctgtttaattcttctgacagttagtgaaaatttaagtaagattagagttaaattcaaacatcctgggttctatgctagatgagttgttgttcttactagtcttgagttcggttcttcagtcaattttaagtacttttgacagcatttctattgtaatttatttaaattaatctgatgagtagagttttatgtgtcacaataaagatgttacttaaattaagacattttatatatggtaaattccccttatgatcccactgttagtcccatttttcaaaagcaaaaatattaatctcttattttctttgagtctgctcagttaaagatttccatatgttaaattttccatcagggtagctatggactcttatgtatcatgggtgatttttataggtgttttggagtgctcttttcccatttctgttactcatagtagtacctaaagtgacatcttttcaaatctaataagtttgagaccaaacttccaattcctggtctgttgtggttttttcctatatttccacaaagtctgatcttaaccttgagaaatggtaagttttctagtatgaagaaagaagttgtagataggatcaggttgggtagagagattgttgggtggtagggaatggtatgggatgtgaggactaggcttcatttcccaggtagaaaagggcagttagaagaaccagtgtaggtccccacagaagacatgactcattgatggaatggagggagaacctccagtgttggtaacaggcatgaaaataaactggtagagcatatatagaagtcaactaaacaagaaacgcatgtgattttcataagcaaggatactgaagtaattcctgactcctacataatggtcaggattgaacattgtccagagccagataagtaaaagaggaaaaaccaactctgaaaatatcaattttaattttgatatttatacatttatgcttttattcttcctagggaaatatgattgcattattgatttgaatcctaatcccaaaaatgcttatgtctatgctagactctagatcagtggaccttacattccacaagtgattgtacagtaggatcatcgagagacattaagaaataaaagaggcctatagacatgatacccagatattttgattaatcatatctagggcagagaccagaactttgtattttaaaaatacattctctagataattttagtatgcacccatgacttttaacaatttaactccaaggctaatcctgctcttgggcaaggatgcttaagaaactgtagtcaattcttaggatatttgataccaagtcacctctactgttagttggtactttaaaatcctgtgtttctttctgtcttatttctgaaagtgggttgttgccttgtactccactcaattcttttgacttattcctacttctcttcaggactttagttctatttctgaatcccacacaggaactggtgctctgctttcattcattgctttttgtcttccagatacatgcttaatgtctcttgctagatgctctgtatttatcttttgctagatgttctgtatttatccctccctccctcccttcgtgcttccctccctcattgtttctttccctccctccctccctccctcctttcctcccttcattccttccttccttcctgcctcccttttgccttttctgtatctctttgccaaatctccttcatgctgataactgctggcttagattactggcttagactgccatcatttgcatcacccaattagaatatcatatttttttctgattttctcctgtttatgtataagtgggcatacctagttctagataaatccctccctttattcatcccatgtcattaattccacaatgacatgcaatagggttttgttcaaactaatgtcagaaatagtgggtcatgcattgttttcataaaatgcctggttactgctagatttttttacttgagagctttagataacactttcctgtccactattactattgttaggatcagaaatcctattaattccgagaggacagtgttaccctagggagaaaataaagtgggcaatagaatttgttgctgcaataggaaagggaagtttatacttgtctgtgagctttcataaagcagagtcattttaggatctttgcgaagaagatatcaagggatttcagccagagaacaagcagaacagtgacaaatgatcctgactcttgtgagttactccactgagcgattagtgcccaggaaaacgttgactgaaaatacccaattgccataatttttctgcttttcattctctgtcttctggttctgtgtacttccccacaccattttatgagacttcattcacctcttcattcacttctagtacctcagactgtttttcattaacctcttttttttggtttgtttctataacctttctattttcattattcttattctcaatcttacattttaataaaaagcaacaattcaaatctgccaaacgtgtttacttctcttaatttgtcagtacatttttgctttagtgctatttttaagcttaatattccagttgccaaatttagtagtcaagcaactctaacttactgcaaatttatacaatttctttaattcagagctctaaatgatcactagggtttcagctggactagtatattgttatattaactgcaggaaaagattgattaatccacagacgtctgtatataatattgtggaggaaatatttgccctattaaaggaatagtttttaagtactttgttccatcaatacaaatatttattgaatattttgtatttttgggtactgttctaggtactggtgatcatcagggagaaaacagcaagtgggcagccaggcagtaaaaaactacagacaagtaacaaatacgaaaacttcagagtgatgcatgctgtgaagaaaaataagacaatggggccgggcgcggtggctcattcctgtaatcccagcactttgggaggccaaggtgggtggatcacctgaggtcaggagttcgagtccagcctggccaacatggtgataaccccatctctactaaaaatataaaaactagccaggcctggtatgggcacctgtaatcccagctactcaggaggctgaggcaggagaattgcttgaacccaggaggcagaggttgtagtgagccgacatggtgccactgcactccagccttggcaacagagtgagactctgtctcaaaaaaacaaaaaagaaaagagaagaaaaataagccagtggaatgtaaaagagtgtgaagggcttaaataatatgttaacgataatattcttaaatccatttaagcaactcataggatttctatatgactgtagtatttgtgctgtttcactgatatttctggatttagagctccagaaatgaactttttttttttttttaaccttcactttaatatggaggaggttgaggttaatgaaagttctggtttctccactgatgtctgagtagcatttgctactctggatttatttaagatgaatgaaaggagacagtgaggctgtagcattgtattttgggctagacaaagtcccgagtggtgttcatcatcccaccagtgtgttttgaatacctccatgtgccaggcctgtgctggccatgaagatttgagagtgagtaaggctgatgtcgtctctgctgtcctggctctgtcagcatagaagctaatgggaaggccacatggcaggaggtataaaacttttctactcagtggacagaatgcaaagctgcttgagtgtgaccactagaagagagccatcccaagagaagtggaagtaaaatccacaaatcaaatgcatacttaagctttctcttgctgttgttttctttttctccatatacacacacatacacatatatgcctatatacataagtacatacatacacatacatgtatacatatgtatgtatacacatgtataaattatatatgctttactatttgtaaggatttttcatgtatactattttgtaccttgctaaagtctataattaggtattattatttccattttacagatgaaggaattagacccagagtgtaagtactttactccaaatcgcttagccaacaaatgcttgcagctatatttgaatatagttttttaaactacaggaaaggagtaccgctctttttaccatgttgcatttttctctgtttccaaaaataagtggtaattgtgacacatcttccattaaaagaaccacctctgtttcctaaaaaaaaaacaacaccctgtgtttatgtattagtatatactgctacatggtactgtatgttattttggccaactccctgaattaaaaaatatatatttttctttttttgagatggagtcttgctctgtcgcccaggctacagtgcagtggtgcaatctcggctcactgcaagctctgcctcccgggttcatgccattctcctacctcagcctcccgagtagctgggactacaggtgcccgccaccacgcccagctaattttttcgtatttttagtagagatggggtttcaccgcgttagccaggatggtctcgatctcctgacctcatgatccgcccgccttggcctcccaaagtgctgggattacaggcatgaggcacctcacctggccaaaaatattttataaataccttttgccaatgattattctgtgtctgtgctgccagagtgagcactgacaatatttattctgggtatgaaagtatttttctgactccaaatgagagatagaaaaacagatctagagagcaagggttttgagctgataaaaataggaggaacccagcttatacttctattaatgcacacttcatgatgtgcttcctaattgtttacatgtctttctctttgacttgaatgtaggtacctagtggtcaggtacctacatttaactctttggggcctatttaactctttgtaaccacagcaggaaggccagaggccctggaggggtagctatccaaggattattgtttgaaagacaaataaagactgaggagtattcttgaagaaaggaaactaaagacacaagaaaaacaaatgcaaagcatgatcctgtactggatctcggactaggaaataatacaactataaggtatatcattgggacaatgagcaaaatttgaatatagattgtgggttagaagatagtattgtgtcaaagtgtacatttttatacaaggaagtattagggatgaaggggcataatgtctgctacctactctcaaatggtgtgtgggtgtgtgtgtgtgtgtacgtgtgtatgtgtgtgtgtagcaaaagagaagggggaatgagagagaataagaaagtaaatggcacaaattgttcacaaatggtgaaacgagatgaatatgagaatttttatactattcttgcaacttttctctaagtttaaacttatatcaaaataaacatttccaaaaatgattgaataaagttaaaatatattataagtccaaaggaactttgtttttattgggttgtatccccaattaaaaacaaacggacatcaccacaaaactaactaaaataacaaacataagtgagtttaagagtttgcagcgtatttttatgctgctataaattcctagtatcacctatgaatgcatcaaattctatataattagtgtccagattggagtctatctgtggagtttattttccttaagttttgttttctgtctcccttataacgtgatttggtgatatggagattaaggatgaaattggaatagtgtctgaacgtagtcccactctgtttatctcctattgcagggcaattgataccagaataggtgattggttcctgtatgttccagaacatttcatttctttcttctacacagaaaaatattgctcaagaataaaatcacattttcaaagaataaaagtaaaaataaaactgctgactacttctattgcttaaggtaccgattttcatggtactatattgagtgacatctatacacggacatgtagctttcttcttgtcatccctttactattatgataattttggacttcccaaatactttccttgaattcagaagcctcatcaatcattgacatattctcctctgtagactctgatttttttattgcttccctgacattttaaatagccagtatgcatcatttttcatggcctgtcatcagtcattagataatattgcaatgtgctatcaaagtatttctatatttagtagcagtacattctgtatctccatatagcattgtgtagaattagttacacaggatcttcacttaaagcaggacatcacactaagttggtgtttagtgtttactgaactaataggcgtgtaaagtcaactgtttagaagataatatagctgtacatggtcaaaattattaccactgcctatatttttaaattaataacaggtcagagcataagcacatgatggatattcatttccctttttgttggaatagacaaaagatcagtttcaaaaatggtgttcatttcagattatacatatatgtgtatatatattttatatatatatataaatatatataattccttaaaactttaattgttgcataaaaatactgaggcttatgtaaattattctcacatttcaaatttatttgaaattaaaaattttaagcaaacatatgcaggacataatcaggtattctgtctatgtgatttaactccccccacctactcccacaattcctgcacacactaatatacagactttcatttctagtttttttttttttttgagatggagtcttgctctgttgcccaggctggagtgctgtggcatgatctcagctcactgcaacctctgcctcccgggtttaagcgattctcctgcctcagcctcccaagtaggtgggactacaggcacatgctaccacaaaaatatttgtatttttttttttttaagtggagatggggtttcaccatgttagccaggatggtctcgatctcctgacctcatgatccacctgccttggcctcccaaagtgctgggattacaggcgtgagccaccacacccagccccatatacacattttcatgctgtcatggacctcatagtcctgatcctttgggaacaaaattttcaactaaataatagaatgaatctagtcctgttaataggaggcaaaaattcaagtaacagtggtattcactgaccattgttcctgctctcaccttagtataaatgttgggaaaataggagggatttgtgggatggagtaaatcttggtatctccacataggaactttattggacttaactttattcttatttgtctaagtctttgtttggatagttctgagtagtgaaacagggatgttagtagtcagctctacagacagcagaattgaagtctatagtccagttgtttaaaatgaagattgcctacattgggagatttctacttagaacaaggttaccatagtcacaaggctgaaaaatttctcaaatatctatttgacttctagggcaccaagccaactgattcactgttagtgggatagaaaaaaaacaaactatgtagacctttgacattcttctgcaagctagaaaggaaatagcaataatatactggcaaggctaggaatgcgctgagaagagaaaagtcagcttgcttctttaattgtgactcttttttgaagcacacttaagaagcattttgaaaggaatgtggcatctttcatcatgtgtgaattcaagatcttatagctttgtaatatctttttcctgccaagtactagattcggttgaccttttggataatgcatttttgtttgctttcaaatattgagaaagatctttcatataaccttctgttttccttaggaattaaatagtgttgagggaatcttaaaagtttatgggaaaaaataaaagatccacattcagacatctttgttttatatctcttttagctcagacagccctaagtctacctattaagctatttataagaataaactaagtctctggtgctgttttcttcctgcttctgcttgtgtttttaacattcctatgtcacatatttttcttgccttcgttctctaagaagtggagtgcctttgtttgtttatgactctgcagtgggggctgctctcctttgggcatttcaggagggtgagtggcaggacacaagttggaatgagcaaggtgtgctcacaatgcattgaagagactagtctaatctgagatgtgattcttgttggtgcattataaaaaatgagcacagggaatggttcttatgctgtgtctgcaggatatgccagtgcatctcactagataaattttgttccacttagcatccttccttcctcactgttccccaaatttaaaggtttggattttcactaatatcgtctaatctctggcactcctttccatgaaattgtggtatgtgtcctggtgagataattagaaaattggtctgttgttatctagttgacttggtgcttgtgttggctgttactttgttcttccttaactcttctttttagtcccttctgtgctagcttctgtagaaaagaggatttaacatactcacgtgcactaccgctgttaccaccatcatttttgctttggaatggtgatgatttaagaacttaaaaccaaaggcttaccagtatccagtccgcattttctacattatctacatttccccattaatgagccctcttgaatttaaattaaaatgtaaaggaacctgaatatgcatttattcattcaaatatctattcaacaaatatttattgctctctagatgctggcattgtgtaggtactgatttactcagccaagtacagtagagtgctgcacaaattaatagcagactactctgttctccttttattttgggcttctcaggcatcctgtgctgagtcttggatcaaaaacacaacaatacagaaaataatctgttctaattccttagtgttcctggtaatatatcttacacttggacttatggcttatagtactatataaattcttaagaacaatagactgaaatccttcatatctttatcttagtaattgcccatacctgagatttaaaaaaaataattcaaaacaagaaaaaacatgaaataacagcttagtgctgtttattgaatgctcctataaaaagacaaaatattggcaacaaccaacagtccaactataaggaaagagtcagttaaaatatgatagctctgcttagaagaattttaagcagccacttaaatgagaactatgtggaaagattatgctacagcatgggaaaatgtttgcgatgttgctgtagctctagttccccaggaaacagactccaacatggagatttgcactcagacaggctcctgggcagtgtgctcaggatcagtgatcccaccaggcaaacttcattaggtttcaaggcctgagaatgatcctttgtggttctcagctctgccttttgggtcattctcatgaaaggtagtaagtacatgtttgcagctgaggagttttaccagactgtttccctgtgagaatgtaaagaaagtagatggggcagagggaaaaattgaattgctcttgcagaagccatcacaacagaggtctcagctgatctcttcagaattgcccctgactggggcaagaaggaggtatctttttgttatgactccccactttccaaatgaactatctttgaaagcagcttcccttgcggaggcaggtggatcttgagccggcagctctcttcagctgaaggcaatgcctagagtcagactcagttgagagctgacagctacaaacactcccagtatctgttagagatgacagattatacaaaaaagaaaactttatacataaagtgtttgggcatatcatgaacattatgaatccgagtacataaaatatgtgtgagtatgcacaaaaactggaggggacactgaaaaaatgaatatggctctgttacaaaagaaaagagaagccatgagagcataatcctttcaccaaataaacaatgaaaccaaacagatgatagtttcctctaaaataatgaaagaattcatgtatatattttcccctcctcactcaattttaaaagatgaccattaaaaaaattctttcaggtctcagcctttcccttgtgttttatttgtggaatatgttagagtgggataatgacataatgacaaacatagctcagtgttctgtgagatctactttgagaccgtaacgaatatgaatagttgctccgcttggcatgcttttaatctttcctagggttgcctcacccacgatgctaaagaagcagtgcttatgagttcagtaagtacatgcaccactgatactcattttcacggctctacatttcttcctttttcagcttaacattttatatattcatgatcaaaatggaattgggcatgaaaaatgtgaacggcacaaggcaaataaatacaatactagaaaaacagtttgaggtgtatatgctagtgaagaagaataaacctgaacatctattttcccaggttagagcacatatacacaaaagactgtaatcctggcataaaagtttctcatgttagctccccttatctgaaatagacttcctatttctcaactgctttcttatttccttccaaagcataactcgtagtatccttccaaatcatacatactgtgtgtgtgtttcctagtgtacccttttttttttttatattaaacagttctttaaagctgcctttaatgcacttggaattacttctttgaaaaatacaagatgagaaaagacaggagaacatgagaactattttcagatactttaaaggacttctgtgagaagaggagatttgttcaaatcaccacctagtatatgagggtatattagaactagtggactaaaattataggaatagattttgccccacatgcaagaaggaaggaattttgtaattactggagatattcagttttggaagagcaagcttcctgagctgctcatcagggtgctgtttaagtagaggaaagatgactgtctatgagatctgctgtgttttgagagagattggactggttatcagtcaagttctcatgtacttgatggcttcatgaatcaatgttatactaaatggtgtattcacaaattctgctttaaacaaatatatacgtaatcataagatttcatcttccagaagtatagaagtattagcattgcttgtgaatgctgtaaaaatgctgtgatgctactgtaatagctacagcatggaaacacaataacatactaatttctgtcactcttaacatctaatgctgtttgtctaatgaaatacattttagacctttggctaagtatttattacctaattcaataggaaaattgaaaaaaatttcagatttccatcaatttcatttctttaccacaacaccttttttttttgaaaaaaaaaaaaaaaaagtttgtccctttgctcagactggactgcagcatagctcccaacacttggttggagcagttgaggagggtgaatcacaatttagtgatttaaaaaaaaaagtgaccattttttttggaggcggggccaagatggccgactggaagctgcgtgttcagaggctcccactggaaaaaaaatctaagcatgtgaatccttcatcagcaaccaaggtattcaggttctctcgccaaaattgacaagaaggctggcctgaccacagagagaaggaagagcagtgtagtgagaaggcccacctgagagccacacggggaaggggaagccccttccccaagccaaaggaggcggtggtgagtgagtgcgctagggaaactgctttttccacagaaccctgccacccatggattggaagatcccactcgtgaacccacgccaccagggcctagcgtcccagccttggaacatgcagattcttacagcctctcagctggagtctgcttaagcctatggaactcaggaagtgggggttgctggtggggaggggggaagaagaggcaaccagcaccagctgtggctgcctgctgtctaagccatttgagctcctggggggaggggcaagagtcagcactgggacttgcaactgcctaacacactaagctccctgggcagggtgggcacacccatttctatagctccaggctgtactttcccctgctagagctagagccagggaggctggacgacttgctcccaagacttgtccccacagcccaacacaccctctgtggcagtctgcggctagagtgcctcttcaggcctaatcccaacccatcattcctcagtgggcggggcttccctgcaggatctccaataactccagctagaggctcggggacagaattcagatctccctgggcctgagtccctagggagagggatggccacagtctctggggaccagcagacttgctgtctcctcttggtagttctgagaaatccaggcagctcagatgagtgggttttcccctagtgaaacataccctctccaccaaaggacaaagtgcttcattaaatgggtcctgctccctgtgccacccgattgggtgagaccctccaacaggggttgtcagacaccctatacaggagtcatcctactggcatcaggttggtgcctgtcgaggtcagaggtcccagaagaaggagcaggcacccatctttactgctctccagactccttgaatgacatctccaggaactggagcgaatcacatgaatacgacctgaagtgaacccctagcaaactgcagcagtcctacagaagagggaccaattattgaaagaaaaacaagcagaaagtgacaacagcatcaacaacaacaacaacaacaaaaaggcctccacaaaaaaccctatccaaggatcagcaggctcaaagactgaaagtagacaaattgaggaaggtaagaaagaatcaatgaaaaaatgctgtaaacccaaaaggccagagtgcttcatctccaaatgattacaatgtcaagggcacagaactggagggaggatcagatggacggattgacagaagtaggcttcagaagatggataataaaaaactatgatgagctaaaggagcttgttctaacccaatgcaacgaagctaagaaacttgataaaaggaattgctaactagaatacccagtttagagagaaacataaatgacctgatggagctgaaaaacacagcatgagaacttcacgaagcatacacaagtatcaacagccaaattgaccaagcagaagaaaggctatcagagtttgaaaactaccttactgaaataagacatgcagacaagaatagagaaaaaagaatgatcaaagtcttcaagaagtatgggacttgataaaaggacagaatctgcgattgattggagtaccagaaggagatggagagaatggaaacaagctggaaaacacacttcagaatattatccaggagaacttccccaacctagcaagacaggccaacatgaaaattcaggaaatacagagaacatcattaagatactctgtaagaagatcaaccccaagacacataattatcagtttctccaaggtcaaaaaaaggaaaaactgttaaaggtagccagagagaaaggccaggtcacctacaaagggaagtccatcagactaacagtggacctctcagcagaaactctacaagccagaaaagattgggggccaatatttaatatcttaaataattttcaacccagaatttcacatctagccaaactgagcttcataagcaaaggagaaatgaaatcatttccagacaagcaaatgctgagggatttcattaccaccagtcctgccctgcaagagctcctaaaagaagcactaaatatggaaaggaaaaaccagtaccaggtactgcaaaaacacagcaaaatataaagaccaatgacaccatgaagaaactgcatcaactattatgcaaaataaccaaatagcatcatgttgacagaatcaaattcacacataacaatactaatgtaaatgggctaaatgccccacttaaaagacagactgggccgggcatggtggctaacacctgtaatcccaacactttgggaggctgagatgggtggatcacctgaggttgggagttcaagaccagcctgaccaacaaggagaaaccccatctctactaaaaatacaaaattagttgggcatggtggcacatgcctgtaatcccagctacttgagaggctgaggtaggagaattgcttgaacctgggaggttgcggtgagccgagatcatgccattgcactccagcctgggcaacaagagcaaaactctgtctcaaaaaaaagaaaaaaaaaagacacagactggcaaattgaataaggagtcaagacccatctgtgtgctgtattcaggagacccatcttaaatgcaaagacacacacagcctcaaaataaagggatggaggaaaatttaccaagcaaatggaaagaaaaaaacaagaaagcaggggttgcaatcctagtccctgacaaaacagactttaaacaaacaaaaatacaaaaagacaagggtattatacaatggtaaggggaagaattcaacaagaagagctaactattctaaatatatatgtacccaatacagaaacacccagattcataaaactagttcttagagacctgcaaagagacttaaactcccacacaataatagtgggagactttaacaccccactctcagtattagatcaatgagagaaaaaattaaaaaggatatttaggagttgaactcagctctggatcacgtggacctagtagacatttacggaactctctaccctagatcaacagaatatacgtccttctcctgtgccacatggcacttaccctgaaattgaacacatattttgaaataaaatactcctcagcaaatgcaaaagaactgaaatcgtaacagtttcttggaccacagtgcaatcaaattagaactcaggattaagaaactcactcaaaacgacacaatttcatggaaattgaacaacttgttcctgaatgactcccgggtaaataatgaaattaaagcagaaatcaaaaagttttttgaaaccaatgacaaagagacaacataccagaatctctggaacatagctaaaacagtgttaagatggaaatctatagcattaaatgcccacatcagaaagctagaaagatctcaaattgacaccctaacatcacaattaaaagagttagagaggcaagaacaaactaatccaaaaggtagcagaagacaagagataactaagatcagagaagaattgaaggagatagagacatgaaaaacctccaaaaatcaatgaatccaggagctgattttttgaaaaaattaacaaaatagatagaccaatagctagactaataagagagagaagaatcaagtagacacaataaaaaatgataaatgggatatcaccactgaccccacagaaatacaaactaccatcagagaatactataaacacctttacgcaaataaactagaaaatctagaagaaatggataaattcctggacacatacaccctaccaagactaaaccaggaagaagttgaatccctgaatagaccaataacaagctctaaaattgaggcagtaattaatagcctaccaaccaaaaaaaaaagcaaggaccagatggattcacagctgaattctaccagaaatataaagaggagctagtaccattctttctaaaactattctaaacaattgaaaaggagggagtcttccctaactcattttatgaagccagcatcatcctgataccaaaattaggaagagacacacaaaaaagaaaacttcaggccaatatccctgatgaacatcgatgcaaaaatcttcaataaaatactggcaaactgaatgagcagcacatcaaaaaacttatccaccatgagcaagtgggcttcatccttgggatgcaaggctggttcaacatatgcaaatgcataaacataatccgtcagataaacagaaccaaagacaaaaagcacatgattatctcaacagattcagaaaaggcctttgataaaattgaacatcgcttcatgttaactctcaataaactaggtattgatggaacatatctcaaaataagagctatttatgacaaacccacagccaatatcatatggaatgggcaaaagctagaagcattcctttaaaaactggtacaagacaaggatgccctctctcaccactcctattcaacatagtattagaagttctggccagggcaatcaggcaagagaaagaaataaagggtattcaaacaagaagagaggaagtcaagttgtctctgtttgcagatgacatgattttatatttagaaaaccctggctgggtgcggtgactcatacctgtaatcccagcactttgggaggctgagataggcagatcacctgaggtcaggagttcgagaccagactggccaacatggtgaaaccctgactctactaaaaatacaaaaattagccaggtgtggtagtgcacacctgtagtcccagatattgggaggctgaggcaggaaaatcacttgaacccaggaggtggaggtttcagtgagctgagagtgtaccagcctgggcaatagatcaagactctgtttaaaaagaaaaaaaaaaccctcatcatctcagcccacaaacttcttgaactgataagcaacttcagcaaagtctcaggatgcaaaattagtgtgcaaaaatcacagtcactcctttacaccaataataggcaagcagagagccaaatcatgaatgaactcccattcacaattgctacaaagagaataaaatacctaggaatacaactttcaagggatgtgaagacctcttcaaggagaactacaaaccactgctcaaggaaataagagaagacataaacaaatggaaaaaacattccatcctcgtggataggaagaatcaatatcgtgaaaatagccatactgcccaaagtaatttacagattcaatgctattcacatcaaactaccattgacattcttcacagaattagaaaaaattattttaaatttcatatggaatcaaagaagaccctgtatagtcaagacaatcctaagcaaaaagaacaaagctggagacctcatgctacctgacttcaaagtatactacgaggctacagtaaccaaaatagcatggtactggtaccaaaaccgacatatagaccaatggagcagtacagagacctcagaaataacaccacatatctgcaaccatctgatctttgacaaacctgacaaaaaacaagcaatggagaaaggatctcctatttagtaaatggtactgggaaaactggctagccatatgcagaaaagtaaaactagacccctttcttacaccttatacaaaaattaactcaagatggattgaagacttaaatgtaaaaacccaaaccataaaaactctggaagaaaacctaggcaataccattcaggacattggcatgggcaaagacttcatgacaaaaacaccaaaagcaattgcgacaaaatccaaaattgacaagtggggtctaattaaactaaagagcttctgcacagcaaaataaactatcatcagagtgaacaggcaacctacagaatgggagaaaagttttgaaattttctgacaaagggctaatatccagaatttaccgggaacttaaccatatttccaaaaacaaaaccaaacaaccccatcataaagtgggcaaaggatgtgaacacacacttctcaaaagaagatatttacatagccaacaatcatgaaaaaaagctcaacatcactgatcatcagagaaatgcaaatgaaaagcacaatgagataccatctcacgccagtcagaatggtgattattaaaaagtcagggaatagtagatgctggcgaggctgtggagaagtaggaatgcttttgtactgttggtgggaatgtaaattagttcaaccattgtggaagacagtgtggcgattcctcaaggatctagaaccagaaataccatttgacccagcaaccccattactgggtatatacccaaaggagtataaatgattctactataaagacacatgcacatgtatgtttattgcagcactgtttacaataacaaagatatggaaccaacccaaatgtccatcaatgatagactggataaagaaaatgtggtacatatacaccatggaataaaatgcagccataaaaatgagtgagatcatgtcctttgcagggacatggatgaagctggaagccatcgttctcagcaaactaacacaggaacagaaaaccaaacactgcatgttctcactcataagtgggagttgaacattgagaacacatggtcacagagaggggaacaacacacaccatggcctgttggagggtgaggggtgaggtcagggaacttagaggatgggtcaataggtgcagcaaaccaccatggcaagcgcatacctatgtaacaaacctgcacgttctgcacatgtatcccatttttttagaagaaatttaaaaaagtgaccattaaagaggcattggcattgattaacagctctgagtaagccctccgaggatcggtccatgtggaaatcatgctttcctgctgcctcttctgtggccgccaatttgaacagggctagtcatcatcagcaaaagccagaatctatgtacgtcacagtaatcccctcccccaccttcttcaccagcgggtaagagactggtaaaaagtaaaggcgtgagaagtgatgagaatacttatctgcagggagattccaaatcttgggagccactgccctattttcagtgtggcagattgcattccagaataaggggccaggtgtgggcacagagctgaagcaggtgctcctgcagctcctctttgtaattagctcatgtctgctcattctttgactctgcaccttactgctgctgggctgctgctgggctgctgctggctttgtgtcttctctggcaatatgccagggtgctgaagaaggaaggctggggaatgtgatgagccctttgtcacctgccaggttgccagcatctgatagcaggcatagcacagtggcctgagaaggctgcctgattagacatgtgcttccctgaacctgtccccttcttagcactcaacacctgtggctccttgttggcaaaggaacaagaatttgtcaaacaataagcattcacacctattaaattagtcatttggcataacttgcccaagcttgtgataaaaggcctgccagtgaatactgaagggtacaaaatatagcaatggaaaaatcatgtatgcacacatatgaatttctatcactacatatattatgcctggacatatgatcagtcacatccagatgtatttgttttcattaatccattggttttatattcattcttttatagattcaccacagacaaggcacggtaccaaagattagggttactatagtggtcttcatttagtttctctaaaactccatagtttgtctttctggaccttagcatatatgtttcttcagtctggaatggtttccttcctcccctatctatctactcttttttggtggcctagttgacatttcctttttcttcttcaagaggttaagtctggttgagggattggacacattagcagctattgtgtgggaaatattaggctgggggtaatcacaaggtgctttggaagcctaacaagtagagacatctatctcggtctcagagtgtcaaggaaagcattctgaaggaattttggtgtgaagatatgcaaaataagtgaagcagagaactagctaagtggggtaggtaggagaacagaatcctagttaaaaaacaaaataaaacaaaacacagaaccagccatgtacagaagcctgtaaatgagagagagattgttgagcatgttcaggaaactgaaaagtggttcataatggctggtatagaggtgtgaaatgggggactgagagagggaaggatgggccagtaagtaaaagctggactaagccttgctgattttggactttattcagaaggcaacagtcattggagggctttccagagaaacaatatgatgagatgtataattctagactactgatcatggtggcctaaaacaaagtagtggtatttaggatagagagactagcagaatgtcaggggagatgcattatgaacttacacacaacacacacacacaatcgtaattttattaaaataaaaaaatcatattctaaattattttgacagttttagcttagctttatatcatacaaaatcaagcatctttttacatcttttttatatgtttgcttgttttggttaaggcatacataccgtcccctagatcttctaaaatatttattgcttcatcttttgcattgtacgatcttaattgatctggaatttgattttgtttgaggcatgagatgggatttaattttattgttctccagacggctagtgccatttattaagtaaaccattcttttccctttgaattgaaatactgttctgtggtatattaaaacttctcatatacacagatttacttcagcaaaatgacataattttatgcttttttgcaatgtgtttactggttattttattttcatatctcacagtattttctagaacctccaagataatattgaaaacgatgatagcaagcatacttgtcaaatttctgattttagttaaaatgtttttagtattttgctatttagaataagctgcttctggtttttggaaaagatcttttattatatttgaacagtttctttatatcttattttattcaaaatgcttattaagacttgaatctcacacttttcagaatctactgatatgatcatattttgtttacttttatgaatgtaataatttatgctgatatattttccactgctgaactaccgtttcatttctgatataaatcctacttggtcatgatgatttattcttttataaatcgctagattctatctgctactatttttgcaaatattcataagagaaattggtcttagtatactgtatcagcttttgacataaagttatttgggattaataaaaagaattgagtgattttaatttttttctatggccggaaaatattttaaaaactttgcagtcatctagtttttttcctaattgctagccagaactcaggttcttcttgagtcaactttggtcatttatactttgccagatacttacccatttccattccatttacacatttgttcacagcaagttgcatgtttcttttctgatttatctaattcgtcttaatatgtgcctatgtattcttattccaatttagttactttctttcttaatttcagcttttatctattaattcctactccatagtttttttcttaagctcattacagttttcttaatttggaagctctttatttacttatttatttttgttgctgaaaacatttctggcattttccttgagtatagttttgttgtacctcagaattgtgtatgatgcaggctcctttttattgatttctaaaagttataattccaattttgactttccctgtaatccaagagaatgtattgcttaactctcaaatatatatgccaccttttggttatttctgtttattattaaaaatgtgatctgtaaaatctttaaaatattttatggggtttttatgatcaagtatttgagcaatttttgtaattttacatacatataatacatatgtacatatacaaatgttttgagtttgttgcttttgctattttatttttctgactttgcctttttgttagtttttattattaacatttatttaatttctctgattttgctttttagttttgatcttttgatttctcaaaaggacacattaaagtttttcactaaaattttatttttatcaaggttttcttttatcttcattgttctgttgtatataattttaatttctctatgattttgctgatctattcgttacatagcttggtactgagagacatgtattagtgtttcctactataattatagttgtatagatttcttctttcattctttttttttttttgtgagatggagtcttgctttgtcacccaggctggagtgcaatggtgcgatcttggctcactgcaacctctgcctcccaggttcaagcgattctcctgcctcagcctcatgagtagctgggattacaggaacctgccactgcgcccagctaatttttgtattttttagtagagatgggtttcaccatcttggccaggctggtctcgaattcctgacttcattatccacccgcctcggcctcccaaagtgctgggattacaggtgtgagccactgtgcccagcctcttctttcattcttaattttgaaaatatataattttgaaactatataatgctttattgaaatatgatttacataccatgcaatttacctaacaaaagtgtacaattcgatggttgttaatatattcacaaagttttgcaaccatcactacaatcaattttagaacattttcatcactccaaaaagaaaccccatactcattagtaattaattcctaattgtttttgctttatatatttagctacaatgttgcttggtttatgtctcttaggtcttctttgtaaattgtgattttgttttactttgtctctttttattctgtttatcacttctccccttattctaccttgttgatattaatattgcccctccattgctgctttttttcttgcagtttctttgaattctttgcctgttgactcattttcaaccttttattttttaatcaccttttataagtacaattcttgtgagagttttctcatttaatgggatgatttattcatttacatttactttaatccgtgagctatatgattttcttgatttatcatatttcttttacattgtttttgtttctggtcttttgctgttttgatcatgttgacatatacataatatttgaccttgtatttggagagttctactccaatttcccatttcattattgattatcttcctttttctcttagtagaattagacccatgggttttttattattttaaaacaaaatatcaattattttctttctaagattatattattcctatccccccaaatccccttaagaagaaacttttagaataggtttacttttctcctctctaccttctcccctctcctcaccatccaagtcctgtggtttgctgagattgtttagtttcagaatatgaacaaaatttaccttgtggtagtttggtagtttttctatgtatcagtagcttttttgtttgtttgtttgtttgttttttgagatgggtttcgctcttgttgcccaggctggagtgcagtggtgtgatctcagctcactgcaacctccgcctcccaggttcaagcgattctcctgcctcagctttcccaagtagctgggattataggcatgcgccaccatgcccagataattttgtatttttagtagagacagggtttctccatgttggtcaggctggtctcgaactcctgacctcaggtgatctgcccgcctcggcctcccaaagtgctgggattacaggcgtaagccaccgcacccggcctgtatcagtaatttaaaattaatgttcatactacaactgtccaggtaataggtcattatccataatacatgtctaatatgtataaatgtgtggacatttgtatgtatgtacacatttgtatatgatgtatatgtacacatacatcagaaagcatgtgtctatgtgtgtgttgtagggttcattgctcactaatgtgtctacttttccttcttctcttaaccagactcctctacttcttcattctgagtgatttcttgatcgattaatgtgtttttttgttttgttttttttgtttttgttttttttcattttctaaggtgtttcactgagtgatggaatctctgaatctttgccagatactcttctgggtgataaacttttaggtttcagttctctcagtatctcacctgtatttttctctcatcatctagctttcattgttgcagatgaaaagtaaattttttttaattacctgttttctcttgcaacttaaaagatcttctttatctctctctctcttttttttttttcaggaatccaaccagatattcttaggggtgtgtgtgtgtgtctgtgtttcttatcattcctggttgcaatttatgctttttccatctgtagatgtaggattttccatggttcaggggaaattctctctgtaattcatttagttatagtccttcttccattggtttcttttttctcattctacattatagtgtttttagaggttgttcctctaaatatgtttatggaaaatagaaggatcacagaaaaaatactacaagggactatctgctattttataagaaagacacggacatgtgctttgtgatttgaaaggaaggagtaacactgatagttttgtagtgtatgtttatgatactgcacttgttagatgtggttactaggtgaaaaaattcgtttcagagtactcacatgggggttggcttcatcttcattataccacatttctcattgttaaaatttatttctgatgtatgttttaaaacataaattcacagattaaaaaattttattttaaattcaggggtacatgtgcaggtttgttatataggtaaccttgtgtcatgggggtttggtgttcagattatttcgccactcagatattaaacctggtaccgttcagttattttttgtgatcttctttctcctcccaaagatggctccccagtgaatgcttcctgacatttacactcttctacagtaattttcagtacaaggtctcactctgtcactcaggctggagtacagtggtgcagtcacagctcactgcagcctagacttgcttgggctcaggtgattctcccacctcagcctccagagtagctgggactgcgggcctgcaccactatgcctggctctttttttgtatttttagtaaagacagggtttaggcatgttgcccaggctgggaccacctgctttttttttttttttttttttggagacagggtctcactctgttgcccaggctggagtgcagtggtatgatcacgggtcactgctacctcaacatcctgggctccagtgattctcccacctcagcctcccgagtagctgggactacggactacaggcatgtaccaccatgccctgctaatttttgtacttttttctagatatggggtttcaccatgttgggcaggctgggtcttgaacttctggactcaagcaatcagcctgctttggcctcccaaagtgctaggtttacaggcatgacccactgtgcccagcctaacctgtttttttatttaagtctcccttcaaacattgtctctctgaggagaggcagatactgtttttcttctacttccgtgggtactcctgtgtacccctgttgtagcccaaccataatgtaatttactgttttgtaggggcccatgagagaaagtcatgtgtctttttgttttcatatccttagatgtggcacaagtgcaacccttaaaaggttagtaatattcaccaaacaaatacttagatgaatgcttaatttctatgaaacaatgcttattctccaggtgtcaggcattatgccagtgatagatacgcagacataaatagggcaaggtccttgtcctcaagaaatgccatctgaggtggggtgggatagcagatgagagacaacagggccagatcatgaaggaacagatcgtatttcatttacagctaaaggatgccagcatttatgctattcacctttttaaagaggtgaattaacagtagttaaaaattctaacttaacttacccattaataagagcagctttgttataaattttgccacttgaggaaatgtattcttatagacccagatgtcaagctgtcatagaatcttgtgatgtgaggagattagcattgtctatatgtttcaaatgatttactgtaagtagggggtttgcgtcaatcgtaggcggaactttgggagtcagaattgcatcagttgtctgaattgaattactttgtctgtgctttctgaattttgagattaaagtttaaaatcaaagtcttggctattgacttgtatatttgtaaaagttgaagtaatcttttcttagttttaatattttcaaatctaataacttttttcttttctgatcttgtgcagtttaacagttctgggaataaaaatctttattagttaattgaatattatgggtttatatagaattgccattcataatattttaatgtaatattcaaaaaaattcatttttttttagtaatacaacagtcactttagcatctggtattccttagcatcatcatttgaaaattaacaatattgtaccttaaagtacagaggtcctttataaagcagcaggctttctagttgatagattgctgcgcatagagtagtttttagtttgttgcctatggtgaacttcttattttctggatgattctttgggatcctggcattaggcacagaacataagcttacactgtattgtctttacatttgtgtgcaccataactgtgaggaccttttcaatgttatgaaaaatgcaagttagaagaacttctctttttctcttcaatgcacatggacctgaagtcttttgaaaatacagttcttcaaagtttagaagcaatccatggaatattttcagtgacacacggaatattgtagttcagcatatatggtcagtttataggaatttttatttattctgtatttagtttttaataagaatttcataactggaagatttcatagcaacaaaggactgtcattgaatgtgtatataaatttaacttgtatcttagagttttctagttataacatagtgatggtgatgtaaggatttggcatagaaagaagttttagtgaaggaagtgagaattaatgttcatgcagagtaatcaaaccaggagagtatggtttgataagccaaaagagatgagagttttaggaggaagggatgattaatagtgtcaaattaaaggaaaaacagcaaacaaggttaagtaagataaggacaaaacagtatgtattgatttaagtatttatgaaagcagtttcaacagagcagttggaacaggagactaatggcagtgaatattgtctgtctttgttttctcttctacactagagaactggacagataagtactattattgtctattctggctgacattattgttagtgaatgcaacacatgttgaagagcagtcttgtaacctggcaatgtgacatgagtggtgatatttttatcttaataagtgactttctcaacaagtcttgagcatccaatccatgaaaccaaaatgaatatgaaatgcttattaataaagggactgtttctcacttaggttttctactcattttcctatcacattgattttaagaagttctttgtcaaactgacttcttggctaccagaagttttagactctatagtaagctcttaaagaatattagatgtgctttgactattttaaaaacaatattattcactctgttcatttgcctcacttctggctgggaggaacactcagggaatgataaaggtaggaaagcagctaagctgtagacagcctagattgctctgcactctaatggggcgctagcaaagtgaccttcttttcccagtcctgcctgatttgcaggacttcaaatgagatgatggaaatggggcaagaaaatatgaatatgtaaactacatgtattgatttcaaccaatgtcaaaggagaagcaatagagtttaggtagaagctgtctttaatatgcaggccaaaatcttttgtatgtgttatagtcctctttggcacataaattccctcatttttcctcatatcatcctcaagggggggatcttgtgatcacatgtgatcctgcttcttattacgatagaatacattgtgcacacttatttatttttcattgtaatatccagcactataaggtggaactcttttgccagggcatcagggagtgattatatatggagaaaacttaacaataacctttaattctgtctcatcagattcctcctccatgcttggctgcccttacttttgtgggtgaaagaatgtaaatcattccagagttctgtcattattattttcttgttttttctccttttccctgaggtctagctgacctgcatgtctttccctgagattgctaatgtaagccttttgtttccaccagatagcttgatgcctatccccattcatgtgccatagatttcttttctggtttatattttccacttaatacatgcatttcgataagaagtaagatgataatatggatgtaatatggacataatatgtaggcaacttggatattctgtgaagaatggggaaatcattaagaaaaagaaaaatatattatttatgataactactgcaaggctattgaaaggtgaacagctagattagcaacatttaaaaagctgatgctctgggagttagggggaaggaagggataaacaggatttttagggcagtgaaaatgctctaagtgatatgataagtgtatacatatcattatacatttgtttaagcccacagaatatacaatattaagagtgagccttaatgtaaaccatggaatttggatgataataatgcatcatgtaggttcatggattgtaataaatgtaccactctggtgggagatatgataatggggcaggctgtgcatgtgtcggggcagagagatatgggaaataactgtgccttctgctcaattttgctgtgactctaaaactggtctaaaaatatgtagtctatttaaaaacaaacaaaaaggttcatgttcattaacattttagaggcatcctgaagatgaactgaaatttatattttctgattcaagatgagtgaattaacctatgtggaaatttgtggatctaagagaaataacctttgttactttattcagtagttactcttttgataagcacttaaaaagctataaattcaattatttatattagacttcactaacatttgcttcccatttacctctaggtttgaagtttgaggaaattcaaaaaagatttggtgaagagttctttaatatatgctttcatgagaatgagagagtccttcgagctgtaggtggcactttgcaggacttttttaacggctttgatgctttgttggaacacattagaacttcttttggaaaacaggccactctggagtcaccatctttcctatgcaaagagctccctgaaggtactctcatgctccactacttccaccctcaccatattgtggggtttgcaatgctggggatgattaaggctgcaggaaagaagatctatcggctggatgtggaagtggaacaggttgcaaatgagaagctatgctctgatgtttcaaacccaggcaattgtagctgtcttactttccttatcaaagaatgtgaaaatactaatatcatgaagaaccttccacagggaacctcccaagttcctgcggacctcagaattagcatcaacaccttctgtagagccttccctttccacttgatgtttgatcccagcatgtcagtccttcagttgggggaaggtctaaggaagcagcttcgatgtgacactcacaaagtgctcaagtttgaggactgcttcgagattgtatctccaaaggttaatgccacctttgaaagggtcctgctgcgactgtctaccccgtttgtgattagaaccaagcctgaggcttctggctctgaaaataaagacaaggtaagtgctatggacttgagatggtgatgggaactagaagagtggataattatttcagtaaattacatggtggctgtacttgtaattatttaggcaagagagcttaaagtgccatttagaagattactggtccctggatgtatgtaaaaagatttggcctcattcccagccattttgcatagtgtctgcctcctccattaatttatttcagcatataaaaagaagacatttattaatactagctatagcaattacaaaaatgatagaactcactaaaaacctgataatataaacacatgaatatttccactgaatgtagtcaaactatgagaaatatagcatttcaatattgtggggcgtgactgcaatatctttaaatacatatgctaaaagttaccttcactttgaatatgttcttttctaaatttcataatctgggaacatctggtttacatcctatttttgtcttaatatgcagaataatgtattccccaaaagctgagaattgactatctcgagacttctgtttaaattttagtattaaaatagagattcattgctttagaacatgatctctagttgagagaataaagtgaagactaggaaattttttgtggatttctttgaatcccctttgggaaatctggattataaattataaataattgatgaaaagacaccagaaataaatcttaaaatatttgggtttaaatgaacattttgtccctcaggtaaaatattttaaaaagtcaacattaaaatagataataaaatgtaaagaaaaataaaccatgattttttatgtttagtaatatgctttcagtgattaaacggaaaaacaacattaatttccaggacagaaatttgtatagttccattcagtttccagtagagtgtcttttcaacattttgtactagggtaaataaagttcttttaggctatttagcctgtttccaagcatttgagggaagctattagctattagaaatgacaggttgctctgggctaaaggaaagaagagttgtagaagtaattaaagactcagtgaaaatatacatattctggaataataataaataaatgaggaaatagccctctgaaagcagcgcttaacttgtttttgaggattttatacagcattagtttcatgattgatgatttttataattttgaagttcaatggaaagttttttaaaaaaaatattcgagaaagatggctgggtgtggtggctcacacctgtaatcccaacactttgggaggccgaggtgggcagatcgatcacctgaggtcaggagtttgagaccagcctggccaacatgatgaaaccccatctctaccaaaaacacaaaaaaacgagctgggcatggtggcgggtgcctgtaatcccagctactcaggaggctgagacaggagaatcgcttgaacccaggaggcagaggctgcagtgagctgagatcatgccactgcactccagcctgggtgacaagagtgagactctgtctcaaaaaaaaaattatttgagaatgatagaaagatgcacatttattcaatatgacgaaatcaggtggtttaggaaattaataatgtttttatcatacaagttcagtgatttgaaaatatctaaggatagacctggattccagtttggcacatttggatattttagtctgaatgaattagtattatttgatcatatgatgttttaaatacaaattgtcacatatgtatattatatgtatgtttaataattgctacccattttgaagtcctttagaatggaagaaacttgttaaatgtgtatttttgttcacatttgtagatgctttaaaacgagttattctttctctttaatttagggaatatcaaaactatcagttctgttttacagaagcacaatatttggctaggagaatttgaagcatttttggcctttagaattgaagttggtgtttttggaaatatttctgaactagaatatattattatcaatgttgttgctttatatattttatcgatttgggaaaaattaattcattttaaaatgactgcttcaggttttttccccttatatttcatttggcttctatttctatttaatttgtataccagggtaagaaatagacataatgaaatgatgactcaaatgtcaaggccccctgccaattccaataataaggaactgtgctcattgaggagatgcaattatcatttaaacatgttagtggcagtttaaaaataaagtaataggcaggatttttagttaaaataaggatagaaatctactcatccttatatttatttctgcttactcacctgagtttgccagaatgggacatttgagaggttacagttgccccaaattgatactatggtcagtaaagttgtcacatacagtcttacccagatgaataacatttttaaattagtaagtcatcaaatttcacatttacagtttattaaaacatggaaagaagaaagaaaaataatatgtaaaaattgtgtttttgttgataaatttgactttgtcttcattattttccccataatagctattcttgttaatgtatacctctatgatgtctgaagtctctaattttttagttggcttttataagaaaatgctattttaaaataatttatatttattccttcttctaacattgagggctctcataatttaactgttttgtttgtgcatttaataccaatgaaccactacgtctgccataaaaaaaaaaatcaagagcaagcatgtcaccgaggggcatctgacgcagttatcagtggcaggattcaacagtcttgaggttagaaaaaaactcttccagatggcttgaccaagctttgattctatcacttggtttcctctacattttctctaagtgatcatccatgcctcacatattcttctctctccctattttctttttcctcattatagtattcgtatgttttcatctttccctaaactcaacttcctgtcatcatcatctttccttatcagatgtcaaacattaagtatgaatgaattggttgtttttaaaaaacccaacagattcagtgtagagaataaagactgaattaatccatgttaatttgtgctgtgtatttctttcattccatgtatatcaaatattgttctgagaatttggaaatgtattgcatagatcttttgaattacaagacattgtggtaaatttgagatgaattttttttgcagcttaatgagcagtttgcagttaatatttagtccatgtaaacataacctactgatatagattacaaagcttcttggtatggaatgaatcttgtttgagtgaatagctttgttagaaatgagagtaatagcacatagcttccttctctgccaggtaaggtcatgatgtgtggtgaaagtatcaacaggctgggagagaggtgtctctgacagccatgatcttagtaaatctttttaatgtctgcacctcagttttatacattggaaattaatgaacctagacaaactaatatttttactcctttacaaatcatacttaacatatatacatatacatgaggtcaattgatcatgattttttttttaattttttttttaatttttttttttggagatggagtcttgctgtgtctcacccaggctggagtgcagtggtgtgatctcaggttaccgcaacctccacctccctagttcaagcgattctcctgtctcagcctcccgagtagctgggactacaggtgtgcactaccacacccagctaattttgtatttttagtagagactgggtttcaccatgtttgaggccagactggtctcgtctcaaactcctgacctcaggtgatccacccaccttggcctatcaaattgctgggatcacaggcgtgagccaccgcacttggccatgaagctttctttcatctctatgtttcagtgaattcagatgcattttaaaagagaggtgcggagaatctgacttacctaccatgaagggatcatcttgttatcaagaattagttaaaataattctctggtagtttaggctgcctacctcagaaagttatttgggaggattaaatgacataatccatgtaaaattcttagcatctttgaccccagggataagcactgcataaatgttcattattacttctactgctattattatttgtgttcctttccacctataacagtctccgtatttattcccctattcacttactgccttatagatgaaagcaccaggtatcagtaggtttgataattttagagaaatattgagctcacctaacatcttcctaaaatatgccttggaccctgctgcttgtctccttaataaagactagaagaccacttgtcacacattctataggagctctgtttggatctgcattttatttacatactatcattgttttaaaatctctggtctctgtcagattgatgaaggtttggaatcgagttttcattacctgtatctactaatgtcgtttatgttcatttatcagagcattgtgcagtaacttccaaaataaaatggatgtgttaacttaggcacaacctgaagcagcaacggattttgagaaacaataaataacatgagttcttttgacatttttttttagtagcatcacttgagagaactttaatagcaccttggaaggaacccagcatttgaaatacatcatccctgcgacagagcaatagcattgttattcatcttcacttttgttctcagggttggaactgaggaaaagcataacaaaaacacatttcttttttaattcccagaaatatgctctcatttgtcttattaattagaagctacaatcaaacgctgggaaacaattttcaaagaataaagtaggaaatgtctggttttctgtggccaaatcagttttcagaatactctcttatcttttctagacagttgcccacctttttctgaggcgatgattgaaaagtttttaagtatttattaatcttactataccataatgaaaccgttgaaagacaagtttcatcttgctgtcaagaatacattatttgacttcaaccttaatttaatttgagaaagtgtgagcatttcttctttgttcagataataatattttattagagaatttcaaatattgaactgtagttacctttagtgatgaacaacctgacattagagctttctctatacattagcagagctgagacatgatttcgttcagaattacctggagttcactctgttcttgtaagtatgaatgagacctttatttttaatttgtgtgttgcttacctttctctagaactgctctctgatcattgcccttttttcttttaatgtaatttattattttttaataatttgaacttcatctagattcagtgggtacatgtatgggtttgttacgtgggtatattgcatgatgctgaggtttgggctttgactgatcccctcacccaggtcctaagcatagtgcccaatagtttttcaacccttgtcccccctttcccatccagtagtcttcaatgtctattgttgccatctttatgtccatgagcaccaatgtttagctcccacttttaagtgagaacatgcggtatttggttttccgttcctgtgtttgtttgcttagaatggtggcctcaagctgcatctttttttatggctgcatagctgcatccagctatgtgttctttttaatggttgcacaatattccatgatatatatgtactacattgtctttatccaatccaccactgatgggcacctgggttgattccctgtcttcgctattgtgaatagtgctgcaataatcatatgagtgcagtgtcttttgagtagaatgatttattttcttttggatatataaccagtaatgcaattgctaggtcaaatggtagctctttttaacttctttgagaaatctccaaactgtttttcacaaacgctgaactaatttatagtcccaccaacaacgtataagtgttcccttttctccacagccttgccagcatctgttgcttttgacttattaataatacccattctgcctggtgtgagatggtatctcattgtgggtttgatttgcatttttctgatatttagtgatgttgagtatttttttatatgtttggtggctgtttttatgttttattttgagaaatgtctgttcatgtattttgcctatttttaatggtgttattttttgtttgcttaacttccttatagattttggttattagacctttgttagatgcatagtttatgaatattttctcccattttttaggttgtttactctgttcatttactttgcttttcagaagctctttagtttaattaggtcccacttgtcaatttttgttttgttttgttgcttttgggacttagtaacaaattctttcccaaggccagtgtccagaatggtgtttcctaggttttcttctaggattcttactgttcgaggtcttacatttaaatatttaatccatcttgagttcatttttgtatatggtaaaaggcaggggtcccatttcattcacctgcatacagctagccagctatcccagcaccatttattgaatagggagtcctttccctattgcttatttttgtcaactttgctgaagatcagatggctgtgtgtagctttatttctgggttttctattctgttccactggtttatgtgtctgtttctgtaataataccaagctattttggttattgtaaccttatagtatagtttgaagtcaggtaatgtgatgcctctggctttgttctttttgcttaggattgctttggttatttgggctcttttttggttccatatgaactttagaatagttttttccagttctgtgaaaaataatgatggtatcttgataggaatagcattgaatctgtagattactttgggcagtatggccattttaatgatactgactcttctaaactatgagcgacaaggctcatgtatgatattttgatgcagatattagtgatgttcatgctggttctgggtttttaaaaattagtataaggttaaaattgctgtatggtattttttttaaatgaaccacacaggaggcttaatggcattgttcctgtatagttactttattgtgtatagtaagaggacactgtacatgattacatgatgaattatgtattcccaatagtcatctataggcttaaagtgcttattttgccatatttaatttttgttaacaagaaatattgtagccctgagcataacaggaggtacctcctattggagatcagatttttatttagttctattaaaggtttgtaggttctcagggataaaaatcaatccctttagttaaaaatcatacagaatcttcctttaactgttccttttgtttttaagttagaatcattttagccagtagctttaagtctcagtgaaaaaaaaatacatgttttcaatgtgttgtctacctcttcattttttgatagtttcctgtttgttcttgtgtacttttttggtaagtatacagtgcaataatttttagtaaatgaatataatagtgcatctacgacaacaatttggttttagaaaactttatcacccccaaaagtttacccatttgcagttaattcctgctcctacctccaactgcagccaaccactggcctactttcatctctatagatttgcttcttctactcatttcttacaaatgtcatcatacaattagttatctttctttttcttttggtttgccatcatgtttttgagcttatctgtagtgtagtatgcatcagcagattgttaatttttcctgatgaacagtattctattgcatagatacacacggtttgtttatccattcaccagttgatggacattgattttccagattttggctattatgaataatgttgcaatgaacattcacatacaagagtttgtgtggatatgttcccatttctcttgaactgatttgcagttgttgcatcatatagtaagtacatgtttaatttttaaagaagttgctgaactgtttttcaaagagcttatgccatttcccatttgactggcagcgtaagaaggttcagcttttacactcacacctggtattgtcggtctttttcatcatagccttcctaatgagtgcaaagtggtgtcttaggttttaagttatacttccctgatgactaaagatggtaaacatcttttcttatactttttagtcattggtgtaatttctttagttaaatatgtaggcaaatattttgtccatacttaattgttgtttgctttcctattaataaattgtattaaaaatatacattctagatatgatattgtctttaaaaggtacttcctatgcagttgtcttttataatcttcaatttactgtcctttaaaaatatttatggagaaacttctgttcagaaagtttcattcatagaaatgtaagtctgggctttatcggtcaacactgtttacatatttcagtatctccttcagttgcacttgactttatcctttctattgatatcttaggttgaaataacagttttcctctggatatattctgtgtggccatatgctggtctcgaactcttgacctcgtgatccgcctgccttggcttgccaaagtgctgggatttacaggcatgggtcgctgtgtccagccccgaagtactttcaaaacaggaaaagatatcaaaggcatggcaacataacacactaggtttcttttcttattattttgttacagttttacttttcaaggattttgagatttggtataattgagttccagaacttagacatcaacttagtattttttcctatagcaacttttgaatcatgacttaagctacagcatctttctttttgcaattgggttttatggtaatttctaattattataattctgatagaaacaattagctttacatatgctttgatagggcatcatccttgagcaagcacagaaaaaaagcagtattgagagacagtattgtgtatgattaagaatacagtctctgtagaatggcttgaagccgggaggcagaggttgcaatgagccaggatcgcaccactgcactccagcctggttgacagagcgagactctgtctcaaaaaaaagaatgcagtctctgtagcaggacttcccaacttcagactgttatttactagctgggtaaccttgagcaagttaactttttgaagcttgttttcattgccaacctcatagtcagtgggcctctcttgtttgttcccatttctttttaaaataactaccacattctcctgacttccacaaatatgtttactacttgtttcagttttatcactgaagacatatttaaacattcccttagttgtttttctcatttttaatccttagttttgactaagccttactccttttgttaaattttagtatcattattcttagagaaaaatgccaaaatattaatatttaaaaggcatatctgtctatccattagtatttatctgtatctatgtatcttaacatttctggcactgttttaagtgtcttccatgaaaatgttataagaaaggagtgaaagctgctttcaaatatttaaatagttatcatataaaaattagataaagtttttgtttcagaaggcaaaaccagtgtcaaagaatagatgttataagaaagtagatttggttaagaattaagaggaactttccaacaactggagacattaaaaatggagggagttgcctagtgaaataaaggtctatataatacttgagagttcataaagaaaatgaatgacagtcactcagggatattttactgaagattcataaagggaacccaaactttaaaggtaaataatatgatcacgttatttttgtaatgctagtttcaggaatagggagagtatccatattataaacattttgtgctattgtgaaaaaaaactttgattctgttttcttttcatagcagatatggtttaaccttaaaaagtaatgaattggtggagtagagagatttagaaaagctttgactatttagcaattcttcttctttcaaagcttagtacatagtggcttttaaaattcaactcaataaagtatgtttaaaatgctgcctgtatttggattccaagtttagtagacaatttctgctcctcaaaatgcaatgaaaacttgatttctatgatctatgatgaataataaaagctgcctttaaaacattttatacttgtaagagtgctttataagaaagccacttatttacatttttcagcctccatgaaattgaacctttaagaaatgctaaaatagtaaacaagtaattaggctatgagttattaacaagttttatttcagtttatttagttgttagacaaagctagtttacacatttctattatactggtggctaaagattatgatcacttattagagagatcagtttctattgtacttataacatgattcagaacccttcattctgtttaacagcatttccttattctgtgaagaaatgagtacagtttaccacattttatttttctgaaaataatcaaaatccaagtacagtcatacactacacattgatggtttagtcagattgactgcatatatgacagtggtcccataggattgtaaagccgtattttatcataccttttcaatgtttagacacaaaaataccattgtgttccagttcttacagtattcaggatagtcacatactgtatagatttgcagcctaggagcaataagctctaccatttagcctatgtgcattgtaggctatgcctctaggtttgtgtaagtataccctgttgttcatataatggtgaaattgcccaacagtgtgcttctgagatgtatttctcttgttgttaagtgattcatgactgtatttatgtttgaatcatacaataatcttggttcgttttccgtttttcctaatgaagacatggtggttttttttttttccttggagatacaggggggtcaaaaatctgagcatattgtaggtgacaagcagtggaagttgattccaaaactcttgctttttgaaggagaggtcaagaattatatttcttgtcagcacagactcatctgtgaagttgttgttggctgatgttaaaaatgcttgtaataacatgtgtaggttcttcaaaggattgagatttcaagcttacatgtctcaaaattttgagtgaagcagtgactcttttttggccattgaacaccagcttcagaaatccttccatccactgtagaagaggtgtgagggaatctctttctctctgtgaacatatatggagaactcatactatgatttatggcagcttgcattttcatatttttctaatttagatgttactatgaataaggtaggtgtagatctaacaatagaattgccataaacaggagttagaaattcttaacatcctacagtaaaagaattttgtgctactctgatacattttttaggtaggttataaattcttatcttactatcttaatatgactaattatgacagctatttttcagtagtttaattaccattctaccctgttctgtggttataaagacttattccaggccgggcgtggtggctcacgcctgtaatcccagcactttgggaggctgaggcaggtggatcaccaggtcaggagatcaagaccatcctggctaacatggtgaaaccccgtgtctactaaaaatatatttaaaaaaaaaattagccgggcgtggtggtgggcgcctgtagtcccggctactcaggacgttgaggcaggagaatggcgtgaacccggaaggtggagcttgcagtgagccgagatggcaccactgcactccagcctgggtgacagagcgagactctgactcaaaaaaaaaagacttattccatacaagagtttattattctgtgaaataatatatattattttatgtacaatgtttacattctatgtcaactcaaaaagaaaattttgtgaagtttgtgttcttatccccccagtttatagaaataaatagtacctaataaattatttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagaaataaagggcatccaaataggaagaggggaagtgaaactatccctgtttgcagatgacttgatcctatacctagaaaaccctgtagtcgcagccccaaagctccttatgatgataagcaggttcacaaagtctcaggatacaaaatcaacattcaaaaatcactagcatttctgtacaacagtagtcaagctgaaagccaaatcaggaaccctttttcaacttctaaaggctgcttgtgtcctttgcttacggccctttactgcatcttcaaagtgcatcactataacctttgcttcgttcttataaggaccctgtgatttttactgggcccagcagaataatgtagaataattgctccatctcaagatctttgacttaattacatctgcaaagtctcttttgtcatgtcagataacagattcacagattctgggaattaaagactgggatatcttttggggaccattattctttctaccacagtggaaaaccagcatcagcaaagttacggaagttgaaataagcatggagtgtatagccgaataataaaaagatcaaaatgaaatgtaaagtatgtattaagaagtgtggcaaacaggattgctaagcaggctggtataagttacaaagccctttaaaactcaggacaggagatttagatttaatgcagttaatactagcgaacattccaagtttttaaagaagtggctactgttatgaaaatggtatttataggaggttggtcatgtatgatttgtaggagagcctggtggagagaaagtttgatggcagggagaatcgtaaatgtacagtcagatgtggtaccttgcatagttatttacgtatgttggatacaatgcatttctataaattgtttgactcaaaaattatatttttgaattaaagtagcaattattaatttttttacaattcacttattttatattgtatctgtttttggaccatagtgatggttgtcaattcataccttgtcagtcagtggtttttctttgcttcctcattgtctttccctctgtcttaacacctatttgctaatggctattctgaagggattcttctttttctcattcagagaaatcttatgtgttcttgtgaaagtaactttatgttaggaatggtaaattactttttttagatattgttatacattttcttctttaattattaaatttgtgatattagtgaattcttccaagggggaagatactgacatcagactgaatatttactttaagtacatcttaactggagcttttattgctttcacctggaaagggtcaacacttagttgaataaaaaggattcacctttttacttgtaatggaatatcaactgcaatgtggtttttgatggtccaaagaccatggtgtcctcattatatttaacgtcagagtaaagtgccacatttcctctggcaccagaatggaaaggactgcatgcataatagataaaaaaagcatagatataaaaaaagatataaaatatactatttttctgctggtgataggcaccttctccatcctttccctattgcaatacatgaattttgcccttctccaactctaattgatggtcatttagtatcagagtaatgaattctatagttggcctgtaacctgtggctggaacttttgctaggtcttgggagatgagacacccactctctactgaggtggataagctggtaaatcttaagtttgggactgctgagagtcaccattagagagagttttcttaacaatgaagtcagtgcagaggaaagcaaagcccataaaaaagagtctcagtgttggtgagatgatttgagccctggatccaaccatgatttaaactcaaatatttctgtttcttttggtttataagccagtatattttcttcattatttaagctgattttagttgttcatctatcagtttctgtcaagactccactcttgcacagtacacatacaaccagaactcttacttgggctccaaagtctcttcaaggtccctctgtggcatgtttgtcatggtgttgagttttccccttcagctgcctgactttgtatcttggcagaaggagtgagctagatttccttgctacctcctggtaatttgctgagtcatacaactctcttcaaatatgatactgttatagtagcattaatacagggattctaaaggaaaaatatttaattgccataatggggacaaaaacctggttgataaatcttttcatatttttcctatttatggaattagaggaatgaacacaagactgtcttcaatttatctattactataatggattatttctttatttcactagcaataaatgttgggggattcctggggtatttataaggagtaagagatagttttgctaaaagaatctttaaagattttattgaatgtgagatatccagtaaatgataggaatcagtcttgattctcatccataatttctgcttagggagaaactttaaccaagtttttttttaaaagattaaatattacaatatttttttccagtttttttttcttttagtggctctcctttcttatcaccccatataacctaagaggcagagagagtagttctgttgctaactcttgcagaagttgtgcccatttcttttttctggtttgctgagatttttatgccaataataaggtcggcattcttctttggaaaagaaagttgtctaaattctacgtataagtggcactatagaaatatttggaaaataacaatggcatactaaaattacttggaaacaacaaatgaacagagcagtcactatgcagtgtctgcaattcagaacaactctgctttgagactgtgacataagataggcagaaggagggaagattcaaaaattttcttcttggataaataattagatcaccttttaattattatcagactactgtatgattgctgattttgttcctcaatacttatatgtgctatttctttattaatcaattcctggactactcggtttctgtattcgatcctattctacaaaggccacagcctattggattttaaagagcccttaagtaaggttatctaacataacatccagctgtgtgggagagtgcactatataatatgtattcagcaaatattttttgattacatattaattagaagacattgtgctagacatcaaagataaataagatcaaaataccctcctgctgaaactctcaatgtaatgagatagaagaatggagtgaacaggctactaaaatattctataataaaggataacattgatttatatatcagaggttccagaaagctctaacatttgaattagtctttgaacatgaagcttagaaaacaaagagcacgctaggcagaggagacaatatgcaaaaacatggagacatggagagttcatagacaatttggataattattaacagattgacatgagatgaaactagtctattggtgaagaacgtattaagaaaagcttttgtagcaattgcaacaaaagccaaaattgacaaatgggatctaattaaactaaagagcttctgcacaacaaaagaaactatcatcagagtgaacgggcaacctacggaatgggagaaaatttttgcaatctacccatctgacaaaggtctaatatccagaatttacaaggaattaaacaaatttacaagaaaaaaatggacaaccccatgaaaaagtgggcaaaggatatgaacatacacttctcaaaaaaagacatgtacgtggccaagaaacatatgaaaaaagttcaacatcactgatcgtccgagaaatgcaaatcaaaaccacactgagataccatctcataccagtcaaaatggtgattgttaaaaactgaagaaacatttgatgctggtgaggctgtggagaaataggaatgcttttacactgtcattgagaatgtaaattggttcattcattgtggaagacagtatggtgattcctcaaggatctagaaccagaagtaccatttgacccagcaatcccactactgggtatatacccaaaggaatataaatcattctactataaagacacatgcacatgtatgtttattgcagcactatttataatagcaaaatcatggaaccatcccaaatgcccatcaatgatagaccggataaagaaaatgtggtacatatataccacggaatactatgcagccataaaaaggaatgagatcatgtcctttgcagggacatggatgaagctgcaagctatcattctcagcaaactaacacaggatcagaaaaccaaacactgcatttctcaaacataagtgggagttgaactgtgagaccacattgacacagggaggggaacaaaacacaccagggcctcttcgggggtgggaggcgaggggagggaacttcagaggacgggtcaatgggtgcagcaagccaccatggcacatgtatacctatgtaacaaatctgcacgttctgcacatgtgtagctgaatttaaagtaaaattttaaaaaagaaaaaaaagaacagcttttgtgttggtatgtgtgtgtgtgcacatgcaccattctgaagaattgggacttaaattggtcatccagacagcatgcttatatccagagttcacaaagcagcaattacacttttgagtactgctaattgccggctttttgcctatatattttgctgagatctttttctgatttgtattcactggtcctattctcaactccttaaattaaaattagtataaatctcttttatatgactatccctcagatatttaaaagtgtctgttccttatcttctagtcttcagaattaaagttccagtcattcaaactatttatcatgctcttcatagaacattccagcctcagaatgtagatagtctaataataagcaacttgactggtatgtagcaatgttgtgacctttctctggattctgcaagtaggaatatgagtgtcacttatgataatattagtatttttattgctataattgtcagctacattatatttgtatatattgactttaaaacccatagattagttttccaagactcactcctgtgttgattctgcccaatcctgtaatcgtgcagatgattcctatgttacaaggttttacatttattcttgttcaatttaattatagttaattttggtctagcataattgcctgtagagatacttaaatcttcattctctttctctgtgttatcaaccgcttatgttttttaatcctgtgtaacttagataaatatactttcattctaacttttgataaaaatgtagaatttcaaaggatacatgacaacatctacagcagagcactatagaacacacgtcaaggctggtaatatgcagaatttgcaatataaaatacttcagggatttgactaattagtttaattcacctaaaccagctaatattttcctgtctatactcctaattcataatgagtctgttaaatatcttctaaatcaaagtacattacatctttgacattacccagatcaaatagtataataaccttaaagcaaatagaaatcgtgttaatgtgacataccttttcttttaatgcacatttgttgagtcccagaaatatgtccatttcattttccatgtgaatgtgactttatttggaaataagcttttggcagttataatcaaatgaccttaaggtgaggtcattattttaatacaatataactggtatccttgtaagaagagaagaaacacaaagacagatacacagggagaattccttgtgaccatggtggcagagatgggagtcacatgtctgaaagcatagggacagcaaggattgctgacaatactggaagttaagagagctgtatggaacagattcttcctaaagcctttagaaagagcatcaccctgtcaacaccttgatttttggacatctagcatccaaaactgtgagagaataaatgtttgttattttaagactgccagtttgtagaaaattaaaaaccttgacataacgctaatgtcgacatttcatttttaccccttttttgaaattagatcaaaatatactcatcttaattcttctggcagtaatttggttttctgtgtttctctgaagattactgaaggttgattaatcatcacattattaggatattttaatgttcctctaagtttatacaaattccaggtagtcagatgctcacttactccactgtgtactcatttaaaattgtttattagttgctaattatgcacttggaactaagctagacactggaaatatggacatggtccttggacttgagaagcttatcataataagccaatgaaaatatcactgtaatttagagcaacaagtgtaatgaaataggatacctgtagtcctaggagaaagcaagaatagggggaagaaacctgggaagttttccatagcactgaatttaaggttgagtgcaatatgatgtatggctttaggcgaaaccacatacatcaattaattaaaacaaaagaatgaaagaaccttgcatagcatggagatgggagagaagaagaagctttctggaaatctaggtaagtagatttgtttgcagtacagtcagtggcagggaagagagaaggctggaaaagttatccagagctgtttattgagagatcttggatttctttctgaaggtcatacgcagccattataataattcccacccctacaaactttagatgtgtagcaagctctttcaaaggaagggaaacaaacaagtaacaacaacaacaaaaacatacaaaataacttcttgttgatcccctgtatttacttaaattatttttatattaatgttaattggttatgttcaaacctaacaggaatttggaattcttgtacatataattcacatacaactataaaataaaatatatttataaactaaataccaaagaactcccacaaaactaatcaaattcaatttaacagtgttaaattatatgaatgtaaatgtttgctgaaactaagttgcacctgctatggtgtagtttttttatagatatattttttttattatactttaagttctagggtacatgtgcacaatgtatgggtttgttacgtatgtatacatgtgccatgttggtgtgcaacacccattaactcgtcatttacattagttatatctcctaatgctatccctcccccctccccccccctcacaagaggccctggtgtgtgatgttccccttcctgtgtccaagagttctcatttttcatttcccacctatgagtgagaacatgcggtgtttggtatttgtccttgcgatagtttcctgagaatgatggtttccagcttcatccacgtccctacaaaggacatgaactcatccttttttatggctgcatagtattccatggtgtatatgtaccacattttcttaatccactctatcattgttggacatttgggttggttccaagtctttgctgttgtgagtagtgctgcaataaacatacatgtgcatgtgtctttatagcagcatgatttatattcctttgggtatatacccagtaatgggatggctgggtcaaatggtatttctagctctagatccctgaggaatcgccacactgtcttccacaatggttgaactagtttacagtcccaccaacagtgtaaaatgttcctatttctccacatcctctccagcacctgttgctcctgactttttaatgattgccattctaactggcataagatgttatctcactgtggttatgatttgcatttctctgatggccagtgatgatgagcattttttcatgtgtctgttggctgcataaatgtcttcttttgagaagcgtctgttcatatcctttgccccttgttgatggggttgtttgtttttttcttgtaaatttgtttgagtactttgtagattctggatattcgccctttgtcagatgagcagattgcaaaaatgttctcccattctgtaggttgcctgttcactctgatggtagtttcttttgctgtgcagaagctctttagtttaattagatcccatttgtcaattttggcatttgttgccattgcttttggtgttttagacatgaagtccttgcccgtgcctatgtcctgaatggtattgcctaggttttcttctagggtttttatggttttaggtctaacatttaagtcttgaatccatcttgaattaattttcatataaggtgtaaagaagggatccagtttcagctttctacatatggctagccagttttcccagcaccgtttgttaaatagagaatccttttccccatttcttgtttttgtcaggtttgtcaaagatcagatagttgtagatgtgtggtattatttctgaggactctgttctgttccattggtctatatctctgttttggtaccagtaccatgctgttttggttactgtagccttgtagtatggtttgaagtcagatagcgtgatgcctccagctttgttcttttggcttaggattgacttggcaatgtgggctcttttttggttccatatgaactttaaagtagttttttccaattctgtgaagcaagtccttggtagcttgatgggcatggcattgaatctataaattaccttgggcagtagggccattttcatgatattgattcttcctatccatgagcatggaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttattggtgtgtaagcatgcttgtgatttttgcacattgattttgtatcctgagactttgctgaagttgcttatcagcttaaggagatttggggctgagacgatggggttttccagatatacaatcaagtcatctgcaaacagggacaatttgacttcctctttgcctaactgcattgcttattaggttgaatatgtgagacacacttttccttaattgtaaattatcattcaatgttatgactacttatcatttcacctactcaatcttgccttttctaggtaccggcatagctttatagctaccaaattttagattatgttccctaacctgggtttatgtagttttattcagtattttatcttgaacattatgaaaccgaagactacatactactaactcactttaggaatagagctttcagaatttacttttagtttgttctgcatatctgtcaccagaccagagggttttttgggggttggggtgtgtatttaaggtgggagaggcaattctcatataaattcaataataaatttggaacaaatgtcattccatatgcagattagtttataaataatcatgtgcttactagcactgagctaccatgccatggccactaaaaacctcttaattctgttccattcctcttttttcttttgtgtcctaaatattgatattctagtctttgatataaaatcaacgattcagtgatctgcaccaaaaattcatttggcctgttttattttgaaatttttaacttattcagaggagtctattaagcttgaattttgttcttaaagtgctataatggtccttagcattcatgctgtgtcgttgaacttggatttaatttatttcatcttatattaaatatgttataagatgctgattagatattttggatcttggatgaggatgtactaaaacttagccagtctaagtaaattttaattctagaggattctctacagactgaaaacttaagatggcttttcaactagtctcaactagaaaataattctgttctagcgtgtgctctgttttctcttcctaactggagagtctctattgctcatagtttgtattggtgtctgatacgtatgtctatctcctagacactgtggtgttttcagaatggtagaaaataagattgagattgtgacagcaggctgataaatatctttatgtctcttttatttccctgtgtagtgtttaacacataatatactttggacagtgttttaaaaataaattgtacatttttgtagaaaaccaactatctttataataaacatagatgattacctctctttgagaaccaccagatattttagcttcctaaaggagtgagtccagtagcactttatttttaattaactgacttattaattaattaatttgggggaaacttggtattatttgttgaaatgcatagatagtattctaaagaaagtttggttaatatttatacttaggggaaagcagtacctagggcttgtggaaatttggtgggcagctatgacctgtgctatcttttaaaatagatttttttttgtattagaaaaggttttactagtatcaactaatggcaacataattcattactgtaggttgttgctataaggtaagatcctcattgtctgcatttcagaaaagattctctctgtgttattccatggagcagcagatagcaattctaagacactgaggtacacaccacagatactgtgcattttaattgactaatttgcctcttcaccttttgaattacaaagatgaggagctattgaatgaatgctcaggctttagcaaactaagggagaaatgtcattattaccacagaccaaataaaaggtacaaaaatgctaactgaacatagaaggaccaacttgcagaatgaccttgggaactggcgattttcagtggctcatccgcattctcttccttgcatctgcctgagcacagaatagttcattctctctccaaatctctttcaatttactaaaatttgtctttagttgaatagcagcagcgacgtccacactgtctcaagtcatgcattgaagtcattaaatgacaaatatgcttccttaggaaatgttttgtgactcattagtctaacaggagaagcaccatttctctacttccctctctgtctcctaacctcccccttttcttcctcctgtcctcccttccttctttcattttttttttaattcaagaacttgaaattaaattagagataatccaatttaactatttcatttgaggaaacgaaggcccaaacaggttcattactgccagagccagaagtagctcctagatgttcctgatctagttctttttgcaccacatacactgcttctttataatatgcatactaaaataaaagcataagtgaatattataagccttaacacatatgtgttcagcatttactgtgtgcaaggtgctatgatagatgctgtggagtaaaccaaagagaaagacaatgtttattttctcaagaagtttacattctaacaaaggaaataatttccatatgcatttttatataattatatataaattatataataattgccatatgagttttgtttttaaatcctgggtagaaagaattcaagtctgggattatgtttctttttattattattattattatactttaagttctgggatgcatatgcacaatatgcaggtttattacataggtatacaggtgccatggtgttttgctgtacccaacaacctgtcatctacattaggtgtttctcctaatggtatccctcccctatcaccctcacccgctgacaggcaaggtgtgtgatgctcccctccctgtgtccatgtgttcttattgttcaactcccacttatgagtgagaacatgcggtgtttggttttctgttcctgtgttagtttcctgagagcgatggtttccagcttcatccatgtccctgcaaaggacatgaactcatccttttttatggcagcatagtattccatggtgtatatgtgccacatttcaaaagctagcagaagacaaaaaataactaagatcagagcagaactgaaggagatagagacacaaaaaacccttcaaaaaatcaatgaatccaggatctggttttttgaaaagattaacagactgctagtcagactaataaagaagaaaagagagaagaatcggacacaataaaaaatgataaaagagatatcactactgatcccagagaaatacaaactaccatcagagaatactataaacacctctacgcaaataaactagaaaatccagaagaagtgaataaattcctggacacatacaccctcctaagactaaaccaagaagaagtcaaatccctaaatagaccaataacaagttccgaaattgaggcagtaattagtagttgaccagacagattcacgggcaaattctaccagaggtacaaagtggagctgataccattccttctgaaattcattccaaacggtagaaaaagaaggactccttcctaattcattttatgaggccagcatcatcctgataccaaaacctggcagagacacaacaaaaaaagaaagcttcaggccaatatccctgatgaacattgatgtgaaaatcctcaataaaatactggcaaaccgaatccagcagcacattaaaaagctttatccaccatgatcaagtcggcttcatccttgggatgcaaggctggttcaacatatgtgactcaataaaggtaatccatcacataaacagaaccattgacaaaaaccacatgattatctcaatagatgcagaaaaggccttcaatgaaatacaacaccgcttcatgctaaaaactctcaactaggtattgatggaatgtatgttaaaataataagagctatttatgacaaacccatcgcccatatcatgcagaatgggcaaaagctggaagcattccctttgaaaactggcacaagacaaggatgccctctctcaccactcctattcaacatagtattggaagttctggccagggcagtcaggcaagagaaagaaagaaagggtattcaaataggaagagaggaagtcaaattgtctctgtttgcagatgacatgattgtatatttagaaaaccccatttttatgtaattatatataaattatataataattgccatacgagtttttaaaaaaagtcctgggtagagagaattcaagtctggcattatctttcttcttcttcttattattattatactttaagttctgggatacatatgcacaatatgcaggtttgttacataggtatacacgtgccatggtgttttgctgtacccaacaacccatcatctacattaggtgtttctcctaatggtatccatcccctatcgctcccaacccccgacaggcagggtgtgtgatgccctgtctcaaagatgcccaaaatctccttcagctgataaacaacttcagcaaagtctcaggatacaaaatcaatgtgcaaaaatcacaagcattcctatataccagtaatagacagccaaatcatgagtgaactcccattcacaattgctacaaagagaataaaatacccaggaatacaacttacaaggcttgtgaatgaccatttcaaggagaactacaaaccactgcttaaggaaataagagaggacacaaacaatagaaaaacattccatgctcgtggataggaagaatcaatatcatgaaaatggccatactgcccaaagtaattatagactcaatgctatccccatcaagttaccattgactttcttcacagaattagaaaaaactactctaaatttcatatggaaccaagaaagagcccatatagccaagacaatcctaagcaaaaagaacaaagctggaggcgtgctacctgacatcagactatactacaaggctacagcaaccaaaacagcatggtactggtaccaaaacagatatatagaccaatggaacagaacagaggcctcagaaataacaccacacatctacaaccatctgatctttgacaaacctgacaaaaacaaacaatgggaaaaggattccctatttaataaacagtgttgggtaaactggctagttatatgcagaaaactgaaactggaccccttccttacaccttatataaaaattaactcgaggtggattaaagacttaaatctaagaccgaaaaccaaaaaaccatagaagaaaacctaggcaataccgttcaggaaataggcatgggcaaagacttcatgactaaaacaccaaaagcaatggcaacaaaagccaaaattgacaaatgggttctaattaaactaaagagcttctgcacagcaaaagggattatctttcactctccctttgtgtttagcctcgatacaaatctcttacaagtttatctttgaggactaagcagtgagagggggcagcatagtcagagacagccccagccacctctgtcccaggtcacagatgattcacaaatgccctaaagttggcagatctttcttcctcttagtttacaaagcatagcatttttcaaaagaaatcttctctaggtatctcaatgaaagagagaagtttaaaagcatagaaacaaagagcagtttgcacttcccaggatttttgtcctaatgtatctgaaaatccagccagggatctgttagaacagagtcgtttacagagccacttccatgcctcccttttcttaaattcaatttgcagagaattttctcctcattccagtttctggtcagggaaggaattggaatagagtctcccattaatctagcaaaaacggttcagtatagtattaattgcctaaggaagacagcaattatcactcttctctgggtattcccttagagtgcccacaaaggttttaaatgtttctttgttccttcagtgaggtgctgcttctttcagttttcacaatagaaaaggctggtttttttgtttgttgtttgttttttacagagttaaataaaatccagaagctgttcaggagcaagatgcttctggctgggatgctgagcatggttaaatgatgatgatgatgatgatatcagctaccatttaacctccttgtttgtactagaaacttatctattgatgtgttttttttatatctcattcaattctcataacaattatatgaaagtagtagtattatcttcattttaccaatgagaaacttaggaacttgtttgaggtcagtgagtaatagatactttatttaaatacagatcttctgtgacctcaaagcctatatagtctttccactattaacacagactctggtgaagaaaacagtgttctaaacctattagtggggtgggcagaacaatagatgctatgtgttgcattcttagagcacttaaggtcatctgtgttgacgaaggggactgacgacataattttgcatttttcatttattatgtctttaggtacagatttctctacagtgtttaatgaagaggaaaaccaaaactgcccttaacacttgcttttagaagttttcctcttttcaccattagtttatcagagttttgttattttacagaaaatttggtagaaagaaatggtttgttgaataaaagctaatgttagataatgataagtgttgttaagggaataaaatatagaaaaatgagataaaagtgtttttttaaatgagtaatttccccatatttgattttgagcatttcatttttaatagcatgtttgttcaagaaaaaattgcattaccatattgtaagcttgagtacgtaatatatcaaaggaaatcctaattttaaatgctattcttttatacacatctctgccttcagaattagggatgtatttattatcctaagaacatccctttaacttgctaaccatagctgtaatgactcttagtgatagagccccaacttgtttctgaagcttggtgctttggggaagatgattatttcagaactgaaagttgatgggaacatggctgacaaatgggaagtttataagtaaaaagtcctagcaacaaagagacacctatccacatcaatatgggaaaaaagaatactgatttgttattgagtacacacaacagactacgtgcatgtagacagcacacaaaacctttgaagacagaatgacatttcacacaatttatacagcaaagaataagaaaatgaaataacatttctcttctttcctcagttacatctcaagataggctcctagattagctctaagagtatgtttatatttcaaggggttatgaggtctgcaaccttggagacatctttgcagtgtgaaactagagactgggtttatctagaccctgtggagaccatttatatctaataggttagagcgaggactcaagcacattgtgttttcaaggagactcaggaggataagagaaggaagttgcctccttcctcttcataagcaaataatcttcttctcatcttcctcctcctcctcctccttcttaaaatttatctttataacaggaagagtagagcttttccctttcttatctgtgattcatcccttggactggagtcaagctgaaatgagggttgggatgggtattctttagctatttatgatggcattgcatattcagtggcagcaacagaagatgcactgtcttaatttttgtgagttaattcagccattagaacaataagtgaaaggatagacattggcacctcctttatatggagttgcattatctgacagcttcaagttttgtgaactcagccaagtatgtatagaaagctctgagaagctaaaatatagaccacaaaatctgggtcaccaggcacgtaaaaagaattcattatgctctcacttactctctttatacatagttgaatatgcttggttgtctggtttcccagtccacaacagattagatacaatatggtaaaatacactatggttgggtagagttgcccctaatgacagcaaatgtgatagtggaaaacctgatgtcaatggggctataaaggaaaatgacctataatttgaaagacagaaactctaacaaatattaaaatatacattttagtacatatttaatatgtaaaatgtttgataaatactagacacttagttcatgtcatgtgttttccttttttcccctgcaagcattgctgtattacatcacagcaaaaaaaaaaaaatcaatgttcatactattactcttagttttgagaaatgtttatgtctgggtactctggaaaacagcagagcactgtgtgtatacattattagctctttttaacccaatatgttaaaactgaaacatattttggtattttaaaacataaacttaagtaattcataaaatttaaatatgttgagtaataatagtaaaatagcaattaaaagcactttacacatattagttcatgtaatttcatttatttatgctgaattagatgaaactcctcccattagtgctagattacagtacagtcatgcattacttaacaatggggataattgctgagaagcatttttaggtgatttcatcattgtgcaagtatcatagagtatacttacacaaatctagatggtagagcctactgcacacctaggctatgtataacctattgctctgaagctgcaaacctgtacagaatgatactgtactgagtactctaggcaattgtaacatgatgatatttgtgtatctaaacatatctaaacatagaaaaggtacagtaaaaatatggtattatcttatgggaccaccgttgtgtaagtggtcggtcattgactggaacattgttaggtgatgtatgactgcacttttacctggtatttgtattgtcattattttttgtagaatcttatttcacttttaaaaatgcacttttcttgagaacaggaatctgtctgactagtacttaaatttttgatcatgccttttgcataaaagatgcttagtaaacttttatgaagtcaattaattaaatctattgtacaattccgttggcactatacctttcttgtaatttattttttaacagggtagggaaaatagactgatgaggttcagcagaataaatacataaattaagcatggatggccagctcaatttaagtatgagacaatgtctattatcccctgttggtaataaagtactgttttttcagggaagttcaaatgttcatacaaaaataccaagccttaacacaggattggattcaggtttaaagttatcagttcactgacaatcttggttcacagtttggtgcctgttaattgaattgtagatgtaagattatttataattactgcactcttacccttcattttaatctgaattcattaattttacataatgtcagtagtaggtcaaattattgtaacaatgaactacagtccctaaaaattatgacaaaaagaggccagggttaattttaatttacagttttcagattttataacctatgtatcttatatgtgatcaaggcatccagaattattgaatggcccctgctccaatgtttcaattttaaatcagctatttgtaatcaaaacacaattatctgcttatgtgacatatttcttattatgttctcaggttactttctgaaaacctgttatctaaatacagtggcctggaattgtactcatctaagattttagcctgaagaaagctgggagtggactggcaacatagtgatttttctccttgtcttctagatttaggcctagaacaatatttgataccaacaaaggttgtcaaaggaatttgtctctcacatatttgtaatccatttttatctgccttataagtcataatacttctggtcttgggtctatacgtgccaggcatcatagaggcctagaactctggttctgagtttagatggacctgtgtttaaatcctactgcctctacctcttgatgatgtattcctagccaagtttcctaattccccatagtctcagttttctcatctataaaacagagataacagtagtatctatttcacaggcttgtcaagaagattaaatgatataactcactaaatatatgatgagtattgacattatagtgccctaagtcctttaatgtggtatacagccaaagcttttcaactttacaaattgcttctcattcaagatgatctaatcttttccctgacaaataattcatttctttatataactcatagaatttaaatagacattaaaaggtaaacaatctagctacattaatttttactaagatgtgaatcactggtaaccataactctccaagacttatttatgttttaagagatatctatcttttgaaatctgttaaatattgaaaatttaggcatgatgatgaattgaagtgaaagctttagacaatatatgtgaaaggtacatttggggcacattgcctttcaggttggttgtcattgctgagaggcctatcttgggtttagtttgtggaagtttaatctttatatcatatattttttccttttgtacttttccttcttaaagtcctggatttgttccaggatccctgacagataccaaaatctaaagatgctcaagttcctgatataaaatggtatagtatttgcatataacctttgcatataacatatgcatatcctcgtgtatattttaaattatctatagattacttggaatacgtaatacaatgtaaatgctatgtaaatagttgctatactgtatttttaaggaaataatgacaagaaaaaagtctatctatgttcagtacagatgcagtttattttcaagtggtttaaattcacaattggttgaatccatggatgtggagcccacagatacagagagctgactgtacgttctcgaaaaaactgaatcatttggcaaaggcaaggtgacctacaatagagggaggagttagaataaaggtcaggtcagttgaaggttgagaaagcaagatatgagaagcagcaatgactggttttatatgaagctgtgtgtaagtaggggactgcaactgatgggatgtttatgttcccccaaaatccatatgttgaaattctaatccaaatgtgttggtacttggaggtggagcctttgggaggtaattaggtcatgagggtggagccctcaggaatgagattagagcctgtgtaagaaaaagagagctagctagctagctttctgtcatgcgaggatacagtgaaaagtcagcagtctaaaacctgaaagagggtcttcaccaggaactcgacccttctggcaccctgattttggacctccaacctccaaaactatgagaaataaatgctgtttaagccatacagtttgtggtattttgttatagcagccctagctaagacaaggactaaatttattctcaaggttatagaaatgaggaagttaattcacttaatgctaggtttggacatagaagtagatatgtaatagctcatttaggtaattctgtaggtaggatatagtccattttaagggaacataccagttatttggagattagctttgttttctagaagtgaaaagcactatggggactagtataaactgtacggtttaagtgaaaagaatgtccagatgatgtctgcatttcttataaagacaccaagtagggaagttggcagagctctgccttctacttttggtgctatagagtttagaagaaagagtaatggaaagaaaaaggaactgggtacacatcaccacgggtactcatttcagtacaatgcacaccgtggtgctgtaatacttaccccagggacatagattaaggtgccagtcttgcttctcagacacttaatggaaattttgactgtctgcagagataattttttatattatattcaagaaataataaatgtaataggatatagaggaatgaaactttctagttacagaaatatttaacatagtttcactttatcttcaaaattaatccttaaaaacagatagaactgatggtcttatctctgagttgtagataaggaaaataagattgccaaaactcgtatagcttcagattcagaaaaaaaaaggcagatcttttttattctctgtggttctttctgtcatattacttatgtaaaatgacagtgaaacaaaatgcccaggctttggggcatgtgaagacggaataattttcttctagctaacacgttttttctttttttgagatggagtcttgttctgtcgcccaggctgcagtgcagtggcatgatctcagctcactgcaacctctgctttccgggctcaagcaattttcctgcatcaggctcccaagtagctgggattataggcacccaccacaatgcctggctaatttttgtagttttaactctgtctccaaaaaaaaaatacaaaaaaaaatttagccaggtgtggtggcacatgtctgtagtcccagctacttgggaggctgaggtgggaggatcacctgagcccaggaagttgaggctgcagtaagctgaggtcacaccactgctctccagcctgggtgatggaatgagaccctgtcaccaaaaataaataaataaataaataaataaataaataaataaataaataaaatacaagagacccaaacagataaaacacccttgaactatgaaggactaatactttctgatttcaaaatttattttaaaactacagtaattaagatagtggtcttaattggacagtggtactgctataaatatagacatgtaggccagtgtaataaaattgagtgttcaaaaataaacccttacctttatggtcaattaattgttgacaaggatgccaagataattcagcaaggaaagaatagtcttttttcaacaaatgtttttagtacaagtgtctatctccatgtgaaaaaataagtttgggcagctaccttaaaacatatacaaaaattaactcaaaatgggttgtagacctgggagaaagatcaaggtggctgactagaagtatcccgcagtcacctcctccacaaaaaaaaggaccaaaacagcaagaggataaccacacattgaatagagtatctaagagaacactgaaattcagcaaggaagtgacagggaccctctgaggcatagagtgagagggcagccaagcagctggcctggccaggatcggtttggaatgaggaaggtgtcttcattgtggggaaaaggtaggtgagagatccccagccatccactttcccaccacagatgctggtaatactagccacaagagagccactcagcactcacaggcccttagcctagtacagggagctgcctagggtctgtgcaagtgaattgttgcagagagggaactcacactggctcccactcactccccgagaccaaagcagctgcagcatggagccactttgagaacccaactcccaccagactacattattccctgaggcccaacgggccttgcattttcacatccccaaagtcccacttataacccctgtattcacctagaaagctgcaacaccacaatgacagctaaatctggcattgtggcttggtccccaggattctggcctatgcagtgcactacaccctggggaacaggtgatagagcacaccagggtggctgcccccagtactgatactccccagagccttagagctgcctgttctgggctgctgcaactcagaacaacctcccctccactccaacttcacaactgtgtgcaccttcatagggcctgaggacaggacttccataggcagactgtctccagtgcccacatacaccctccggatacctgcatattggcctgccccactcatagctgccaccactaccacatgctcatccatccggggccctgagggcaggcctgccctgatcgccactgttgatgcttgtgcatgccatccaggagcctgagggttcgtccgccttacgtggtactaccccgctttgcctgtatgcactattttgaagcctgaggatcagcccatccttctcaccaccacatgcccccttgtccactagccagaagactgaggacaggcctaccatgttcattgccactgacatatgcctacctgctgccatctgctgtcatggtcactaccactgcacatgtgcacttcccaggcccccagagacaggccactcaacctgctgctgtactcctcatctaggcattccatccaagatcctagggactggtctgcccagcctacaaacactacttctggtgtcttcactcccacgggcccaaggctgtcctgccactgctattgtcactgccagtgctatgcacactgtccaggggcccaaacacatgccaacctggccctcctcagctaccactaatgtccaagcatgctgcctggggcttgaggatcagcctacctgggtcaccccacagccattactggtgccagtgtatactacccaagggcccaaggactggcatgcctagtttaccagcaacatcactcatgcccaaggaccagcccacctggtgaccttgtccccagcaagtccttgtcacagctgccagcaacaactgcagccagtgtcactgaggaactcactgctcacatttattacagccaaagaaatcatacagagactacactactgcactttcccagaataaaagccaaaacaccctactgaacaaacaataaagatctacttacagggaaaaaaatctttcccgactaaagccagtccataaaattggaacaagtgactattaagacagatgcagaggtatcaacataaggacacaagaatgagaaagcaaggaaacatgacacttacaaaggaacatactttttcagtgacagatcctgcagaaagaaaagtctattaaatgtccgaaaaaattcaaaataatgatcttaaggaaacttagtgagatacaagacaacacagataagcaatataaagaaataagaaaaataatttatggcctgaatgagaaatttgacatagatgtaagaaagaaccaaacagaaattgtagaactgaagaattcaatgaatttttaaaaatacaattgatatcttcaacagtagactagatcaagcagaagaaataattaaacttgaagatagagcttccaaaataacccagccccaataaaaacaaaaaaccaaaaaaattttaaaaagccaaaagaaaataaaaggagtgaagaacatccatgtgacacatgggatgctataaagtaaacagatatatttggattttcagaaggagaagagatgggcaaagctatagaaaacctatttaatgaaataataactgaaaatttcccaagtcttttggaagatatagacatccagatacagaaaggtgaaagattcctaaacatatttcatctaaaaagatcttttctggtgcatgttttagtcaaacaggcaacagtaaaagagaattctacaaacagcaagagaaaagaattcagttacatgtaagggaagccatatcagactaacagcagattttccaacagaagtctgacagcccaagagaaaagagaatgatctattccaagtgctgaaaggaaaatactgccagccaaaactcctatatccagcaaagctatctttcaaacatgagggagaaataaatctgtcaaaacaactccagagaatcaaatagaaggaaattcttcctaactcattatatgagaccaacattacccttatgccaaaagcaggcaaggacacaagaaaaaagaaaagtacaggccaatattcctgatggacaaagatgcaaaactcctcaacaaaatctagcaaaccaaacccgatttcacatcaaaatgatcatttaccgtgatcaaataggaatcccagagattcagtgattgttcaacctacacaactcaataaatgtgatatgttacatcaatagaatgaaggacaaaagccaaatgttcattttactagatgcagaaaaagcatttgataaaattcagcatcccttcatgttaaagactcaacaaattaggcacagaaagagcatacatcaatataataagggtcatatatgacaaacccatggctaacatacatactgaatcgggaaaagctgaaagcctttcctctaagaactgagacaaggcaaagatgtctgctttcaccactcttattcaacatagtactggaagtcctagtcagaaatcaggaaagagaaagaaatataaggtatgaaaattggagaacaggaagtcaaattttccctctttgtaaacaacatgatcttgtatataagaaaacctaaagaccccataaaaaagaatctcttagaagtgatacacaagttcagtaaaattgcatttctacgcaccaataatgaactagctgaaaaagaaatcaagaaaactatgccatttacaatagctacaaaaaatacctaggaataaattaaacaaaaggggtgaaagattgctatgatgaagactataaaacactgattaaagaaattgaagaggactcaaacaaatggaatgacatcccttgctcatgattggaagaattaataatgttaaaatggccatactaccccccaaaattttcagattgaatgcaatctctatcaaaaatattaatgacattctttacagaatttgaaaaaatatcctaaaatttgtatgagatccacaaagaccctaattgcgaaagaaatactgagtaaaagatcaaagctgtaggcatcacaccacctggcgtggtgtgattcaaagtatactacaaagcaagagtaatcaaaatagtatgctattgatataaaaacagacacatagatcaatggaacagaatagagaagtaaatccacatatttacagccaactgactttcaataaagtatccaagaacatacattgggtaaagaatacactcttcaataaatagtgaagggaaaactggatatccatatgcaaaagaatgaaagtagactcctctctctcaccatagacagaaaccaactcaagatggagtaaatgcttaaatgtaaaatgaaaatgataaaaccagtagaagaaagcatagggaaacacttcaggacattagtgtttgcaaatattttatgggtaagactttaaaagcacaggtgacaaaaaagaaatataggtaaatgggattatattaaactaagaagcttctgcacagcaaaggaaagaatcaacagttatgagacaacctgtagaacgggagaaaatatttgcaaactatttatccaacaagggactaatacacagactatacaaggaactcagacaaatcaacagcaaaaaacaaaacaaaacaaaaaaaaacccatttaaaaagtgggcaaagaaactaaacagacatttctcaaagggagacatacaaatggccaagaaatatatgaataaagcattcaacatcactaattgttagggaaatgcaaatcaaaaccacaatgagagatgtcactccagttagaatggctattatcaaaaagacaaaaaataacaaatgctggcaaagatgcagagaaaaggaaactcctatacactgttggtaggatgtaaattagtacagccattatggaaaacatcatggaggtttctcagaaaactataaatagaactgccatacagtttagtaatcccactactgagtatttatccaaagccagcgaagtcaggatattaaaaagttgctgacactcacatgtttattacagcacgatttacaatagctaatatatagaatcaacctaaatgtcaatcaatggatgaatggttaaagaaaatgcagtacatatacacaatgaaataaaaaaagaatgcatccgtgtcatttgcaacaacatgaatgagcctggaggacattatattaaacacaactaatcaggcatagaaagatcaataaccacatgttgtcacacatatgtgggtgccaaaaaaacattttgagcttatggaaatggagagtagaattgtgggtgaggttgggaagagtaggggatagagaaagatgggacgaggttagttaacagatacaaaaattacagctagataggtggaatgggttctggtgttctgcagcaccttacagtgaatatggataactataatttattgtgtcttttcaaaaagctagatgagaggattttgaatgttcacaacacaaagtaataataaatgtttgaggtgattgatacacttgttaccctgatttgatcattacccattgtacacacattgaaataccattctacgttccataaatgtatacaattattaaatatcaactagaaaaagggaaaaaatggattatagacctaaatggagaactcaaatgatattaataaatctcttagaaggaaacatgggaatatggttccatttatatgaaacatcagaatgggcaaatctgtgaagactagattagtagtttgcctatgactgacgcagggagggagagagatgaagactgactgctaatggaatacaaagtttcttcgtggggtgatgaaactattctaaaagggtttgtgatgatgattctgtaattctctgaatcgtctgtaaaatccactgaattgtatactttgaatgggttaattctatggtatgtgaattttatctaaataaaaccattaaaaataaagacaaaggggcctcttcacctctattatgttctccttcctgtgactgttttccctaaattctttccaagataatgctcagtttggatggaatattagttctccttttgctgaaattttcaggtaggtttggtggttttccatcagatatttttcaaaagagtgtcttaaatgggggttaccttttcctttggaacattatgaaacatttatacaaacagagctgtagatatatgataaaagatttaaaattcagttatggagctgggagagggctcaaatcacattttgtagctcgtatttttctacattattcctcgaaatacactcaatcaaatatatttaccaaaataactatgtactagctttcaaatccaacagcttaaaccacaaaacactaattgctacctcctttgaaccttgtaatacttctttttctataatttgcttataattaccatatgcaggcttgtataaagttaaatatatatgtttatatattacatatataatatatgtaaaataataatttgcatattatatatatttagcttaatttataaattgtaagtcaatagacgaaagctttttaaagtttcctaaagacctaacacagttcactacatatatgagctaattaataagtgtttctagttgggtagtagataatgccagtctctacaccagagagaaggggttgaacattaatgtgagtggcttttatcagtaatccagaaaattatagaatggcaccttgtatagtctgtgtattagtcccttgttggataaatagtttgcaaagattaaagatactctatacaatcttacagggctcatcagttagtagctcatttttgtacagaaaatggtagctctgtgaaatagaattggcttagaagactttgacttactggaattctaagtaaaattcaaaacgtaacttttcctctcacacatttttacaaagttaaaaacaaatgctgaaaatacttcatttggtacaagtattccacatgtgcaagatacaatacagcaataagatggaattttcaataaatgactaaacattcaaataagcatctttcataggaggtccttggcaggcagcacacttttcccactaaggctgctgttataaaatcatttttggagctattcttttggaatgtctgtccttctctcaaagccagtgtacaaattatatgaataaacagttttggtacttttccatcataattgtttataacaaaaattataatactccagttagtcaaccacttcattctagggttagctcactttggggtgcttccaaaattatatccactgttaaaacaagaagatatgctaccatttacagttcttaaaaatggattttgagctttgtaatatcactataacaaatgtgtatcttggttcactgccaggtacatgttgagtatccaatcaaatgttggtataatgagtgaatgaattaatatgatttttctgttactttaaagggagtacatctttagcaatatctgtatatgtttctgaaaaatcaattatttcatattcactgattgtgtgcttatgcttgctgtttgaactctttattttctgctcatggcttttgacctatttatattgacatacattctgttgatttttatatagctctaattgcaaaaataaaaattgaacaacatgtaaaaagaaactcgttccagcattttcaccagctttccatgccttctctgttatgattggtagagctctgtgatgtcttcagcctattttcaaatttctgcgtaataaacttcattgggcccacagatctgaatccattaagttactttaagtaatcagtgtccagatccttccttatttggtcatggtgttttgcactcttattgcagtggctgcttttctggtcctttgtagaaacagagattttctggagtcatttatagtattcttgctctccccatttaatacattgggttagatttctaatttaaaaaaaagcatttcttatttcttttagtgtttttcaaaacttgctatttattaattttttggtctgtcctttctttagcctcttatcccatgaataaataagtacatatgttgaaaaagaaggaaatacaatggatttatacacctttcaaaaatttctagggctcagcctctacagactcaaattttaattaatagtttacttttttttgtgccactgaaatttactaaggcatatgtaatgaaatatcaccttttcaggaagcttccactaatggggctcagctgaaatgccttctccttcctttgggtccccagggctttgtggctttgtttattttgcctcatcttggagtaatttgtgtatagttcttagttgttttaaacagtaataataataatagcaatgattagtattgattatttcctttgggtcagatacttgatgtgtaagatcctatttatttcttacaactatcttacagcaaaggtattattatcatcttcattttatcatatgtcattttatcacatgtagaatcataaatatatatgtgagtatatatataagcagaaacaatccttataaaaaccacaattttttatatatatatatatatttttttttttgagttttgcaatatcactataacaaatgtgtatcttggtgtactgccaggcagatgttgagtatccaattaaatattggtggaatgagtgaatggatttatataatttttcagttatatgtataactatggtttttataaggattgtttctgctgataatgagaatttgagcaaattattctgtacaaaataaacctgggttacattttccccttcagaaccttttattttcttatatctaatcctcttgttagggacatttgaaattggcctctttttggtcccttgagacttactttatttctgcttggtgcctatagaatttttaatttaatattgaagtttaataaccttttcccctgatacatggtgtgccatttctaccttactattgaattctctatttcacagaaacgttcctgtattatatctttgaataattttctatttcatttgttcagttctctagtttaggaaaataagaggaaaatatgaaatggttagatgctaagtagatataagacattataagaagcaaagatgaaggaaatgtatcagatgtacagttcagaacaagtagtgtcgaagaggtcagagcgtctgggaaacccaatcaaaatgtttcccctgaagatctccgtattgtgtcagccatcatagactccctacaatagtacaaatagaacactgctccttcttaatcgttttttaagttagtatttaaccctcatttagtgtgtctttaccatgtgctaagtcctgtaaagacaaaagatattaatgctttagtctaaaatctagatttttttccaccaactttggattttaaaaagttttaagcttccagaaaagttggaaactagcaagatgttaaaacaaatctagattcactgattactctttaaaattaaattccactgtcttctaaaatttcagcatgtatctccaaagaagatgattcatctacatagtcacagtaccccccaaaattaactttgaaagtatattaccaaagatgtagtttatattcacattttcccaattttctcaacaattttatttatagattgtctctcctaggatccaattgagtattacacattgcatttagttttcatgtttctttaacatcctttattctaaagtgtcctgatgttaacattttttagagttctacaatctgaatttttctgattgtttcctcatgattagattaggttaaatgtttttggcaagagctgtatcacattaagtggtacaaaatagtagtttatcctattctttgtaatgttatcttaaattacttagttaaggtgttggctgtaaatcttttcgttgaaaggaaaactttcctttggtaattaacaagttatctgtagggtgacactttagaccatatgagcataccgttttccaacaacttttcattgaatggatttagaaatcattaatgatccttgccagaatcaattgtattcgtgttggcaaaatggtgattttctaattctactcctaatcttcttaagcacaactatgacctcattaaggtagctgtcccaaattttctgggcctcttttttttttaaaactatctggtagatacagtgagatctcttttacaaaaaagaaataagtacagtgttaaatgtctaatgagcatcaggaacacaaaaaaattgtacctacattgacctgctctttaacttcttccaatatggaagagatagtcagtgagcacctgagtgatctttcaggaaagcaaagacaatccacgtaacatgtttgtctctagcactcatccttggatatgtctcctttccttcatgtaaacagttaagaaacacccaattgtaaatataaaactcattctgaaagaagagggggagcaatactgtaaggacttcaaatttcctactctattattggaaaatggagcattttttttttttaatcggccgcagggatttttgttagtgtttttgttttattttaattaagaagaaaacattaattctatgaaacataagccatttgctttccatatatttggcctggagtagactctggacattgataatttttcaaaacatctccaggtgattctaatgtacagccaggattgagaaatttttgaagaacaggtaactccatcttgaaagatgggtggaattaggacatgtggagattgccggaggtaactttaggtgaaggaaataacataagcaaagattaacctactgatggcaaggatttgccattcttttccacaaatgaagccttttttttctgttatgtttacctgaaaggtaattggaaaaatgatgccttaaagttcactaatttgtgagaatcataggcaaaagctttcctgtgatattagagaagagtaagatattgttcttgataacatcctgcaactcatcatttatagcataataagcccttccactctgattctgttagacaggcccatccatggcaagatattaaacaaaacaggatttattgaaaacatgtctgataatagcaatgatattgaaaaagagcaaaacagtacaatcctggtttttatgtttctgctttgaccacaggcttaaaatgtgtatttcaagcctataaatattgattgtgagacacaagaaacataatataaatattttgaaggaatagtaattaagagcagtgagtcacaggtagctaccagatgaaaataataaacccaactttgtcagggcttcagatcagagtaaggtttcaattttgatatccacggagaagagccaaattgaagatgaatatgagtaaatattgatgatccatactactgaatttgtctggtgataaatgtttcttaggtattgcacatattccgaactcataaatacatatactacataaaaacatggaaaaaacccttcagaaatgttttcctgtattatattttcagaaagtcacaagttttagagaaatcatataagcagaatggcagacagcatgggccatatttccatgtcaaaagtaaattgaaaatctaaattagtacctgaggttaaaaatacttatgtccacagattccagaatacaaaggaaaagtaatgccagccaaatctgaaacataaacaactataagttttctttgtatttgaaaatatggccttggaactctgtataagaagatgcttacttcataaacatacatgtgcaagtgtctttttcatataatgacttctttaagagtgccctccaatgatatgacaagatgctgaccgatgttatacctcatttcctgaaagtttctaagtgctctatgatggatcctatggtggtgagagtcaacaacctttgtcataataaataggagatttttctcacaattttcgaagtaatgtgacattaaaaataaggataggaaggagacaaggaaagaagaatcagtaaagtagtaagaataattagtattgtgtcaggagaactaaattctagttgtgtctctgtcaccaactagctagaaactttgggtaaaccatcttacctattgacttcacttgcaaaatgaacattaggctgtatttcaataatttccaaatgtttgaagaagtagaacctttatcaataaagtatagtatagaaaactttctttcctccacttttaaattattcctgaagttctgaccctttttcctattctttactttcaaatgcttttaatttcaacttctcccacttgctgttacaccctaatatatctaatacgtctctacaggtatatttctgtgcctttcagtagccctctatgttcatctactttttaattttttttatttcaataggattttgggaaacaggtggtagttggtgacatgcatagattttggtgcacccatcacccaagcagtgaacactgtacccagtgtgtagtcttctatttctcaccaacccccatcctttcccctgagtccccaaagtccaatgtatcattttgttttattactttttttcttaaaaatattcagatattgtatcttattactcctttaagctactcatccattctacatgttttccttataaacttttcaaaatggtagcaattgttttcacaagcagagccttatgggaattttacatgtgtggaagaacataataaatttggaatttgctgatgatttcacttttaaaaataaataaatagaacctttttctcccttgaatgaactcttacttggaatcataatatgtaaaacagatgaaggcaaagatgcaggagaagttcttgagtcctaccctttcagccattcccatccttatgagactgacatggcactgccacagacacccaagggccttgctactcaaagtgtggtccaggaatcagctgcatcagctggttagggatacagaatctcagaagcttatttgagaatcacaagctccagtgggacctactaaatcaaaatctacattctaacaggccccttccacccaccacccaccttcattcctccctaccccctttttcctcaccactatgatctggttcacactaaagtttgagaagctccgctctaaatacagatgcaactccatttgaaaagtaactactggactagttaactcatagagatgaatgatgttcattttgtcctttcacacaccacactgactgattctcagctggaagcccagtgtgcaagaagaacaagaaatagtggcactaatgccatttttagtcttatagaaatataggaatatagaatgcagggttttattttatttagtagacagtccagtggtctgtttattctacaacactgactcaaagaaagggactacatagtggcctttatgtatattagcatatcagtcagggccccagcaggaacttaatgccacactcagtgggagacttcttaacaaagttgtgggcaatcttaaggaaaccactaagggatggtgaagccctagggactagcaatggtgggaaccactaacactgtcaatcttgatggagcaagggaagggatggaacctagggaaagctttaacagtgggaagggcccactgtgggatctcttgccttaggtgggagaataagccactgccaaatcacagatcagcagagagcaaaccaagagaatgaataaaccagactttctctcctctcccactctggtcacctgccatcgtttaccattggccaaacccaactggaaactagagtgcaggggaatgatttgatgcagtacagaaaagtcatcttcctggggtacagagcagggtacagaaggtggaaggtggttctgaagaggaaattcagaatatctaacatgataaatagttggatttgtaaataggaaaaaaaaggtagtaaagtaaaattctaatggaaaggtttcatttgtgcttgttttgtttgcatatatgttcatacacttatgtgtgtatgtatattaagcacaagggggaatttctaagacatagtgagatgtagcagaaaatgtgtactttgaagagactttatactttcttctgctgtagaaagttttagataagagaacgttgttaatctgtatttatctagcacatacccttttgtaggcactgctaaggacactcaagtataaaacatggtccctccctcagagaactatgatcttggttgaagggcaaaaacatcaaatatgtttataatatgcacatggaatggaatgctttatttcgttcattcagccaatatttattaagcacctgctatataccaggcaatgtctttaagtcgagtcagaaattcaaaacaaattccctgtggacagggaatttgtaatcttgtttgaaaggtggactttaattatacatttcaagcatgataagtgttttgaaaagagaaatacggagttgtttaggaatttgtatcaaatacacctaacatattggggagccaaaaaagcctcctcgaagcatttaagaagtataagtaggaagttattcaggtcatagaggatagtaaggtgaagggcagctgggggcagtagagatgagggtgtttgcaggggcgtactagtagaagggcagagaagatcatgtgttcaaaaggcccagggagaaaagagatcatggcatatttaacaaagtgaaagtaatctattataactggagcagaaagtaaagggagtgtggtattgtcctttatcctacagcactagaaaggtattaaaatattctaagtaaatgaatcactccatcaaatggaaaaattatgaatataaaatttggacttctattattaccattttgaactaaaactttatgttgatgtgtttatttctaaagtttttctgagaaataagcacaagaatgaatttttctcaaaattttttccgaagtttattttttacttctaatttaagaaaatagctgaattgttcggaattttctgtcatgttttgctgtatattaaagtaataacatcttttaaaaggaaattggcaagtgttctttattagcaattttataaagatagaaccattttaaattgattgttgccaaaagtagaatacaaaaagtatcacagaattatgtgaataattaggaaataaattttacacctctttatgtgtatgtatgtgtgtattcttactgctggaatttcttaatctctgtcagcaatagcacttactttcaaacttcttcatctactgcctcagcttactgatacttctatatcaatatagttattttgcctttctggagaaggtaaatcacaaccaatatgtatttctttgaattctagccaagcaaaaaggacatgcagagtccctcttgagctagaagcgtttatgcagatggtatcatttcatacaaacatgtattgtcaaaacccatcataagatcactgtcagaattactggggatcctgtcaatcatatgtttctccatgttattatttttccaagtatcttctttcaccactacagtagccctgatggatattaacacagaaaaaaggaatagtgccatcaatagtgcttcttttcttccaataacaatatcatcatttttggcacagatgagagataccttatttcttaggtgaatgtatagatggagggacacaactgaaagaatgacttcttaatcagcttacaatgtcatattttcaaactttatggattcagtggctcatgttaaattattttacagtagacatttatatatatatgtatataatactttaagtcttagggtacatgtgcacaacgtgcaggtttgttacatatgtatacatgtgccatgttggtgtgctgcacccattaactcgtcatttacactaggtatatctcctaatgctatccctcccccctccccccaccccacaacaggccccggtgtgtgatgttccccttcctgtgtccaaatgtcctcattgttcaattcccacctgtgagtgagaacatgtggtgtttggttttttgtccttgcaatagtttgctgagaatgatggtttctagctttatccatgtccctacaaaggacatgaactcatccttttttatggctgcatagtattccatggtgtatatgtgccacattttcttaatccagtctatcattgttggacatttgggttggttccaagtctttgctattgtgagtagtgccgcaataaacatacgtgtgcatgtgtctttatagtagcgtgatttatattcctttgggtatatacccagtaatgggatggctgggtcaaatggtatttctagttctagatcccggaggaattgccacactgtcttccacaacggttgaactggtttacggtcccaccaacagtgtaaaagtgttcctatttctccacgtcccctccagcacctgttgttccctgactttttaatgatcgccattctgactggtgtgagatgatatctcagaaataataccacacatctacaactatctgatctttgacaaacctgacaaaaacaagaaatggggaaaggattccctatttaacaaatggtgctgggaaaactggctagccatatgtagaaagctgaaactggatcccttccttacaccttatacaaaaattaattcaagatggattcaagacttaaatgttagacctaaaaccataaaaaccctagaagaaaactaggcaataccattcaggacataggtatgggcaaggacttcatgtctaaaacaccaaaagctatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagtactcaaacaaatttacaagaaaaaaacaaccccatcaaaaagtaggcgaaggatatgaacagacacttctcaaaaaaaagacatttatgcagccaacagacatgaaaaaatgctcatcgtcactggccatcagagaaatgcaaatcaaaaccacaatgagatatgatctcacagcagttagaatgacatttttcaaatcacgaagaaacccagaaaatttgtatatagtaggctctgatcttgccaaatgtgggattattctgatacatagtttatgataaattacaccaattgctcatggtctgcggctgcttataaagatgaaaatttgtttgtccattagttattagttaacagtagatatgaataaatttatgaatatatgtatataaatttgcaaatatttgatccctctgaaattacaactgaattctacttgtttccaaaatgttttcaactttatacattttcatttattcattcatacattgattgactctacaaatattcactgaaacactactgtgtgttaggtcccatgctagacctatttttaaagttgacttttaaacagatcctgctttgaaaaagctttcagtttagaaagggggtaaggcacggagacatactacaagagacaatgtgctaagcaccaaaagaaagtcttgtgcaaagccattctacatctgagacaagtgaggttatttctacttgagagggtagggttgcacacgagggacaattttataatggaggtgacattgggaaagcatctcccagaatggataggacagagacatagcaggattggagaaaagcacatttttccagcctgtgaggaaagtattagcatagagtgtgtgctcagaatagagaagatgcaaagcatggagtaagacaggatcttgaaaaggcttggaatggtgaccagactgcatgttctgcaaatggaaaaataaccaaaaactattattaaacataaatagcaaggggattcttctcaggaagaaactaatagtatggtggggattcatttgtttgcaggaagggaacagttgcaatacagtggtgactataaatttttatgtactaatttttcagtatacagtagaccattgagcaacacagatttgaactgtgtgggttcacttatatagattcttttttcaataaatacattggaaaatgttttggagatttgcgacaatttgaaaaaacttgcagatgaaccttgtggcctaggtatattgaaataatttaaaagttagttatgtggaaagcagtgtggtgattcttcagagagctagaaacagaactaccacttgacccagcaatccgattactgggtatatacccaaaggaatataaatcattctaccataatgatacaggcacacaaatgttcactgcagcactcttcacaacagcaaagacatggaatcaacctaaatgctcagcaatgacagattggataaagaaatgtggtacatatacaccatggaatactatgcagccataaagaactacatcacatcctttgcaagggacatggatggtgctagaggtcattatccttagcagactaatacaagaaaagaaaagcaaatattgcatgttgttacttgtaagtgcaagctaaataatgagaactcatggacacaaagagggaaacaatagacactggggcctccttgagtgtgcaggttgggaggtgggagaggatcagaaaaaaataactattgggtagtttgcttagtacctgggtgacgaaataacctgtacaacaaacccctgttacaaaagtttacctgtataacaaacctacacatgtacccctgaaccaaaaataaaagtttaaaaaaatgtagatactagtctgtttcatcatttactactataaaatatatacaaatatattgcaaaaagttgaaatttataaaaaaacttatgcacaaaaacactgactctacccggcactaccacttgcagttgagagaaatgtaaacaaatgtaaagatgtagtattacatcataactgcataagattatagtacatactgtactattgcaataatttcataaccacctcttgttgctgttgaagtcctattgtatcctcttaaaatggcatgtgatgctaatcagatctgcatgagcagttcatctctccagtaaattgcgtattacagtaaaaagttacctctcttggtttttgtgtattttttacagtgtttagtgcaataatgtaattcttgaataacaccatggggcccacatgaagtcccactggtgatgctgaatgtgcttccttgaggcagagaaaagtcatgacattacaagaaaaagttgaaatactttatacgtactgtatattgcggcctgcagctgcagttgcctgtcatttcagacagacgattcatcttgtaaacagacaatgtaaacttatggtattgataaatatggtacagtactgtatatgtattttctcttttgattttcttaataacattttatttttctctagcttactttattgtaagaacataatacataatataaaatacaaaatatgtgttaatcaactgtttatgatattggtacagcttctggtcagcagtaggctattagtagttaggtttcaggggagtcaaaagttatacatggaatttcaactgcatgggggaccagcgctcccaatccccatgttgttccagggccaactgcacttttttcattcttaataatttactctttttaatctctatatggtttataaaacttttcatttacataattgtttcttaaactcactcaatacaaagaatcatttgggatgcttgtaaaagatagcatactacagttattatagttattccattatcttccacagaaaatttttgcttagatttacctacattcgtcccattctttgtttcctatttttttaatcttaggttattctgggttcatttttctttgtttcagtaatgcacttttagaattttcttttgtgttattcatggagaagtctcttggtttgtgttgatctcattagcattataaaaatatagcttttctgagtgtaccacactaggatgacagttattatttctcaatccattgaaaatattattccattgtgttctggtttctattacttctatatagtgtcagtcttctctctctgcttttatgatctctgtgctatctgtggattcatgactaagcgtctaattctggattttgttttatttatatttcttggtggatgctgtgcttgatatcgtgagttcatatttttcattacttcagggagtttcacaatctggtacttcaaaatttacctttccccattctctttattctccccattctctttattctctccctcaggtactctgattaatttagattttcacattctatatcatatattacttgatctcctcatattttctactctttagctctttgttctacatgttacggtatttttagatcttccagttctagtttatttactttctttagtggcatctaatattttatttaacccatctgctgttttgttttactttcaaccattttttaaaaatttataaaggttctattttcttttccaaatatccctcatcagtttttaattggctctcattgtattttgtgatgtcattctttacttctttaaatgtcctatgtatattttatattccaagtcgtaaaatctagtatttgatgcccttggtgagctaaatctattatgttttttcctacctactctcatttctggtggtaagttttattgtaaatttggtgattgttgattgttaccttatatttgactttattttattctgaggaaaactaggatgcctaatttaaagatatattccatgtaagagaaggttcatgtgtttccacagggattttggagacattacaaacctagaacaaatttagccccttccagggtttcaggtataatccaagaatctcattttcagcttatcttccttgctgctaaggtaaagctaaatctccaaaccacagtgcagagactggcatttaccctcaagctatcctatcttaagtatgcgctttcagctcatagttaagcttttagctcaacgtttatgcttttatttttgcttaggccccttggagattttcctcacctattttaagcccagcagtgttatgaaaattatattttatgcaaaatctactttttttgtttgtttttcatgaggatccttccagcctactgccagaagctgaatgatagatattttttgcctatagcacaatgacagtctggaaattatcaagttgttttgatcaatataggtaagccaaactggaatactttagaataaacaaacaaaaatgaacttggcatctgatttgtccagtttagtagtctctactgattcttgctactttgtgctatttggatgcaacgtaaaatattgtattagtaaaatatttaaaatgagcccagatgatattatgctaagtgaaataaaccaggcacagaaagacaattactgcatgatctcatttatatgtggaaactgcaaaaaggctaatacatagaagcaaatagtagaatagcagttacaaggggttggggtatgggagaaatgggcaggtgttggtcaaagggtgcacatttgcaagtataagatgaataagttctagggacctaatgtacagcatgatggctatagttaatgtactatatatttgaaataggctaagaaagtagatcttaaatattctcgccacaaaaaataaatatgtgaaatatggatatgttaattagcttgattatggtaatcaattcacagtatatacatgtatcaaaacatgatgttgtacacattgaatatataaaatttttaatttatcaattgtaccttaataaggctgaaaaaataatttctcttttacagagtggtgactgggccactcggagactactgcatagctcttctcaaagcttctttttctttattctaatatgctttgtaatggaaaattgaagggaaagtagagaattgactcattaaaaagtctaagacattaaaagatattttgtctatttttccaatagttaataatctttacttacggttgattaagttcatataagttaaccattccattaatatctatagagtgcctacatggcgtgtactgttccacatggtagaaaacatagcaaggaacatgtagatagaaatcgctactcttatggatctagcatcctatcatcatgatagacataaatgagaaaaggtagtaaaataaatagtacggtagatagtaagtgctaaggagaaaaataaaacttggaaaaggaatcaagaatggtgaaagttgttgtaatattagatgggtatatggattcactgcttctgagcattttcttaatgcattctgtggactgttagatcacaggcggaccactcccataatctagtgaacagattatttaggagagtgagtgttatgggttaactgtgtacctcttcctaagatactttgaagtcctaacccccagtatctctgaatgtaaccttatttggagataagtttctttacagataagtttctctattatttctttacagaaataatcaagttacaatgaggccagtagggtgggccctaatccagtatgacctctgtccttacaaaaagggaaatatttggacacagacacaaacacagggagaatgccatgtgtaaattagagttatgctgctgcaagccaaggaactaccagaacctaggagagagaatggagatctgtcaacaccatgatctcagactcatagcctccaatacatatggcagtaaatttctgttgtgtaagccactcaattcgtgatacttccttacagcagccctagcaaactaatatagacagcttaatagtatgtaggacaatagtaggtgctgagctaagggctctaaaattacttctagcccactgtatagctgctttcatttaatttaacaaatatataatgtttatgataaattagggactactgtagaaaatttgtaaatattaaccaatgtgcatccaaataacaattgtgttatataggttcatttattattttaaagatgtcaggaaaacattcaagcaaacattgcatggcagggcagacattcttagaccttatataggggattttcctgagggtgtcatataacacatgcacacttatgcaagtttttaaaaagctcattctctagtgatagtgaaagacgtaggcaaaggacatgctccagacaagaatacctgtatcctagtcctgcacctctgtttcctgagccgtagaccctggacacatcatttctttcagcctccatcttacacctcctaatactaactaggttactataaaattaagtcagatgataattttaaatgttaaaataaacatcaaaaagaaataaagtctctaatacatagtttgccctagagattttcatttttagagggattattccctcaatattttctcaaataatgtattaatttatacactgcttgtgaacactgagatttaagaaaccatttaaattatttagagaatacttgaaaggctttaaaaccatctgactggaatgcaaactacacatacaattactttcaaagagataaaaattgatatgaaattataattcataatgattaatgttgaacgagcataaaaccaactgcatatttgtcctttaagcaaagctttggattcagaattatagattaaaatatgtgttaatcttgggacttgcctttaattaatttatggcatagaacctaaaaatgggaagtatattaattaaaatgagagtgaatatagtcagactgggttgggaaagaatcttgatggattcttttcaccacattcttagtatggaggaggtgcgagtctagatcacatctcaagtgtatgatggagttgggggaaaatgatttcttaccaagacctggtatattagtcaaggtaagtattgctagctgctataacaaacaatcgtgaaatcccagtcccttaaaacaggaaacatttatttcttgctcacatcataggtctgaggcaggttgggtgcctctactgagcagccctgctgcgagagagactgtggaatccagtctcctatcttgtgattttaccatcttagacaagtggcctccatggctactgaggaaagagtagagagagaagtggagaatcacataggctaaactcacattccaatggtcataactcagtcagtatagctgtaacctgacaagaccctgaccaataacgttttgctttctgctatcatcatatgggcctttcttcagtgctctaagtatgcaatttttcttttccttctgggcctttgaactttcctttacccgtcttggggcacttccttgccatatcccaataacccacgtgcttttcaccagcacagcaagcttccaaggaatgtttcttcagttgaactctatcatcttgtcaaggagttttttacacgttgttcatgttcacgggaatgtctagaaagacaaattctgattatctgtgtctgagacattttgctagtgcaaagtcaaccttcatcatgatattatgatttatgtggcactttttatgctttataaaactgtttttaattgataaaactaagcagaaatgtatttatagacagttgtttccagagtttcactgttactgaaaatgctgtactgaataagggtgtatttttaatctgcattccatgcttatagctatataagctttatgaagcttatatagcttcataaaatgtattataaattcttcaacataatttcatagttaatagtttcataattaatagtacctgttggtagtatctttcatatgccagctgaataatcattatcattgtcataatgcttaataacaacaataataattgatagtagttgttgtgtacatgtatatgtgggtactggcctatgcttttgatatgtattatttcatttaaacttcattgtactagtcagggctctctagagggtcggaactaataggataaatgtataaaggagagtttattaagaagtattaactcacacaatcataaggtgaggttccacattaggacatctgcaagctgaggagcaaggaagccagtctgagtcccaaagctgaagaacttggagtctgttgttcgagagcaggaagcatccagcacaggaaaaagatgtagccttggaggctaagccagtttaatatttcaactttcttctgcctgcttttattctggcagcgctggcagctgattagatggtgcccacccggattgagggtaggtctgcctttcccagtccactgactcaaatgttaatctcctttggcaacaccctcacagacacacccaggaacaatactttgcatccttcaatccaatcaagttgacattcagtaataaccatcacaagtccaccccttgtcaacttgaacccatacacatctcctgaaatcatacataatcttcaaataaagacaataagttcataattacacataacataatacaactatcctttgtacaaccagaaatgcaccaatccccaacccaagtgctatcacataaagtaataacacttaaatgctgacatgaaatcaataaatcttatgtcacatgataaaggagaaatgaatgaaatgaagatattttcttagtacaagtgtatacatgcacaaacatgttcttaacaaaataaagaggaaatactcatgacaattacactcctcatttctgcaactggtcatatggtcgtagctggtattgatgactaccttcttctactacccattctgtattccctttgccttcagcaagcacctcagcaggccatggttttttacttggtgtagtgacccaaaccttcagtcctgaaggatctgggctatttgtagtcctgcctggattgtgttcttctagtttcccattgaccttaatcacgtcacagggcatggtaatactaaaagacactctaagggatctcctgtattccacacatattcttccttacctccattttgaagtagtggactgatttcatcttgatagtccaggtcagtcaccccaaccaaacactgtaactcccttcttagcctccctaacttaccttctaaaggtaggaggagctcaaaatatccaggtggcaatcttaacttccagcttaatagaattgttgcattcttcaatactttgcatccttcaatctaatcaagttgacattcaatattaaccatcatattcatcctgatcctgttctgttaaaattatcattatcccagtcttacaaatgaggatgctaagaccctgagagaccatgtgatcagcctgtcgtcactcagccagcaagtagtggaactaggctttaaagtcaggccatttttagtttcaaaagtctcactcttttcatctttccacaccatgtatggaaagaatactgagtgagacaggccccaatcagggctctcttaatttataaactgtgtgatctctggcaactcacccaaccctcccttatcttagcttccgtgattacagtaattgtgattgtgtgttccacaccactgcaggacgataaaatgcaacaaggtatgtggaaactttgaaaattccaacatgctgtacaaatccaagggataatcagaagattattattgagtcacagattgactttgttcgtcgagcagactcttggcaaatattaaggatatgcccagagcactcaaatctccaaattggaaacaaagcaatcatataattcctcttataaaatatagcagtgcgactgaaaatgtaagggcccctttacatctctaatgttttcacgaatgttggaggaaaatcattaataaagttgttaaaacaaatactttctggagtatttgttgaaatagctctgtgattcatctttgattaatgtatttacaggctacttgatggacttgttcatgtgctagctctgggattccactgaactccacattctagtcttcattcttttgaaaacatattctggcacagagccgtctatggtgggctgtgtaggtcaagaggtcagggttcaatccttgccttcttgcgagtttgccttgtgatgtcatgcaagttgtcttcctctccatgccttcttttcatttataccattgagtggatggattggacaagatgatacttgatacaataattccccagtgtagttgatattttgaatcatgtgtaggtgttgttaaaataaaaaaattctgaaataaggccacatacctgcaatcaactgatatttgacaaagttgacaaaaataaacaatagggaaaggacaccctatttaataaagggtactgggaaaattggctagccatacacataagaatacaactgaactcctatctctcatcataatcaaaaatcaactcaagatggatcacagacctaaacataatacttgcaactataaaaatccttaaaaaaaaaatctaggaaaagcttttctgaacatgggcctagtcaaataatttatgatgaagaccccaaaagcaaatgcaacaaaaccaaaaatagacaaatgtgactttatcaaactaaaaagcttctgcacagcaaaagaaaaaaatcaacaaacagacaacagaacgggagaaaatatttgcgaattatgcctccaacaaagaactaatagccagaatgtacaaggtactcaaacaactcaacaagaaaaaaaaataaagagctacattaaaagtgggcaaagggcccgagcacccgtaggtcggattctctggataaggcaccggaagtgaccgcctcgcggctgcttcctctcctggagtccagagtctcgctgttccgccgcgatattcagtaaaccactgggagtccggcagcatgaaggcagcgcgccctcccatgactgcagggaagttcatggtggtcggcggcggcatcgcgggcgtcacttgtgcggagcagttggctactcactttccatcagaagatattctcttggtaacagcttctcctgttatgaaagcagttacaaatttcaagcagatttctaaaatattggaagaatttgatgttgaagaacaatcaagtaccatgttagaaaaacgctttcccaacatcaaggttatagaatctggcgtaaagcaactgaagagtgaagaacactgcattgtaacagaagatggcaatcagcatgtatataagaaactctgtgtgctggagctaaaccaaagttgatatgtgaaggaaatccttatgtattaggaatccgtgatacagacagtgctcaggaatttcagaaacagcttactaaagctaaaagaataatgatcttagggaacggtggtatcgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcatataaaagaaccagatatacaactgaaggaaggaaaaaggaagctagaagcaaatctaaatcagataatgtaggcagtgcgttgggaccagattggcatgaaggcttgaatcttaaaggaacaaaagagttttctcataagattcaccttgaagctatgtgtgaagtaaagaaaatctaccttcaggatgagtttagaattttgaagaaaaagtccttcacttttccaagagaccatacgtcagttacaactaatacagagatgtggcctgtctatgtggaattgaccaatgaaaagatatatggctgcgatttcattgtcagtgctacaggagttacaccgaatatagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacaagaatacatcaaagtcgtcatgcaaaatggacgaatgatgggagctttcttaattggtgaaactgatttagaagaaacatttgaaaacctaatcttaaaccaaatgaatctttcatcatatggagaagatctgctagatccaaatattgatatagaagattattttgactaaaaatggaatttcttcaagaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaatacaacactgaccacttggataaaaatcttaagttatttatttctgtgttttaaacataaatatgtttacttgtgatttagctttggagcaaatttaggtaagttatctatttagccaaatgtactctagtagattagaaccattctttgtgaaatgtcaaaatatggctgtggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtcgaatgcagcccaggacagctttgaatgcagcccaacacaaatttgtaaactttcttaaaacttgagatttttcttgcaatttttttttaagcttatcagctatcgtcagtgttagcatgttttatgtgcggcccaagacaattcttcttccaatgtggctcagggaagccaaaagattggacatccctgatctacatatttaacttaaagtatcactcagtgagcctctgtcagtgtaatattgctttcaaaaagatagttatgtcaaaagaaaaaatatagctaagtatataaaggcataaaaaacttaagacaattatatggacttattctcaaatattttacattttttgtaaactttcttaaaacatgagatttttcttgcaattttttttttaagctcatcagctgtcatcagtgttagcatattttatgtgaggcccaagacaattcttcttccaatgtggctcagggaagccaaaagattggacatccctgatctacatatttaacttaaagtatcactcattgagcctctgtcagtataatattgctttcaaaaagatagttatgtcaaaagaaaaaatatagctaagtatataaaggcataaaaaacttaagacaattatatgaacttattctcaaatattttacaattaaagggttttacataaaaatttttcccttgttttatactggaaaattatataatcgtgatctctaattttcaaacattctcaaaagtttagatcttcagagataagctctgaaaatatagatccatacatataaaatatctatgaaattcttttaaaaactattgtctaactacaaaaatagtggcatatacatgcataaaccatctttaattagaaaatttagtaacattcatgtcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctacaaaaaaaaaaaataacaaagcaagcaccttggtaaaaatccagctattcagttttctcatgagattaaatatttcaaaatattctttctgtatcagttggctttttaagtatacaggggtctagttttttatctacaaatttctattcaaatatgagctctattttgaataaaaggggctacattgtgagagaagttctaaagacctcaaatgtccttagacacaatggcacttgacttgacatgcttttgcagacttgatagtatttggtttaaaacagtggtttctaaccactggaacagcagaaacagacttctcaactattagtaatcacaaccaaataagagcagagtgcataacaaaattagatattaaaacagagtcctcccattccaagaaactggaaacccctagtttatgttaaaaggccagtctaaattctttcacttatatctttacagaaaactatattttctctcttccatacccagaaatctaatcagaaaactgacttttctcatgttcaactggacctaggggaatatgacagaaaagcatcccataggctttaatatactttttaaaatatataaaactgaaaattaatagccatttaccctgaaagagttctgtgtggactttgtcacttgcacagtaatagcatgtgcctcattgttcagaagattagctttaggtcctattttcaaataagaaatggtagcataagctgtaaaactgtagtcttctctgcagaaaatgccaacaataagaaagcttttgaaggaatcacggaaaacaaatttataaaagcaataactatatgcgcagtaatttttaatacattgacttgaaataataaaatttacaagaatgcaaataaagcctttaaagaaaaaaaaagtgggcaaaggacatgaacaaacatttctcaaaagaagaaatagaagcagccaacaaacacatgatataatgatcagtatccctaatctttggagaaatgcaaattaaaaccacactaagacatcatcatacaccagtcagaatggctattattaaaaagttgaaaaacaatagatgtttgtgtggatgcagagaaaaggaacacactgttggtgggaatgtaaattagttcagcctctatggaagacggtatggaaatagctcaaaggactaaaaatagaaccactgtttgacccagcaatcccacttctgggtatcattatattaaaaatgacacctgcacttgaatgttcatcacagtacctcacaataggaaagtcatggaaccaacctaagtgtttaccaactgttgattttattttaaaaatgtggtatatgcatgccaagtaatactatatggccatgaaaaagaatgaaatcatatcctttgcagcaacatagatggacctggaggccattatcttaagtgaactaactcagaagcagaaaatcaaatatcacctgttctcacttataagtctgcactaaacagtgggtacacatggacataaagatggaaatagtagacagtgggtactccaaaagcagggaaggcaggagggctctgaggaatgaaaaattacctcttgggtacaatgttcaatatttgagtgatgggtacaccagaagcccaatcctcaacattattcaaaatacccatgtgacaaacatgtacatgttccccctgaatctacatttttttttcagaagaaaataagtgattgtttttatttttaggaaactaaacaaatatcattttcttctctctgatctcatagcacttgacaaacaacagggtgtagcagtccaaaccctggcactagaatctacattttttaaaaaaagtaacaattacaaataatatcttctgtatcctattccctattctccctcttcctagaatacattccaatgccttcaactattattttaatcacaaaattgttgatgacaaattgtgatattcaaatgtctttttttcattaatagaggtattactgtataacctgtgaaagaaatgctttactttgataagggaaaatgatgagtacaggagttaaaaaatattcttcttaaactctagactttttgagaccaaacctcttggaatttgtattacttattcaaattgttcagctggaggctattatcctaagtgaattaacacaagaacagaaaaccaaataccgtatgttctcacttataagtaggagctaaacgttgagtacacatggatgcaaagatgggaacaatagaaactgggtcctgcttgagggaggaggctgagaggagggtgagggtcgaaaaactacctgttgggtactatgctgtctacctgggtaataaaaccatttgtacaccaaaccacagcaacacacaatttacccatgtaacaaacctgcacatgtgctccttggacctaaaataaaagttgagaaaagaaaaataaataaacaataatagtggaaaaattcataattttacttctgtgtcatggtcaattaaaattttaatatttagcaaagcaaagaaaaaaattgttcgtatggtaatgtaaaaagataagtcttgaatttctacatgaatcctaaaatttgcaaaataaataaaactaagtttagcagctctctgtatttctttagccatagactaagcaactgttctattattcctttagaaaattccttttgtactcaaattttcttaattctgcttatgcaacagccaggattctcagtatgtaacagtgggttttgccaacttgggtcccagcctaaattctagttatttgttttaaatatttaatgcaagtcagccagaatgccaaaacactatccttattactaagcaatatattaaacaaacacccctgacttgttcctcacccttaatccacagaattgaaacgaggaatggaagaacaaataaattttaacgtaaaataataataatttaatgataacataaaataatacacaaacacataataataattggatgttagtcttttttaaggctttatcagaatattctgtgttaaattggctgggtcagaatggccaataagattttacacatccaaatggctctctattacactgaggaggtttcgttcattcctgtgtgacactgtgttagtgctttgtgcagaattgtttttgtaatatttccttgaaaaaagtgtagaattttctgtctttgcagaacattgaatggtggtgctatatatttattatagcttcttgaagtgtagttatatacaccagatatgtagaaatagaacccacatctcccatgggatgtgtgaatgacagtgtggtgacaaaagcaccccaggggttcaggctaactgttggttttaaagcaaggaaaacttttagttctgtgcctttaatgtgtatgatttactgattgtgtgtatgtgctgaaaaataaaatcattttcaccctgtgggaaaaaaggcagtttgtttgtgtaaggtattaaagactgcatataaatttaatattctccacatagcataaaatttaatgcttgttaagtaaaattgaataaagactctaaaagcaaaacataaacatttcatatttggaaaatttgcacaacagaatgccaaaatatttgttgatgttcttctttcaactataaagcatagacgtatttcctttaaatattatatgaatcctgctgtgatttaaaaagaaaagtggcatctaatcatggaacattaaattgacttggttatgtagtttatggcttatttatcaaaaaagaattcaaatccatttttagaatgaatttctgagatttaaagaatagaaatgaaactaaatgcaaacacacaagaaaataaaaaagcacagagataaattgtctaaaaggctatatttttggtatttttgtttatttaatgaataaacaatatgaattatacagtatctcatctcaacaaaggcaacatttcaatctattgaataaacagtagcataattagccttgagttaatatcccctcctcacacatacacttttctatggttcacttcagtaaaaaggcaaatcttttctgctttagttcctgcatatttagagtgcttaggctaggccaggtgcagtgggtcatgcctataatcccggcactttgggaggctgaggcgggtggatcatttgtgtcaggacttcaagaccagtctggccaacatgtttaaaccctgtctgtactaaaaatacaaaaattagccaggcatgatggcatgtacctgtagtttcagctactcaggaggctgaggcaggaaaatcatttgaacctgggagggagaggttgcagtgagccggtatcatgccactgcactccagcctgggtgatagagtgagactctgtctctaaataaataatattttttttaaaaagtgcttagcctagtactggctgctcactaatcaaggtagcgtgtgctgaaggttgcatggctgtgacaatttcttaaggaagaccatagtattggtaggttttagatattaagtaaatatttttaaaacaaataaatggttattataaatgcagacattaggatgatatttttttaaaaaataaatagccctatgggggaaagttggttttatttcaaagcaccttatttttttggaataattgtgtgttaagaatcaaaacacacatacacatcgaatgattaaacaaataagcaaggaaaacaaataagcaaggaaaacaaacttcttctacattatttttatttatttatgttttaactgaaagtttgtgttctttgatcaacatctcctcaatccttccatatcccagcctctggtaaccaccattttaatctctatgtctatgagtttgaattttatacttcaaatataggtgaggccatgcagtatttgggtacttgtctttctgtacttatttcactttacataatgttcttcatgttcaaacatggtgtctcaaaagacagtattttttttcttttgtaaggctgaatggtattctctggtgtatccaggcacacctcagagatactgtgggtttggttacaaccactccaataaaacaaatattacaagaaggcaaatcacacaatattttttgctttccagtgtatttacagttcttttcacactatactgtagtccattaagtttgcaatagcattatgtctgaaaaatgtatataccttaataaaaaaaaactttattgctaaaaatgctaatgattatctgagccttcatcaagtcataatcttttttgctggtggagggtcttaccttgatgtaaatggctactgactgatcagggtagtggttgctgaaggttgggtggctctaacaatttcttaaagtaagacagcaatgaagtttgctgcatcgattgactcgtcctatcacaaaacatttccttatagcttgcaatgctgtttgatagcattgtattcacagtagtattgctttcaaaatttgaatatgtcttctcaaactctgtgctgctttatcaactaattttaggtaatattctaaatcttttgttgtcatttcaacagtgttcactgagtcttcagcaggagtaggttgcttctcaagaaaccactttctttgcccatctgtaagaagtaacttctcattcatttaagttttatcatgagattgcagcaattcagccacatcttcaacatctaattctagtgctttttgccatttctactatatctgcagtgataccctcaactgaagtcttgaagctctccaagtcatcaccgagggttgaaataaacttcttccaaactgttaatgctgaagacagcttctttaaacctcatgaaccatcctctgctaccttcaagctttcttctgcagcttcctcacctccctcagccttcatagaattagagatctaaggccgcctttctctggattaggctttggctaaacagaatgtaatggctgatttgatcttccatgcatactactaaaactttctccgtatcagcaataatactgttttagtttcttatcatttgtgtgttcaccggagtagcattttttaaaatttccttcaagaacctttcattttcattcgcaacttggctcactgacttaagaggtgtagttttctgcttatctcagctttcgacatgcctttcttactaagcttaatcatttctagcatttgatataaagtgagagccctgcaacttttcttttcacttgaacacttagaggtcattgtagtgttattcattggtctaatttcaatattgttgttctcatgtgatagggagctctgaggagagggagaagaactgggaacagctcgttggtggggcactcagaacacacacgatgttgactgattaagttcactgtcttatacgggtgtggtttgtggtgccccaaaacaattaccatagtaacatcaaggatcactgatcacaggttaccataacacatataataatgaaagagcttgaaatattatgagaattgccaaaatatgacacagagacatgagatgagcatatgatgttggaaaaatatcaccagtagatttgttcaacagaaggttgtcacaaactttcaatttgtaaaaccatgcaatatctgcaaagggcaataaagtgaagcacaataaaatgaggtatgcttgtatataccacaatccataccacaattatccattcatctgttgatggacacttaggtttattccgtattttggctatagtgtttaatgctgcagtgaacatggggtgcagattactgtcatttgatttcattttttaaatatatactcagtagtgagattgctggatcatatagtaattctatttttactttcttgaagaatgttgatactgtttgtcatcatggctgtactaatttccactcccaccaacagtgtacaggggttctcttttctccacattttgctggtactcattatttttcatcattttaatagccattctaacaggtatcaggtgatatctcattgtagttttaatttgtatttatctgatgattagtgatgttggacatttttttcatatttctcttggctatttgtatgtcttcttttgagaaatgtctgtattcaggccttttgcccatttaatttggttgttttcttcttagtcagttgagttctttatatattttggatactaaaacccttgtaagatatatggtttgcaaatattttcccctattctgtatgtcgtttcttcacactgttgatgtttcctttgctgtgctgaagctttttaatttgatagaatctcattgatctattctcatttttattgtctgtgcttttggggtcatgtccaaaaaattgctgttcagagcaatgtcaaggagcttttcctctatgttttcttttagtagttagtttctagtcttaaataggaactattggaactaaagttataggagctatttttgctggaggtcctagtgcaaatactccaagcttaaaggataaactttgcataatggtaaatcttgggggcaagatgacatctatcaatatgttttaaggaaaattcatattgtgattgtttaatttgggccagatataactgtcatttcatatgcttcatcatatcccagctagaagatgaatgttagaggacaaatgaattatttcgtcattaacttagctgatgtaatctttaggaaggggtggaactgcaccacatttaaatgttccttccccttttattttctggaagacactgacaaaatggtgttaattctttttcaaatagttgttagaattttccagcaaaactatttggcctgaagatttttttttcaaaaaactttaaattatacatttcatgtttttaatggttataaaatgattcagattatcagtttcatcttggttgagttttggtagtttgggtttttttcaagggattggttcatttaaactgtcaaattttttaatgtaaagctgtttgtgatatccccttattattcttgtaatgtctatattatctatagtgataacccctatcttgttccttatgttgatttttgtttacttagctgtcattttcatcagtgttgctagactttactgattttattgatgttttttcaaagaaaccatttttttttgctcattttctttattgttttcctgtttgtaatttcattgattacctctcttatggtttttgtttcctcccttctgcttgctttgggtttattttgctcttatatttttcttttctgaggtagacacttagattattgattcgtgatttgttctcgccttgattataagcactctcttcactgctttggctgcatgctacttattttaatatgctgtatttccattttgatttcattttatgcaatttaatttctgttaacaattcctcttttaaaatgaattgtgtagaaaagtgttgtttcattttcacattgttagggatttttctgttgtctttcagttattgacttctagtattatttcacctagttaacatactctgtacaatttcaacttttgaaatttattctggtgtttttttatggcctaggatttggtcggtatatgttccatgatctccttggggttttttttttttttttttttttaaagaaagagtattctgctgttgttggattgtcaaattattttagatattaattagatcgtatttgtagattttgttgtttttgtagattttgttgttaaggtatcagttttctgtggctactgtaacaaattaccacaaacttggtagcttaaaacaacataaatttattctttcatagtcctgcatgccagaagtcaaagtgtcaaaaggaccatgctatctccagaggctctggggtagaatccatttcttgcttcttctagctttttgtggctgctggcaggtcttgaggtttcttggcttgaggtcacatcactctaatctatgtctctttcttcacgtcaccttctcctttgtgtgtggtgtgtgtgtgcgtgtgtttgtgtgtctgtgtgcatgtgtggtctccctctgccttcctcttgtgaggccactcatgacgatcaaagtatcagaatgtataatattatcatatttgtctcagtcatcgcatatgatttagacaactcatgaggagaagataatctatgtatttacccatacttctagtccttctgttccttttcttccttcctggtgctcaaagatttttttctcttatctttttctttctgtttaaagacctttctttagccattcttttttattattattattatactttaagttttagggtacatatgcaccctaaaatgtatcttggagtgaattcctttgagtttatccttatttagaatccatatagttgaatttgtgggtttatgtctttcaccaaatttaagacattttcatctatagtttattcaaatactatttcaacctcactctcccctatacttttggaactcttaggatatgaatgtggatttcttttttattgtcctaaagatccctaaaactttttttcagcctattttctctgttgttcagattgagtaaattctattaagctgtcctcaattcactgattctatcctctgtcatctccattctaattttgagcccacccagcatgttttctatttttgttgctgtatttttcagttgtataatttacattggttatttttatatttctattgctttactgagattttgtgttttaaaattcatttaaaaagaatttataattgctcgttgaaatattttcttatgccctctttaaaattcttgacagataattccaacatctgattcattttagtgttggcgtcaatcgattgtcttttctcattcaagttgtgattttcttggttcttattatgattcttatgatggttgactttctattatatttttgataatttgggtattgtgtttgttaggagactctagattctatttaaaatttttattttaacagtcaattcctctatttaggtttggcatgtaggtcctggcctacttttgtgggttttagttgcaatgactgtgtaattttcagaggttatgtggtgctattttcatcttggtttatttcatgcctcatggctcccactgtccttggtaatgctgcttgagggtgcagagcaagcttctccaggtcagatatccttatgtctctatatggaggggatttttcagcccatgtggatgaagagtaattcctagctgggcatttgttgtgcaaaattactcttgctggtgactctagccatacaatttcttgagtagtgagttatggtgggtgtgagagggagaatatcaggacattaagaacatggaagcttctcagactgggcactgtctcctgcttttttagctagagctagttctttgaaagcaaatgttgctctgtgagagcagtggcccttctggaagcccctttaattattgaagcacccgggacatatcattctgtttgtgctttcataaattacattgcagggatctgaaagaccagaaaccaaatctagaagtgcccattttttgttactgaactgaattctaaagaatagtcatgcaaatctatatcagcagctacatctatatctgtagcaacaacttctctcttttcaactgcccattgtgaacatctctttaaggttgttttgccatcacattgatttatatttaaaattgtaattgcttcgcttctctctccttcaccttcaggcttctacagtggttaagagtgtttcctttggagtcagtccagtttgggtttgagtgttgaccttactgcttattagcttgtattctttacaaatctcttaacctccctaaatcttaaaactgaggatagtaatagctagcaaaagagtaaaattcagtaacaaagtataaattaagtattaattaagtactcagcacagtacatgggcaatagcaagtactcacagatgtgttgagttagctacaggcatcatcctcctcaacatcattatcatcttttccagtttatagataaggaaaccgaggctttgaaaggatagggaactgaacgtaggtcagttttcccacttaattttcaggagagttgaaattcaaattcagacctgacttcttccaaatccttcttttcaaactattatgtaacactgcatcaaatgattttcttataaaacctgaagctccatgagagcatggattaggccatgctcaagataggcaaaaatataaaacatgtaatgtgcagttatatgacctggacttactcaattctgattacttattgataacagtggtgaatattttcatagaactatctgagcattaacatgcaacaaacccccatgagatgaatttacctatataacaaacctgcacatgtaccccccaacccagcataaaagtaaaatgaaaaaagaaataatgaagatagtttaacagaacctgacaaccaaggtttgtgatagtatgatatttaaccctttactatagctcagagcaaaatactcccctttgttatgcttgccaatttctgaaatctgacaaatgttatgacaatttatttttcttatgtcttctgtgctatctcattgaaacttcaatatgatgtaagatgcaataaaaccttagatagatgtttatattttaagcaattttccacaattcttttatatacaaatatgtagttcttataatagttttgcttattgctaagttaataaatgcaaataatgatgaatttctgaagttataattatgagaaacataattcaagaaggataatttatattattttccaattaaagtaaaaatgcattggtgacagagatacaaatggtgccattgaatctgcccatttattaaataaaaagttcactgatagaaaatattgaaaaggaagttatttactttatttctttgggcttatcgtctatgaattgtttttctgtagtgtaggcaatcaacaacattttcttccttcagggtctgtttatgtagagatttcagaaaacaaactaatggccacatataagtcaaggacatatttgctattttacatttttgagacaggaatgtgaactattcaatttagactttttataaattaatatttaaaatgcattacatataggaaataatatatattaatttatgcatacatacatacactaattccacatttaaaattaagatggagatgataaaggcaaaagagaataaggtctagttgtgatggtaaatgttaaagttgatacctaggaagaaaagagaaagaaaaagaaaacaggaaccaatggaaaaaaatgagagtagagtccaagcgatgaagaagagagaccagcagaaggagagacaaacaccaaataaagagaggagggtgaaaaaagtgtaactccacgaagcaagggagaagaaagaagaaatcaagatggagaagaaaaaagaagtaattggaaagaaatgtgaagagagagagagagactacatagaagtttaaatatatgagtatcagatgttatcattgccatttaaaaatatgattaactctattaagcttatcaaggtttttgcgcttatgtcaatcttaaaaaaatttatataataatttttaaactatgggattgtacattatgtgtttcttccttaccatgcccttaagatcctaataacaagaaagtatgtattattagcaacactcctaccctaaagagcatatgaaacatatacaaacaatctgtaaatattttacaggacaattattttctttttactcaaaccataacctgtagtattttgagagcctattttaggtagtgaatttagaatgtcttcctcctcctattctctggccgatatagatttggttctccaccatactgtgatacgtttgaaaaggggaactgtattttatctttctatccttatcatccagagcagagcattactagtaaatagaaaataatcaatattttagtgaataaataagagtaatataaataaaaggatgaaatactgaactttagcagaaattttacataaggtaaagtgagcatttaattccataaaaattataacatcaagcaagattccattttattttcttatataaacaagatcttggtgaatggtacaagggagaaaagtaaaaatattaatgacttaaaaatccagatcccaatagtttattccatatttgttcagtgccaccagtttttatcaactagcttaactatttagctataaagaaaacaggaaaatacatgtattgagcacattccatgtagtagtggaacatagatgaaactgatgcacagtcccaactggtcaacttttagcctattctttctaagtaattgcaactggctttttctccaggtgtgcttagtttaaccttagtccaatccaaatagttatagttgtagccataccccagctccaccttccttttctactggtgttcattgttcatgccctctgaaggtgttcattaggctactgggcataagcttgtgttcactaagtttcccattaaatctcagttccctaaattctccagtgaaagggcatagaaaagaggaatagatttaaattactttaccctcagattctttatcatatgacccaaattcctttagtattataattattattttttcatttatttttagcttatatgaacatgctagttgagtgatattttctgataatgctagcttaatatctggtttatatttttatttttaagaataagagaactgtccactaacctaacaagtgcaatgactagtacattttaaaagtactataatagttgaaaaatgatttacataaggccaattactttgattcattttaacctcctggatttattttctgaaaggggtattattttaatgacagttaaatatagttattttgacagatggatttaccatattttcattattatttagtaggctgaaagcttttgaattggctcataaaccagtttcatgatgtaccttggagtatcatcttgaataaaaaatgttttcctgtttcatttttcactgatctcactttccatttcattattgtctttagaaagtagctgagtgagatataaaacaattgtttctcttcagaaccatgaattttaaactggctgaaaatcagatttaaatttgcttatatgaatgcagtaactcagtattgctaataaaacattttttctttctattcatcagataatatattaaattttgtgaacctactatgtgaagagtactgatcaaaattccatgttaatttcacaggtgatggaagtcaaaggacaaatgatccatgttccagaatcaaattccattttatttttgggctctccatgtgtggacaagttggatgaactcatgggccgagggctacatctctcagacatccctatccatgatgccacccgagatgtcattttggttggtgagcaggcaaaggcccaagatgggttgaagaaaaggatggataaattaaaggcaactttagaaagaactcaccaggccctggaagaagagaaaaagaagacagtggatcttctatattctattttccctggtgatgtagcccagcaattatggcaagggcagcaagtacaggccagaaagtttgatgatgtcaccatgctcttttcagacattgttggcttcacagccatatgtgcccagtgtactcccatgcaagtaatcagcatgctgaatgaactgtacaccagatttgaccaccagtgtggatttttggatatttataaggtaagggagtttagttacttacatataaatgttttttaatagtaaattgtcatgtgaattaaattgatttttttacttaaacttgatactaaataattgacaactctttaatttagaaattttatagataatacaggtatttcttctttatgagtaaactttcaatatgagttcgtttgtgttgacatagataactgtgaagaatcatgatattgctcagtaaggaaaaattctatatagctactcctctaagtttatttttattaaaaaattaaacttgttgaattctaggtaactttttaccacataattattcttgcttagaaaatggggttccaatataaactaagaattttattttgacagttaaaaacaaatagcaagttatattaaaatatgcattgtattgtcaaatatggctaatcagtattttgcactgcattattaagtgagatctctttaattctaaaaaaacctatatataaatactctagctattgctcaaatgactaatgagtttttgaggaagtaccttaattttccaagctacataatggaaaaatttccaaaattggtgccaaccaccatggttggtttgatttggtgaactccttattaatttcttactaagatcatagcaatattttgagtcatttagctccatatctacctaatcaataactctacaactttacctagaatcttacgtagattgcacaatgtcagggcatagggctttttttatatgaagggaatcaagtacttttagtataaatagttgtgagctgcaggttttattttcttctttactaatacatattgaccagctacttatttttacagtatgatcttcacataagcagatttggaaagaacttgtctgattcactttgtaaattttatattatcatccagaaggtgtttttatgaaggtgtgtcttcttggggaaatgagctctttagtttcattatgtagactatgtagccaatgttaaatattttaattgaatctcttctgagtggtaaacattcagtatgaagtatgtataagggattttccttgttacagaaaattaagttcttataaattatctttaactcccttataatttattggtatataatttacagcagtggtagccaaatgtctgattctaaaccggagagatactataatgttaaactgtcacttccaggacagaggagatcagctgaatttggcatcactttccttcctccatacttggggcactattacaccaatctctgccacaaccaatcttttccctctaaactactgatttgcagtgtttgcttcctccagttaaagcagtcatgttttttttgttttgttttgttttgttttagccctaagttcatacaactaaatgagaatgataatagataaataaattattctctggaaaaaacatgggaatccctgacaaacataagtatcagttagattttgagaaaagaagaaatgtgatgcttctgagtatgccaaaacaggttcaaggttttaaaatatgatttgatttcttagacatcaagcattcattcccttgtgagttaggacatctcacagaaaaacagtagaaatactccgtatgatcttcaaattttcctatatattattaaaccgtggacagtttcatatagtcatgaataataatcaacaagttttaacttacaaaatgtttatataaatatatatatatacacacacacatataataattctagttcacaacttttcttaaactaaacttgtttaggaaattttgcaattaattacaactaaagattccagggcttggtgttcttaacatatcttcaatgctagtgtattaatcagggttctctagagggatgggactaataggatagatgtatatatgaaagggagtttattaaggagtattgactcacacagtcacaaggtggaatcccaccataggctatctgcaagttgaggagcaaggaagccagtccgagttccaaaacctcaaaaagtagggaagccaacagtgcagccttcagtctgtggccgaaggcttgagaaccctgagcaaaccactagtgtaggtccaagagtccaaaagctaaagaacttggagtccaatgtttgagggcaggaagcatccagcacaaaagaaagatgaaggccaaaagactcaggccagtctagtccttctacattcctctgcctgcttttatcctagtcacgctggcagctgattagatggtacccacctggattgaaggtgggtctgcctctcccagtccattgactcaaatgttaatctcctttggcaacaccctcatagacacacctaggaacaatattttttatccttcaatccaatgacgtttacactcaatattaactatcacagctagtaagtacatgtatctaggataggtgtatagggcagctttggctgcttattcaggattagggaggttgagtttgggagatccagactggaaatacaatatatgctaaatccatagcagtaatggtttggccagagagggaaagacaaaatgatattagtcctgtataggataaaaaaagtacattaggagaaatgcattaggagggatataaattagaaaacttctatttgaccagcctgatttgtaatcttcataaacattctagtgtattttctagaaaatacacacagtgctattttaaaccatgaactatttgccagatttttaatggctattgaaacaaagaatcccagaggtggtagaattttttgtaaggaccacaagtcttattttatgaaatgaaaagagttttgctagattgaaagtatgtatagaatttgggtaattatgtagaataaccataccacagagaaaaataaggtacagcccaccttttatgttagaaatgtgaaaggaagccaggtaaaactaaatgccaagagaaaagaactagatggagtggcccacatggggctttcatagtgtgctacgacatgagatactagtctctaaatttgtggttgcccctctcttcttcatgtcattactccatgttttcctatcatcaggcagatgatagagtgaagaattataatttcagtggtagaattcagataaattaagacataatatgaccattctgctaaaataatcaagctatctataaactagagggttgaggaagaagctgtggattttgctgtgcatatatcaagcactgagaaaatgaaagcctttccaatgcttaactgccaagatgttacaggtgtatgaatactaagtaagagctaggcaaattgaagaaagcctgggttataattttgtttctcttgtaattagaaaggcaaattttcagtaaaagtcaacataaacaacatacgtaatattttgcttctcagattgttctcacatgaacataaagaaccagtatctaattttgtaaatcaatggcatataaatagtaacaataataatggcattgactattgaagcaaattcatgtacattttgctttgttttacatttgtctttgggaaagcctttgattttagataagcagggagaaagactttgcctttctctgattccattctgccatggttgcagtgttccagtgctattttaaatacaatctttagcatccccatcttttcacctttaagcactttaacttgacttttctccagttctataccccataaaataaagatattcagtgcatcagtctcacagttacatcataagcatttcagtgagctttcctataaagagttgagaataccatctggtacatagtagtaaatgtaaatattagctgccattagaacttctcagacaggtgtatctatctagacatacagggatgtgtgttatgtgattatgtttgtgtgtgtgtatgtgtgtgtgtgtatatatacacacatacctagtaggcccagagctttttagaaaagaataaaatatgatctcatataatccctccttgaataacatgtggcattatgtacattttcggataagaaaactgagttttggaaaggttaaatccagataatgtagctcacaagtcagaatttgaactgagacttgtctgattctaaagcctatagtttttgtacaatttaggctgtgatctagacaaagatcaaatgatagaaacaaagagtggaaactgtttaaaaatgacatgacagtataactacagttattgattctgtaaagtaggagattctcccgtctgccatcttttctctttgttagaaaccagccagcacctctgtcttcattcctcctatggaaagtggcataccaaaagaggcattgtgggagcagtggtcccaggtgcaggcaataagaggtatattttttaaacagtgaagtggaataaaagttgatctggttttaaaaatcatcttacccaggtaactctaaaaatgttagtgatggccaggcacggtggctcacgcctgtaatcccagcactttgggaggccgaggtgggtggatcacctgaggtcaggagttcgagaccagcctggccaacctggtgaaacgctgtctctactaaaaatacaaaaattagccaggcatggtggtgggtgcctgtaatccaaactagtcaggaggctgaggcaggagaattgcttgaacccaggtggtagaggttgcagtgagctgagatcacgccactgcattccagcctgggcaacagagtgagactacgtctcaaaaaaaaaaaaaaatgttagtgataaaatagttttctctgtcagagtaaaggtagagggggagtattcccatcacagcctctaagtgtggtttgcaaatgtccatggcattaaacattgtcaggtttagattgggaagaaggaacagtaagacaagatagggcaaccaggtaataccaggacccaaattctattacattagggaacctgatgttaaaaatctgaaaaacaacaacacaaagttcatattggcaaggaaatgtaagtattataagcctagctggaaaagcagagttcaggccaattagcaaagtaggaaatccaggctcactcacagggaatatgagtgggcccaaggggactagatgataggaactggaaaccaggcaacatgtctagatagaaagtataaatatgggtatcagtacaaactttgataaagaagcagagtcttttccctggacagaattaagcttagaatcagagggtgcacaggacaagtctacagtgtcaaaggggaactgaatatggcaacctcatcaaacatctgaaaacagatgtttctgacatagagttttagggctacacagctttatgcctcaagaattttgatttgtcttgccacttgataggaagctactaaagccctctcttcttcgctggaccttcagccagcctctagaaaatgcagtagattctcaaggatatcacttcagcatgaaatagatttcacagaaaaatgaaatgcttcacttccaccttgttttgttgcctttcaaagtacttaggtacttaggttattgttggaattttataaatatgtatatgccattttacgtcatttgcagcatgaaatgccagttccatttagtaaagagtaactgcttcatttttccccaagatttacatattttctcttttaatgatcagtgcacacactttttaaattgagcactgtttcagatttatgttagttctcttcagtagtctccatcaacatcaacatcatttgcttttactgatattttgttggaaacaaagcaacaatgttttctaattaggaaataagaatttcttaagtcaaaaatttattcaactcattcattcactcaataaacatttacaactcatttgataaggagccatgacttccatagaacctttaaaatgttatggaaattagcatgtatttttagaacaattttaatgaatagaaaagaactcatttatatgctgtaggaagtaaggtgaaagtcacagataagcattctgttccaatagcttttctatggcaggagttatattgtcagtttcaaaataccataatgctgtaaaaattacctgaagagggtttaacctcatttatacgtttgcctttggcgagcactttggttggagataaggaagaggcaagggtaagatatgtttctttcaatccattcagacaaggctgtggaatcccagtgctatcttgagtgcactagttggatttctcatcattccacctttcatgggttatttaatctctctgcctcattttatcatctgtaaataagagactaattttatcactttatagttttattttgtgagcttttaaatgagatttatgtaaagtgcttaaaacagtgtctccttcatggtagtaaatgtacatattagctattattactttccaaacaggtatatctggtcctatatgggaagcgcgtgtgtctgtgtgagtgtgtgtgttgtatatctgcaggcatttttatgtacataaacattgtgtatccaacgcttactagaaatagataaaatgcttatttatttggatttattcttttaggttattagaattgcattgtatgccaaagactgtgaaggaaggatagagaaataaaaggagggagggagataaatagctttccgaaatgcattatttgtgtcatcttcatggggcctcaaagattcttaaagatgcttccatctgcatactctgaattacaatatggaatttataaagatgacaatatttctgaaagccagaatgactcgtgggatgtctgtgaccaatactatgaaactgaaccccaaatgtctatttttatattctaatacggcagcctgaattatttttcttctatattcagagaacatttcttttagtgttgtggcatattctgaagacagttagaaggctaaaatacttttagttgctaagcagaagttaatattaatgatgtgtcttgctgaatttttcaaagtgttttgaggtttttgtccctatcgatatttaatttctgaagagtggtggcaactgcaaacagattggtgtttttgatttttacaaacagtatgaactgaatatttatgaccccccaaaattcatagttgaagccctacttaatgtgatattatttagaggtagagtattttggagttaatcaagtttagatgaggtcttgaaggtggggacttcaatgatggaattagcatcattataagaagaagtgacttgagcttgctttctttcctctttgaggacacactaagatggcagccacttgtaagctaggaagagagccctcacctgggaagtgaattggctggcatcttgatcttggactttccagcctccataactatgaggaataaattcctgttgtttaagccacccagtctatggtgttttggtatagcagcctgagcagactgaaatcccaagagaaggtatatcacttctacagaaagtgtggaaatttcttcatgatacaagtctctagtaagttctcttagtagattagtccatattgctaggatttcctgtatctaataagaataaatgctaccgtcccattgatgcaaatgaaagattttcattagccttatagagttaattgtgttattgcacagtatctctcttttgtgtatcaataaactgtaaagaatttaagctgtaagctcaaactgctcatttatctttgccactaccacttcagcagaacagtatgaacaacttgcctttagtttatacatagggtgagtttactaaaatggaaattcattttctaggcaggaccgctatctctcactcacctgataggatagccttaatgcaatctgcaaatctcactgaactgaggtgtttctattacctttttaaaacaaacaaacctttaattaatgcttttatgtagtagaaatgctgtaaatacttctgccactatttatcacttaataacagtgatttaaaaagtgaaaatttctgaaagcaaaatgaaactaacagaattcacatttacttgtattctcagtattaagtgcttaaactgtgatatttcacttattttccagaacaatcctgtggaataggtgttatgatgtcccttctgtgtttttaaatttttatttcaatttttgtgggtacatagtaggagtatgtatttatggagtacgtgagatgttttgatacaggcatgcaatgtgtgataatcacatcatggaaaatggggtatccattccctcaagtatttactttttgtgttacaaacaatccagttagacccttttaaaatgtacaattaaattattattaagtatgatggctctgttgtgctatcaaataataagtgtcccttttgaagatgagtttagtaagttgcagatgctacttgaatttagttctgatttagttaaaagctcaaattttagaaagcaatggtttaaatcattcatgtgtcagatagctagtgtttccaattacctagatggagaatcaggacaaaaaaattgttctggcacttacatactataggttagtgcaaaagtaattgtgggttttgcccttaattttaatacataaaatgagatattcatttatcaattggtacggtctctccaacaactttgacaaattaccagagttcatctttttaaaatgaaaacaatagtatgtcacaggactgttatgaggctgaaaagaactatgagccaaaggtccttgttacaaacatgaggccctcaatgtagtaattagaagatgaacatgaatttgtaaattgcaatttgaattctaccctagaggtaaaaatataactaggtttccttttttaaggtattcaacaaatgtgcactatttttgaatatgtgttggatatcataaatacttattctctttggctcccggaggttaaagaggatctttgtacaaaagttaaaagaatagtttcagcacagtagaagatccttaagaaaaaccgtgtttctaacagtgaaatagactggcagaagcatatgctctgatcacaggagtgatatgccacaaccttttggtggagcaggtaggaacaactttcagtaggtcccctgattctatgagattcttttttttttttatactttaagttctagggtacatgtgcataacgtgcaggtttgttacatatgtatatacatgccatgttggtgtgctgcacccattaactcgtcattttcattaggtatatctcctaatgctatccctcccccttccccctaccccacgacaggccctggtgtgtgatgttccccttcctgtgtccaagtattctcattgttcaattcccacatatgagtgagaacatgcggtgtttggttttttgtccttgcgatagtttgctgagaatgatggtttccagcttcatccatgtccctacaaaggacatgaactcatccttttttatggctgcatagtattccatggtgtatatctgtcacattttcttaatccagtctatcattgatggacatttgggttggttccaagtctttgctattgtgaatagtgccgcaatgaacatatgtgtgcatgtgtctttatagcagcatgatttataatcctttgggcatatacccagtaatgggatggctgggtcaaatggtatttctagttctagatccttgaggaatcgccacactgtcttccacgatggttgaactagtttacagtcccaccaacagtgtaaaagtgttcctatttctccacatcctctccagcacctgttgtttcctgactgtttaatgatcgccattctaactggtatgagatggtatctcattgtggttttgatttgcatttctctgatggccagtgatgataagcattttttcatgtgtctgttggctgcataaatgtcttcttttgagaagtgtctgttcatatccttcgcccacttgttgatggggtggttcttttcttgtaaatttgtttgagttctttgtagattctggatattagccctttgtcagatgagtaaattgcaaaaattttctcccattttgtaggttgcctgttcactctgatggtggtttcttttgctgtgcagaagctctttagtttaattagatcccatttgtcaattttggcttttattgccatagcttttggtgttttagacatgaagtccttgcccatgcctatgtcctgaatggtattgcctaggttttcttctagggtttttatggttttaggtctaacatttaagtctttaatccatcttgaattaatttctgtataaggtgtaaggaagggatctagtttcagcttcctacatatggctagccagttttcccagcaccatttattaaacagggaatcctttccccatttcttgtttttgtcaggtttgtcaaagatcagatagttgtagatgtgtggtattatttctgagaactctgttctgtaccattggtctacatctctgttttggtaccagtaccatgctgttttggttactgtcaccttgtaatatagtttgaagtcaggtagtgtgatgcatccagctttgttcttttgggttgtcttggctatgagggctctcttttggttccatatgaactttaaagtagttttttccaattctgtgaagaaagtcattggtagcttgatggggatggcattgaatctagaaattacctcgggcagtatggccattttcatgacattgattcgtcctacccatgagcatggaatgttcttccatttgtttgtgtcctcttttatttcattgagcagtggtttgtagttctccttcaagaggtccttcatatcccttgtaagttggattcctaggtattttattctctttgaagcagttgtgaatggagctctctgtttttctgttattggtgtataagaatgcttgtgatttttgcacattgattttgtatcctgagactttgctgaagttgcttatcagcttaaggagatttggggctgagacaatggggttttctaaatatacaatcatgtcatctgcaaacagacaatttgacttcctctcttcctaattgaataccctttatttctctctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttggttttgtttatatgctggattacatttattgatttgcatatgttgagccagccttgcatcccagggatgaagcccacttgatcatggtggataagctttttgatgtgctgctggatttggtttgccagtattttattgaggatttttgcattgatgttcatcaaggatattggtctaaaattctctttttttgttgtgtttttgccagcctttggtatcaggatgatgctggcctcataaaatgagttagggaggattccctctttttcttttgattggaatagtttcagaaggaatggtaccagctcctccttgtacctctggtagaattcggctgtgaatccgtctggtcctggactttttttggttggtaggctattaatgattgcctcaatttcagaccctgttatgggtctattcagggattcaacttcttcctggtttagtcttgggagggtgtatgtgtccaggaatttatccatttcttctagattttctagtttatttgcgtagaggtgtttatagtattctctgatggtaatttgtatttctgtgggattggtggtgatatcccctttatcattattgcgtctatttgattcttctttcttttcttcttttttagtcttgctgtgtggtctatcaattttgttaatcttttcaaaaaaccagctcctggattcattgattttttgaagggtcttttgtgtctctatctccttcagttctgctctgattttagttatttcttgccttctgctagcttttgaatgtgtttgctcttgcttctctagttcttttcattgtgatgtagggtgtcaattttagatctttcctgctttctcttgtgggcatttagtgctataaatttccctccacatactgctttgaatgtgtcccagagatgctggtttgttgtgtctttgttctcactggtttcaaagaacatctttatttttgccttcatttcattatgtacccagtagtcattcaggagcaggttgttcagtttccatgtagttgagtggttttgagtgagtttcttaatcctgagttctagtttgattacactgtggtctgagagacagtttgttataatttctgttgaggagtgctttacttccaactatgtggttagttttggaataactgcgatgtggtgctgagaagaatgtatattttgttgatttggggtgtagagttctgtagatgtctattaggtccacttggtgcagagttgagttcaattcctggatatcctttttaactttctgtctcgttgatctgtctaatgttgatcagagcgcctctccccctccaaaggaacgcagctcctctccagcaaggaacaaagctggacagagaatgactttgatgagttgagagaagaaggcttcagacgatcaaacttctccgagctaaaggaggaagttcgaacacatcgcaaagaagttaaaaccttgaaaaaagattagacgaatggctaactagaataaccattgtagagaagtccttaaatgacccgatggagcagaaaaccatggcacgagaactatgtgatgaacacataagcttcagtagccaatttgatcaactggaagaaagggtatcagtgattgaagatcaaatgaatgaaatgaagcgagaagagaagtttagagaaaaaagagtaaaaagaaatgaacaaagcctccaagaaatatgggactatgtgaaaagaccaaatctacgtctgattggtgtgcctgaaagtgacaggaagaatggaaccacgttggaaaagactctgcaggttattatccaggagaacttccccaacctagcaaggcaggccaacattcaaattcaggaaatacagagagcaccacaaagatactccttgagaagagcaactccaaaacacataattgtcagattcaccaaagttgaaatgaaggaaaaaatgttaagggcagccagagataaaggtcgggttacccacaaagggaagcccatcagactaacagctgatctctcagcagaaactctataagccagaagagagtgggggccgatattcaacattcttaaagaaaagaattttcaacccagaatttcatatccagccaaactaagcttcataactgaaggagaaataaaatcctttacagacaagcaaatgctgagacatcctgaaggaagcactaaacatggaaaggaacagctgttaccagccactgcaaaaacatgccaaattgtaaagaccatcgatgctaggaagaaactgcagcaactaacgagcaaaataaccagctaaattcataatgacaggatcaaattcacacataacaatattaaccttaaaggtaaatgggctaaatgctccaataaaagacacagactggcaaattggataaagagtcaagacccatcagtgtgctgtattcaggagacccatctcatgtgcagagacacacataggctcaaaataaagggatggaggaagagctaccaagcaaatggaaaacaaaaaaggcaggagttgcaatcctagtctctgataaaacagactttaaaccaacaaagatcaaaagagacaaagaaggccattacgtaatggtaaagggatcaattcaacaagaagagctaactatcctaaatatatatgcacccaatacaggagcacccagattcataaagcaagtccttacagacctacaaagagacttagactcccacacaataatagtgggagattttaacaccccactgtcaacattagattctatgagattctaatattctaaattcttagtgttggagctatatgtagtttgctaggaaaatgttttcaaactgcaaatcaatgctgctgcctccctattaataagttttaaatgatttgtgtttatttttgcaaacatcttttaaagtggaaagatgagaatttaactctgtcatcttaaatttgggttaaaatggatataaataagttttgatgcatttttcaagctttgaaatgggtaacatgactttcaagttggaaaaagataaatcagttgaaacaaaatcgctgtgagactgctgatttagctgtgagtatgtgttgggatggagggcatgcacatgcataggtgcacatgtgttggagtctatgaaagctgtctattaagataatgctgttcttaagattgtccaaagcatttttaatgttatattttcctgtgatagtcagagtttaatattggatagctttttatgctgtcatcaaagggcaacttcgtgcttctctctttttcccttaccaaattccataattagtgtcatcgcctcatatccagtcgggcatatttcagccctctgcttaatataaggtcctttgacgatcagagagagcccagatgaggactgttgtagttgcctatgacagtgcaatggtagctaaatgtaggggaaagggtattgaagataaagtctgaaaacctgattttaattatatctttgtcacataactgagtaagtcacgtaacttatctgtgttcagcttctgcatctataaaatgggagcagtattataggtctcacatatttgttgcagttgacacaaaaaacttgttcagcaaatgattgtttggaatttgtctattcataattcaaaataacgatatatatgtggaaaattgttgtaaattaatcaacagtatcagcaattgactccatctggagttattcatatgaaagaagaccaagatcagagagaatgtctttaggaatttgctatgaaagaagggacagggactgatattagttgaatgcctaatatgtgctaggtaccatgctaaattttttatatgtttattcattactttcattttcaataaataattatcagtcacatactgtgtttaagtgctaatctaggcattgggtaataacactattgagatatttattttattagatttggattttatttattggattttatgtgtttatccagcttttttgggttatattaataattaaataaaaatagtataaatttaaggttgacaatgtgacaatttgatatatgcatagattgtataatgattattacaatcaaattaatacatagttgatctattatcagacataattacctttgtgtttctgtgtgtgtgtgtgtgtgtgtagtgaggacatttaatatctactctcagcagatttcaagtataaaatacagtattagttactatggtcagcatgctatatggtagatccccagaatgtagtctttataactgaaaatttctgccatttgactaacatcttcccatttcttccaccctcaccccttggcaaacaccattctactctctgttcatatgagaaactcagagagttatttggattccacataagtgagatcatatagtatttatctttctgtgtctggcttatttcacttagcttaatgtcctccagattcatccacaaatggcaggattttgttctttattatggctgaatatttctttacatacatctgtgtgtgtgtgtatcacattttcttcatttatctgttgatagacacaggttgatgttacatcttggctattttgaataatgctgcaatgaacatggaagtgcagatatctcttcaaaatcctgatttcatttcctttggatatgtatccagaagtggagttgctgaaaattataattttacttttaattttttaggaacctccattgtgttttccataatagctgacccaatttacatcctcaaaaactgtgtacaaatgttcccttttctccatacactaactggcatttgttatctcagacttttgataatcatcattctaacaggtgtgaggtgatatctcgttgtggctttaatttgtacttcccttatgattactaattttgagctgtttcatatacctcttggccatttttaggtattctcttgaaaactgtttattcaggtcctttgttcatttttaaattgggctgtttgttgtttttgctattgagttgtatgagttctttgaatattttggatattagcccctcatcagacctgtgatttgcaaatattttctccccttctgtaggttgcctttttcattatgttgattgctttttttttgctatgcagaatatttttagtctgatgtaatcccacttgctaatttttgcttttgttgactgtgttgttgttgtatccaaaaaactcattgctaaggccagtgtcacagagctttgtccttatgtttttagctaaaagttttacagttttgggactcacatttgtgtctttattccattttgagttgatttttctgtatgtcataagagaaggatctaatttcatttccccaaccctatctagctgcccaaccaatttattgaagagaagattcttcctccattgtgttttcttggtgcccttgtaaaagattgtgtagatttagttctgggatctcattctgtcccattggtgtatgtgtctgtttatatgcaatcaccatactattttcattacgattctgtagtgattagtttgaaatcaggaaatctgacggctccagctttgttcttcattctcaagattattttggatattgtagttatatatgaattttaggattttttttctatttctgtgaattttgatagggattgcattggaatattgatagagattgcattgaatctgtaatcacttcgggttttatggacatttttacaatattaatttttccattccatgaacagatatttttccactgatgtgtcttcaatttctttaatcaatatattatagttttcaatgtacacatcattcacatccttgatgaaattaattttaagtagtttattctttttgttgctactttaagtgggatcattttcttaatttctttttcaatactgtgttgaataggataggcaagagaaggcatccttgtcttctgctgcttttcaaggagaatgcttccagcttttgcccattcagtatgatattggctttgggcttgtcatttgtgatgcttattattttgaggtatgttccttcaatacctattttattgggagtttttaacatgaatggatgttgaattttattgaaagcctttttctgcatctcttgagataatcatgtggtttttgtctttagttctgtttttgtgatgaatcacatttattgatttgtgtatgttgaactaaccttgcaacccagggataatgcctacttgatgatagtgggtaagctttttttttttttttttttgagatggagtctcactctgttgcccaggctggagtgcaatggtgtgatctcagctcactccaacctctgcctcctggattcaagtgattgtcctgcctcagcctccccagtagctgggattacaggcacccaccactgagcctggctaatttttgtatttttagtagagatggggtttcactatgttggccaagctggtctcgaactcctgacctcgtgatctgcctgccttagcctctcaaagtgctgggattacagacgtgagccaccacgcccggctgatagtgggtaagctttttgatttgttgctggattcagtttgccagtattttgttgaagaattttgcatcagtgttcatcaaggatgctggccctaagttttttttctttttttattgtatctctgccaggttttggtatcaggatgatgctgcccttacagaatgagttagggaggagtccctcctcaattttttggaatagttttagtaggaatggtaccagctcttctggtatgaaacgtaaatgagtttagtataagatatataaaaaccaaattttattggtgttctaaaggaatcaaatgtattattctgctgaggactggggatactttcagaaaagatgtggcatgagaggtggacttggaagcatgtgacaaatttgacttctggaagagggactaggggaggccttttttaaatctatatttattctgaaaataaaagatagtaattccgtagatatataaaaattgtaggatttatgggttaagatggtctcctttaaaaaatgaattattgaggggtggatcaagatggaagaacagaagtttccactgactgtctccttcacagggacaccaaattcaacaagcacgtgtgcacatgcacacacacacacacaaatacctccataagaaccagaatcaggtgaatactcacagtatctgatttaaacttcatatcgctgaaagaggcactgaagactgtgggaaagacagtcctcaattgttgacactataccttcccaattccccctgtagtagctgcaaagcatggagaaatttgtacactggagagaaggagactgcagtgattgtgagactttgtattgaactcagtgctgtcctgtcatagcagaaagcaaaaccaggctgaattcagctgacactcacacagagggagcatttagaccagccctaggcagaggggaatcacccatgccagtgttcagaacttgagttctgccaaaccttgccaccatggactaaagtgctctggagtcttaaataaacttgaaagtcagtccaggccacaagtactgcaagttttagtgctgagctgggcctggagccagtggacttgtgggagacacaacttactgagataccaacttgggcagctaagggaatgcttgcagcacccctccctcaaccccaggcagtgcaacttacatctccaaaagagacttcttcctttcgcttaaggagaagagagggaaaagtaaagaggactttgtcttgcatcttggataccagctcagccacagtaggatagggcaccagtcagagtcatgaggcccccatttcaggcactagttcccagacatttctagacacaccatgggccacaaggggaacctactgtattgaagggaaggatccagtcctagctggacccatcacctaaagagcccttgggccctgaataaccaccagcgatacccagctactattctgtgggccttaagcaagactctaagatgcactggcttcaagtgagactcagcaatctcagttgtggaggctacagtgagcgacttcatctggttgagaaaagcagaggggaaagtaaaagggcctttgtcttacaccttaggtaccagctcagccccagtaaggtagagcaataagtaggccattgaggttcctgattctaggccttgctcttgtgtagcatttctggacctgccctgggccagagggcagcccattgccccaaaggataagccccaggcctggcagcattcacgcaagtggactgaagagcccttgggccttaagtgaacatcagcggtagcctgtttgatgtccctgtgggcctatggtggtggtggccacagggtgagcctcctctgcctgtggaaaggggagggaagagtaggaaggtgtatcatggtttcagggccagctcaaccacactagaatagaaaaccacgtagacttccaagtttttttattccagtccttagctatcagatggcatctctgggccttggggtaactcactgcagtgaagcaaaggatacaagcctggctaactttgccacctgctgcttttagagcccaagggccttaagaaaacaaaggcagtagctaggcagtggttacagcaggtcttgagcaagacccagtgttgtactggctttaggtctgacccagcactgtcctagtgttggtggccacagggttgtttgtgtccctctatcccaagccccaggtggctcagcacagagagagagactcccattgtttgggagaaagtaagggaagagaaaaagtctctgcctggtaatccagataattcttctgggtcttatccaagaccaccaaggtggtacctctatgggtgtgtaaaaaccacagcattactgggcttgggtgcccccagtgcagagctaatgcaggtggcattagatctagggcttagatcacaacaccgaggccctttcaaatacctggaaagccttcccaagaaggacaagtacaaacaagcccaaactatgaagactgcaataaattctgaactcttcatgcacagacacaagtgaacatcaactagcatcaagatcatccaggaaaatgtgacttcaccaaatgaacgaaataaagcaccagcgactaatcctggagaaacagagatatgtgacctttcagacagagaactgaaaattgctgttttgaggaaattaagaaatctgagataacacagaaaaggaattcagaattctgtcaggtacatttaacaaagaaattgaaataattaaaaacctcaagcagaaattctaaaattgaaaaatgtaattgacatactgaagaatgcatcagtctctttaatagcagaattgatcaagccgaagaaagaattagtgagcttgaagacaagctacttgaaaatacacagtcagaggaataaaattaaatacctagcaatgaacttgaccaaataagtgaaagatctctacaatgaaaggtatataacattgattcaagaaattgaagaagacacaaaaaatggaaatatatttcatgttttgaagaagacaccaaaaatggaaatatatttcatgttgatggattggaagaatcaatattgttaaaacatccatactacccaaagcaaactacagattcaatgcaattcctatcaaaataccaatgacattcttcacagaaatataaaacataaccttaaaatgtatacagaatcacaaaagacccagaatagctaaaactatagagcaaaaagaacaaaactcaaggaattacaatacctgacttcaaattatactacagagctatagtaaccaaaataacgtggtactggcataaagaccaacacattgaccagtggaacagaacagagaacccagaatatagccatacatctatagttaactcaattttgacaaaggtgccaagaacatacatttgggaaaggacagtctcttcaataaatgatgctgggaaaactggatatgcatatgctgggaaaactggatatgcagaagaaagaaactagaccactatgtcatcatatagaaaaatcaaattaaaatgggttaaagacttaaatctaagacctcaaactatgaaaccactaaaagaaaacattagagaaactcttcaggacattggagtgggcagatttcttgagtaacatcccacaagcacaggcaatgaaagtgaaaatggacaaatgggatcacatcaagttaaaaatcttctgcacagcaaaggaaacaattagcaaagtgaagagacaacccacagaatgggagaaaatatttgcaaactacccatctaacaagagattaataaccagaatatgtaaggagctcaaacaactcaataggaaaaaaaaaaatctaataatctgattttaaaatggacaaaaggtctgagtagatatttctcacaagaagagaaatggcaaacaggtatatgaaaaaatgcttaatatctttgatcatcagagaaatgcaaatcaaaagtacaatacaatagcatctcacctcagttaaaatggcttttatcccaagagacaggtaataataaatactggagaaaatctggagcaaagggaacccttgtacattgttggtgggaatgtaaattagtacaaccaatatggggaatagtttgtaggttcctcagaaaactaaaaatagagctaccatacaacccagcaatcctactcttaagtatatgtccaaaagaagggaagtaagtatatggaagagatacctgcactcccatgtttattgtagtacccttcacaatagccaagatttggaagaaacctaagtgtccatcnnnnnnnnnnnnnnnnnnnnnnnnnnnnnnnnnnnnnnnnnnnnnnnnnnnnnnnnnnnnnnnnnnnnnnnnnnnnnnnncctcccacccttcccttccctcccttcccttccccctcccccctcccccttccctcctccccccctccctcaccctccccttcccttcctttttctttccttctgtctctgtctctctctctttctctatctttctctctttctctctccctttctctctttcctttttcttgctgcttttatgctaagggctggcattctgattgctcttttttcaggtttaatccttattttaataaagttttcaagcaaaaaaaaaaaacaaagtaaggcaaatttcccacgttctcacttgtggaaactaaaatgtaaaaaattgaattcatggagatagacagcagaagggtggttactagacactgggaatggtagtagggtggtcatggcgaagtggggatggttaatgggtacaaaaaagagaaagaatgaataagacctagtatttgctggcacaacaggatgactatagtaaaaaataatttaattgtacatttaaaaataactaagagtataattatatataatatatactgtgtacccacaattaaaaataaaaaattaataaaaaagaaaccaccacacaaaaaatactaaaaaaatgaattcttaatattttcacttgatatgctaaattgggtcacaggatttacttttgtgacatcaattaacattacttagcactccttatgtgtttattcaaaatatagcagacatttgccattctctggggatatatttaaagttctggtaaatcagaaatccttgaaaaataatagactcaatattattttctaaagagtgagtggatgaactctaggtagaataataacattgagtattaatatggtggtgggaggtacagaaagtttgcaaaaaacattgagttacccattttgattggaacatggagtcaattacagtggtagaggtggatgaacctgggaaactggagccctagtgttgaagatcttacaggactgtcagaaagaaattttgaattgcccacatctaacaatgatttagaatgaaattttgacttgatattttaatgtatttctcttccctaacatgcttcagtattcaatatcctttatgataaacaacctgggaggtagaaacagtattttccacacgatggacattcctgtgcaggaattggaatgcacattgaaagacctactgagagttttatcaggaggagagctttctgtgatagacagtcatttggaatccattttccttcatttgggagtagttcccaggccaaatcactgttctatttatatccatgacctccttttcaacactgtaccagctgagcactgtgtagagtcatccttaaaagcagccgtatttgggtcaaaaatgtcaaccaaaatgagtgtaattagacaaaaatttttttttaaagaaagaatgaagaggctgttttgtttttgttttgtttttgtttttgtttgtagccttgtcagtaaatccttaaacctgtttccatttgaattgctaaatcattatgtacaatgagcttgggtgtgtttaattgagctcaacaaactttctttggatcattgaatgcctactgtgccagattctcagcatgtgtggtgtgtacgtgtgtgcatgtgcacatttggactggttgttgtagtctgcactttcaacaaacaaggaaatatctggaaaagtttattaccctatggatggagtggagaacagagaaggagtacatgggaatagctggggtcaggttagaagtgcttttctcctttctgaaagccactgctctttaaaaaaaaaaaaaaggtggatatcggggtgaatattgtactatttttaactcacttcatatacagaagtcttcagactttgggaatcatttaaaacaactgaagcttgtgaatgcagatagctggcccttatatccatattttgattcagtaaatccaagtggagcctgggaatctaatttttaacaaataccttctgggtgattcttatgcaggttgtcctgaattttgcaattgaaaacttgcttaagggccacttctgacccctaagtgtagaaattgaatgcaatttaaagcatttaatagaactcttatgggcatcctgatactgtactcaggtccagggatataaagttaagtaaatatctagtaggcggagaggagtataaacacacacacacacattaacatgatacatactgtgagagtgatagaaatttgtccatcaggtatggttgtaagaaagttacagatacccccttgccaaacaaaaagaaagaaaattacagatccagaaatcaggaaagaaaagttgaaaatcctgagggctgagtgctgagatagactttgcctagtttgcagctttgtttgggatgtgccctgaaaaagtcgtatactcagtgaagtggaaacggtttttctctttgcatcttctcctttaaaagtaatatgtgcatccatgaggctttcaggggcctttagaaagagtaaataagcctagtttcaatccatcgtctccgttagggtctctgagaatcagactgtgaatttaaagctgtactggagaaaaaagctacccacatctaaaaatgatggtgggcattaagagatgagatgaccttttattttcctgagcctatgcaaggagtgggtacctatgtacacagattcttctctctgaagtgcctgtgtaggttaatgacaatgccagctgaggactttcagttcttcatatgacagattaatgcccatagaaagttagaggtattatgaggttactttaatgactctttatcacaccttagttctgtagatattacccatgacttcacatggaggacaagtacggagctccagcctctgcaacattaatctcattaatatacaaaaattattgctagaatattaatctttcgcatcataaaataagatcctataatgcagatcttcatattgaatgactacaaggttacttacagaaactaaaaaaaatcttaataactttcctttttggtaatcacatttatggggaaggataaaattaaaatgtggaggtagaatcacaatataatgtctgattaaaatgcttatgcttatgcccagatgccaaagaggtagaggctgcttctttgttccctatgggaggtggagcccctttttcctcagttttgtttatctcttgttctggtcccagcaactgggaccaggggcactccctcctctagagctagggagaccgaggtatggcaattttcaggctaccccaccctgccagtcatcacctgtgatgacttagttttctactggcaccactagtcttggtgagcatcctgctttcaggaaggagtgccctcttaacccccataaatactgggagaataacctacagggttgtggctggcaccgggactcaggcaatagctggtatgttgagttggctaaaaaagtgacaactgaggagtgtgccattttctcaataacagcaggaaaggggaggaaagcagcggaggtggtgggtgaaaagaaggtggagagatgctggtggaggaagaaatgtaggttgaagaagagttgatgaagtgatatccatgtagagaagagaggaaatgatgaaggaaaataaagtgacagagatgaaggaggaggcaaagccctggcctctgaatgccacggactttctgaaggctggagctggagacagtacctgcacaggctaacaggggcttcctccagctggagcccaagtttgggtggatatggtgacactgagatgagaccacagattcatcaaacaaaaaatatcccttctgggatgccaccttttgaaaccacccccacccaaggtcatgcgtaggggccaaggtgcagatttgctgagggccatctcaattaagaggtaaagagttcagacatctaacgacatgctacatgttcaaaatctttttttgaacaaacctctacttcagaaacaaggtaatcattaaacaatatggggttagatcctctggacaagtgggatttcctttcattccagtcacatggcaaggatcccatgccccagtcctgtaggagcaggatatcacctataggttcttcatctggtcctcagactgtagccttccagaacctgataagattgctgttatttttaaagggatctctagcccaactcctgaaataccaactgtcatgtggagggaaagccaggttaccttcagcagggcagcccatggagatactcaggctgttctggtatcagtgtagccaactcctacttttggaagttgcccctgctccagatcatctgccatctattgttggacctgtgcttggccaacagtgatgtctatgtgctgacctccttgcatcttggcttctccggacttttagtgctcccagcttcaagaatgtggcttttatgaacatgcccatcactttgtctaagccaggaaaatggtgaaaactgcattctttcatctacatggcttgaacccttgtctgtgtcagggccttcctgtctctctttgatgtaggtctttatgagttatcttcaaagagggtcagtgtatctttaagaaccgcaacctcaggaacaacgaaaggctgggttcaaggctggtggcaagctggttatcttcgagtatgtcccatgggcgttccatggacctaatacctttgcttgaccacaatcacgtagattttcatctttggttaagagttcacttcagccaccctactgagtatctggcaacacagggacataaacagtggcaagttgctgtgtatgtctgaagtgaaggataaaaagtagagggcctcttaatgtacccaagaccatagtttttcctgctcttctgttactagtaagtatccatgaaagtctgggctatggttttgtgtgtgtgtgtgtttgtgtttcctggccaaccttttggatattcttgtgcagaccgccattgacctcattgttcagtttctagtcaccaaagacttccacaactgcttatggactcagactcttggccaaccattggagaagccctctactatgccccatcctccctgtcacccaggaaccacaacaaatgtcagctgattgggctggcaggtgtggcccagttctctcagcaagggaaatatggcatcctttctaagaaccaagcattcttggtgacagccaataagcccatgaagaatatgggacatttaccagtcccctttcacccacctgagcatgatgaggtgtccaggtgctctgtgagatactaagagagaaaagaaagcatttctcatctttaaagtttatctatatctgtctgcctacatcttattccaatatctcttctctctctgtctctttttaaggcaccagagcaccctagaacacaaaacggctggaaagcagactttctaatttgctgcttctcttgattgtgtcctgggaagattgttcagtaatgtagactctgaacctctgctcttatgccccatagaaaattcaaagaggcacagacctaggactgtcagattgaaggactgaggtggtcaccagtcccatggaacagggatggttaattgcctaattgtgtacattgttctttttggctaatcttatcctcaatactgaccccctcaccccgacttctttcttccatctgtgcccaaatatccaagaagttcccagatatttcttaagtattagcctagagggcaaggagaaaaatgttatgggaatgaaatttaattaggagctaaaagaaattcttttaaatgatctaaaactaaaataaacaaacaaggtaaatgggatgggcgtggtggcttatgcctgtaatcccagcactttgggaggctgaggtgcacaaatctcttgagcccaggagttcgagactagcctgggcaacatggtgaaaccctgtctctacaaaaattaaaaaaaaaaaaaaggcaggcatggtgacatgcgcctgtagtcccagctacaagggaggctgaggtgggaggattgcttgaacccgggatggaggggttgcagagagcccacatcatgccaccgtactccagtctaagtaggcagagtgagaccctgtcttaaaaaaacaaaaaaacaaggtgaatgcatagctctaatatatttatttacaccacctttatttctggaataatgtaaagattttgattctgaagttttgagaaaagataaactgagataggcaaattcttcaaagttttataaaagcagctatagtaatatgtaagggagcagttgtatgtatttttagtacttaagcctcctcttctatgttcagaaaataatgtaagttttttcagacatttgcataagcattatcttttccccatctccatgcttagtttagccatctttattcttacccagtgccattcacgaacaggtgggagatggtgaaaataaatgaaatgcactattttaaactgtgtctgttgtatttaaactatataaaaacactgaggcaattataaaggaattcagaacaaagtcaacttttagacagtttttcttttttttttttttttttttttgtagtctgtttaccatgtccacttgtttcattttggtttagctcaaggaaataaactcaggagcaatggaattgatacatgacactttcacttttcctgctcctcatgaagcaaaacccactaattactttgaaggaatccactaacacttccacatatatttaattttgctaaacttgtatagagctgccttagaggaagagagaagagagaaaaatggagcattcctggaaagctgcattaagactgttgtgtttctgccaatattcttaaggtgccgaatatatctggaaagaaaaaaaatcacaaagatatattacatacactttacttaatgtatatgccaattacttaaactttccagacattttgatattagagaatgtgtgattatttattcattcatgcagtacacaaggtagtttggcatttcccattctctatacattaagcatagccatgtaacttgctctggtcaatgaatcatgaaaagaagatatatatgtcacatctgggaggaagctttaagagctcctgtacaattgggtcagaacctcttttcctttgctgtggcgactagttcccgacgtggaggttctgttagcattgttcctggagtgaagagatgtggcacagtttctcccctccaccccaatcccttaatccaaatggatatgtagaatgaatgagaaatacactgttgctaatttagtgcattaagatttggaggttaaattgttactgtatcataatctaacccagcctatgaaaacattttttaggtttctgtatgttggatatttatgaataattgtgagaatttcatttcctaatatgtgtcactgtttttttgatgtctgtgtcttccctacctctttggtcctattgtttctaatatttggaaactaaatatatatatttagtttacacacctatggagagaaagagagaaaggtctcgttctcgctttgtcacccagtctggagtgcagtggtgaaatcatagcccactgcagccttgatctcctgggctctagcaattccaagtagctgggactataggtaaggtccaccttacctggataatttttatttttgtaaagattgaggtctcactgttgcccaggctggtcttgaactcctggactcaagcagtcctcctgccttggtctcccaaaatgttgggattccaggtgtcagccaccacgcctagtcttaaagttttatacaatcatgtacggattgtaatatgaatttgtcatatttacattgtgcccacatttattttctacttcattcatttatgtatcagttggtaacatattggtctaacttttctatgcaattagagtacatactcctaaggagaaaatgcaacatataactaactaatctccatgtattcttgtgcaaattctagtcatacatatttaatggaattcaatgcattttttttttctgaaaagataattgagatgctgatgaggatgatgatggtgatagacatttcaggaagtgattgtgctctaggaacttggatgttcagagctactgcaaagcattttgatttgtgcaggcaatttactgactatatgttctgatatctgactaccagaaataagttttgaagtacacagctaatagcatcatagatagattttcaaagtgtatacaaatatgaacgggtgggataatgtgaagattagcaaagaacattgtcttattaggggtaaaatggtaaataggcacattttagatgtttattctttgatgggtgtcttcctcagtgagaattatttccaggaagtatattttagtctttggaataaaacttttgccaactcatattgcattgtctttctattcttatagtataattttattttcatttttctggcatcagaaaacaggtcttaaagtgaaatttttgaatataatgatagatctgggggtatttgaatcagttttaatgcatatttcctgatgatcaagtgataagttttgcactgttggtctcatgagcttcttaagtgttctcataatattccctaaattagtgctcatataatttcatgcagtatatctttttaatattgtagtgttggaatgcttttacatggaaatttaatttttgatattaaaaataacagaatattttataataattcttggtatatttatgctggaagcatctccatcactgacgcatatttttcctatacagatctacatagcacacagatctagatggcgctcataaaatgaatggtgaaaataagcaaacagtgaaaattacttattgtgattatggttagcatggttgattgacttattcatttagcaaatattcaataaatatgagatatttaataaatagctatattatagacattatgctaagctctgtgaatacagagatgaaaaaaacatagtcccatttcttttttttttgagatgatggagtctcgctgtgttgcccaggctggagtgcagtggcgtgatctccgctcactgcaagctccgcctcccaggttcacaccattctcctacctcagtctcccgagtagctgggactacaggtgcccgccatcatgcccggctaattctttttgtacttttagtagagatggggtttcaccgtgttagccaggatggtcttgatctcctgaacatagtcccatttcttaaaagctcacatcgtagccagggatatgtattgactttatatagatacatattgattatagcttgtgctgaacgttaaagcagaaagatgtggaagtgctgtggaaacagaataaagaaaggattagttctttgagaaattatttgataaaaactaaaggaaggaacatggagcacatcacagaaaaagtgacactggaattgtgcatttagtacaatttttcatcacttcagcctaattaataatattaaaactattgaggattttattaggttggtgcaaaagtaattgcagtttttgccattaataccaccatctctattgtggataattagagagcttttctctaaagtaatagaacttttattccatgttctatgctttggaaatttgggagttttaacctggggtaaatatttaaaatatttattaacagcaatggacattcagaatggatgtgacaatagaattagaagagggtctggaaagacccctacggtagctgttaactctcaattatatggttatggatgggcctctgcacctcaatttttcatctttcaaatgtcactaatacttgtttcttcctttttttaaaaattatactttaggttctggggtacatgtgcagaacatgcaggttttgttacataggtatacacgtaccatggtggtttgctgcacccatcaacctgtcatctacattagataattctcctaatgctatcccacccctagccccccaccccccgacaggccccagcatgtgatgtccctgtccctgtgtccacatgttctcattgttcaactcctacttatgagtgagaacatgcagtgtttggttttccgttcctgtgttagtttgctgagaacaatggcttccagcttcaaccatgtccctgcaaaagacatgaactcatcctttttcatggctgcatagtattccatggtgtatatgtgccacttttttttttttttttttttgagaccaagtctcactctgtcaccaggctggagcgcagtggtgcaatctcggctcactgcaacctccgcctactgggttcaagcgattctcctgcctcagcctccctactagctgggaccacaggcacgcaccaccgtgcccagttaatttttgtattttcagtagagatggggttttaccatgttggaggatggtctcgatatgctgacctcgtgatccgctgcctcaacctcccaaagtgctggggctacaggagtgagccactgcacctggcccaatacttgtttctttcatgtaggatatttgtgaagataaaatgagacaatgtacataaagtggttgacgcaatggtatggggtatgaatatttaagaaacattaggcgttacaatttttaagagtaagaaagaacagacctgacgaaaaattacagatatatctaaaagtgtggaacaattttcttcaggtggaaaaactgggaaaaaaatgctttccaaaggaatacttgaaagttggaaggagatgaagggatggctctggaaaaggcgattatttggaaattatctaggcaaaatactgacagtcctgttttcgtgggggataattattttatattatagttgttcctaatttcaatgatcatctctagtgataatgttattgaacaaccctggagtgagatgtcagtatttgactgtggctgtttgcaaactctgctgtgattataaacagtagtctaattgcttaatttattgatgttttgccgacatgtttttcagcaacatttgtgattgcagataactaatcatttctctttgggctcattatcatacgtttgcatttgatttgtctgattgctgcaggtggaaacaataggtgatgcctactgtgttgcagcagggctccacagaaaaagcctctgccatgctaaacccattgctctgatggccttgaagatgatggaactttcagaagaggtgctgacacctgatggaagaccgattcaggtaaccctcccaacaatctagtttgagtagtaagtgcaccattaactggaggaggcaaataattcccttccaagttctactttttgtaatttatagatctagacaagttgggtgcttaaggaggacaaggagtgactagagataactcataaatccaggaaaagaacaaatggaataggtccaagataggaaatggtttgtggaaggcaaattactgtggaggaaagaaagagctaaaagattagacccaagggaagaacttactgtcagtgaccaggtcacgaaatccaagcaagaatgatgatgatgagattcggagttttagaggtaatccaagaagtaaaacacaaaaaaagcaagaaaatggaggacctgcgcaacttcctgtagatagtatacaggtattccttgtgaaacatcagacctcagagttacttctggagtttttcttgtggcagagtttgaagattgcagcctgtgaaaactttaaaaacagtggaaagtccagatcctggtgtgttgtactcttgggtctgatggtcttctgcaatctgaggtctacctctgggaatgaagaatgaatgaggtcatctaccatatttctgcttgagcccagtgatggatcccagaagtgtcattactttgaaatcagaaatcttatatttggggaagtaaacttgtattcaagtccacccttttataacagcttaccagctaagagttaagaaaacacgggggcgggggggcgggcacaggaaatggctaaaaatatgagtaccgttctagttctggcattatagcagattggggacactgaacaatccatctgattaaaattatgaaaatattgggttaaatatattaaaaaatatttttaaaaaactattaggcacttctctgagctcacaggaacaggaaaaacatgacaattacactacgtgtgtagattgaaaaaaaaaaacgtaattggtgaatttaacttaagagccctgttattagcaatgatagaaggaaactgggaaatactattcccccctggaggatgccaacttcaatcctatcctcaaattatttccacagattccatgtgttgtaaaaataaggtcctagtttgtggttgtatttttatcttttagttgttcttgataaaccagaaggtttaattttaatgttttaaatgatacatattttcttttataatttgtaaatttttgacctgaccagttcacaaaaaattcttcctgacttaagtcagaatttcctaatgataaatttgcagtttcatagtatgggtttttacatttaacccacctggaagataaaggttattaaaacgagtaataaaaaagaaaaaagccacacacacatgaaaacaaagtactatggggaagaaccgggggaaattatagatgtgaaaaaacatacctgggatgttttcagatatcaaacttatcagacacagaattaaaatgacaatttttaacgtaactataagaaataaaaagagctgaaaactgtgagaaagggacaagacttgggaaagaatcagagaacttctaagcaatcaacacgatgcttaagaaaagaagagagaacaaagtggacaagtttaaaagcagattagacatagatgaagcaagagcttgttcactaaaagaactgaagaaattatcaataactaagttcagatatttaaaaatggggaatatgaataagagaatgtaaaatataaaatatgtgggagacagggcggagagagtggaaagatgtaatatatattcaattgaggttccaaatgaaggtaacagagtgaatacaaaaaagagaattattttcaggaactattaaaagatgtcaatcagtacccagacacagtaatcagcacccagacacagtaattccaaagaattctgcaaaagttaaaccataggaatccaaaactaaacccatcttaacgagactgcagggcatcagagaaaaagagcaattgataaattataaaagtgacagcctgggcacggtggcttacgtctgtaatcccagcacttagggaggctgagagggtggatcacaaggtcaggagttcaagaccagtttggccaagatggtgaaaccctgtctgtactaaaaatacaaaaaattagccgggtgtggtggcgggcgtctgtaatcccagctactcaggaggctgaggcagagaatggcgtgaacccgggaggcagaggttgccgtgaaccgagatgcgccactgcactccagcctgggcgacagagcgagactccatctcaaaaaaaaaaaattataaaagtgacattgattggtgtgaaaaggacaaggcattcaataaatgcttgggggactattggctattcatgaagaaaactaattgaaattggtattgtactttatgaatctttatataaatcaatttttggtgtgggaggtaaatgtaaaaattcatattataaaactataaatttgtcattagaaaattttgacaagtagggaaggattttttgtgaacttatcaggtcaaaaatttgcaaatcataaaataaaagtttagaacattaaaattaaaaccttcctgttaagaagaactaaaaaattaaaatacaactacaaattaggagaatatttttgtgacacatgtaatcaataagtatctagttaaccttgtcagtaatcaaattaatagaaatttacaacactatcataagcatttctccctactagtttgacacaactttgaaagtctgacagtgccactgttggtgaggatctgtagcagcaggaaatctcacccatagctagtggaagtataaatggtacaatttacttggcatcacctggtaaagtttaacttttgcatgtcctacaacccagcatttcctctcctagacgtttacacatgtacaagggaagtacttgtgcacgtgtagcaaaagtcacacacaagaatagtttttgtaacagtctcaaactctagctaattcaaatatccatcaacagtaggatagataaactgtgttatatttataccttggtataccatatagttgggaatatgaaagacctcagctactgacatcaacatggatgaatgtcaaaaacataatcttgaacaaaagaatcaagtcattaaagaatgctgtagtattattccacttaactaaagtttaaaactggaaaaatggaaacaattctatttagaaatacttgcattgatggcaaaaagtgtaaaaaataaaaggaatgattaacacaaaattcaagctggtgcttatctctgagggaaagatatgggaagtaagaggatacaatagggaagataaacatagtataaaattttttattttattactcttctttaatatgcacatatatgtttatatttaaccatttataagtggaaagagagttttctaaccactcctaccagtgatgaaaatgggaaaatatggagcattaaaaataaaatctagtttaagttccctcagggaataattattgaatggtacttctaccatgccaggaaaacaaacaaaaggaatactgtctcacatttgctgcacactgcaaatatagacattccagattgaactaatcagttcttaaattttcaagcctaccagctgggcaggcttctcatttgggattgtttttgatgttggattttcttttatggagagtatgtttgtattgaatttagcattgtcatagcacagttaaattacccgagaacaaaaccagggaattgtgttttacagtgtgttcatcaatattttcatttgtgggatttaatattagctctttcttatgaatcagatagtcttattaaatcagaagaggaaatatccataaagatttaataagaatgcagaaagagaattcaaaataataaaccaccttagtaattttagcttccttactaatttatagtatttgcatgatttgggattatttttcatcatattaatttgattttaaattgccttctagcttggtgctgtgggaacatttccaaacttattgagagaatcttttattatgaaactgctggggtgttgtagtagagttgatatgtgatagcttactgtttacctcaaattatgtaagtttttaggtgatttaaattacaagttattataatagcaataattgactaaaactgaatccaaactttgaaaagtaaattgataatttgtatatggatttatgaacctttgaggcatcctgtaatgatgggaaataggagccaaaattgtcatatacaattgcttggaaatgattggtaatgcccttgactcactaattgtaaaactgcctgcatttatttttttttaattttgaaaataaccagagaatgtagcattttgttttttcagcctataaatactcaagtaaattattgttcaataagtactctaatgaaactcagaggctacttctggactatatctataaagcattcataaatatggtctatctatacaatacattctgaaaaatcagttcatgttgactttaattagaactgcttttataaaaagtgagtagaactttttcaccctggatcaatatgatatttcttctgctggctgaaaatatggaagaacagcattatgactgtttcctttttattcttcccaagggagaatctgattttctttttttttttcctcaagacacagggtcttgctctgttgtccaggctggagtgcagtgtcaccatcacagcttactacagcctcaacctcctgtgctcaggggatcctcccaactcagtctctggagtagctgggaccacaaacatgtggaaccacacctgactatttaaaaaaaactttttagtagagatgggggtctctctatgttgcccaagctggtcgtgaactcctggcctcaagcaatcctcctgcctcagcctcccaaaatgttgggattacaggcatgagccaccatgccaggactgaatttttaaattttaaacagtagacaattgaaaagtaaaattatatttgtattctctcttccttgtttgcactagctatattgtgaattcaccagagaaatgtattactttagttctctaatcttgtgaacccaaaggtattttgaatagtttttagtgctgactggctaacttacactaatagtttaaccacactttgattaaaataaccaaatatttattactgcctatgacttattctttctttaaaaaacactgttgatagggaaagggaagttgggtcaaggattaactagagaatgtacctagggtatatgagaaagacaaatagcattttcacgatttaaggcttttgaagaatattgagtatgtccaaatgtcttttaattctgtacttagtttaaaaactattttcattaaattttatctcataggcatacaaattcaaattttcttcattagttcaaagacagtgcattttatataatgaggcaagtatgcaggaaacattgtgaactagagttaaacaatgtgtaatcatgttgtaatactaatgtgtttagcaatctcaattgcaaatcagggaaatgctgtgagaaaaagactcacagcatttccgctgattcggaatgtgagattggctaatataggttagtattactgcctggtgcaaaagcaggaatattaatgtgcaatttacatgtattgtaacacattaaattacagctccttaagcttcaacttttaatgagcttacaggattttttgagattatgcaataattgttctctaattaatttttaatttttagcttcaacttttaatgagcttacaggattttttgagattatgcaataattattctctaataatttttaatttttaaatagtttttgctatttccagaggaaacctgatgttgttattttaatatttggagggatttgggttttggaaatattgcaatatttaattaaccctatcagatttcagcctgagactgtatttagaaaaaagaaaaactaattacagttggcactccatatccatgagttctgcatcctccgattcagccaactgtgggtcaaaaatgtaggtaggccaatgatagttgcttcagtattgaacatgtatagacatttttttcttgtcattctctaaataatacagcctaacaactatttactcattatttacaacacgttacatattataagtaatctacaggggatttaaagatttaaagaatgtggtaggatgtccataggttgtatgcatgtacaacactacttaatataagggctgcaagtctcttatattacttataatacctaacaaaaagtaaatgctatataaatcattgtaatactatatcattttgtttgtagtttttaattgttgaattgttatttttgtttgttatattttttttattttttaatgccatattttcaatccacggttggttgaacatgcagatgtgaaacctgtggatacacagggtcgactgtatttggtaacctaattaattttctaagattctttgataattatttatttataaaactcaagttagtactttttaatcacattgagattaaaaacatataaggagaaaaacctaaggggtcagaaaaaactacataggcattatataaaattactgttaagatactgatcccagttatcctcatttctcacatttatcaattaggagtatttaaatttgcttttaatctcctagataatgcatatagtggcagttttcataagtcagtgttctattgtaacagtaatatggaaaaataccgtataatgttactggtgaaacttaggactagatagatatattttccgatagatttatcattttgaatagtaaatttatttgtaactataaatgtgtttgtttttaaaaagtatttatttaaagtattaatatttgtgagtgtaccagcaaagttatgagtctcttctgtagtttgcttccttttaataatcaatgcctcattctacatactctccttagatctattttccaacttgccaatacttccctcagttggttgtaaaaattattgattaaactcatccacttgatgcttaaatgctgattataccagtttatagtgttttgcagttccatttgtctgacaaaatttttcataccgtttttatttattttcttgaataaatcatctgtaatgattgtaaatgcttctcctggtaagtcagtctccagaactcctgcagtctattacatcatttgttctttcacttaattttcagtcatgttacttgtttcctgtgtgactaattacacttttttttgtttgaatgctggagattgtatataaaatattatagaaataatttaagacttaggatgattttgcagggaaattttagtgtgcttcttgaaagagactaggggctctagcagttagcgatcaggggatttaaagctgggttttggtctctgtgaggacctgtctacttctggttcacctctatgttttggtattacccttatacctgtggtcatgttcccatctcaaagtggggagggctttctaaggtctttgccctaggaattcttaggctccagtttatgttctcttggccctggctgtcaaaaatgctgctcagcttctcaacctttccattaccttttctggagccagaagatgcccacaggataaaagcaccaccaagtttacttttcacttctcaggtttatcttctgccatatcttggtacaataatttttcgttactttgttagctgaccagcatagggtaattcaaatgatataacctgctattttatatgtatatatgctaagtttcacaataattctgtgaaggaattattgctattatttccagtttgtaaatgaagaaaataagcataaaaaatagttaaccagagcttctaatatatatactgtgtatacattaaataaaagcatgttaaataacatttatattgtcaaatcttcctattgccttgaatattccattaaagttagacttttcatggctttagtcttcaataaatttaaatgtatgttagatgtcctctttgaaaaagtagaagtaagttctctattttaaaggtattccatccaaaaataaaataatttgtttttaaattagaaagtaagagacattctagctgcatgtggtggtaggggggcatacctgtagtcccagatactcgagaagctgaggagggaggatggctttaatccaggagttagacaccagcctgtgctggacagcataacaataccttatctagaaagagagagagagattgacattgattaaattcagttatgtgaaaaaaatgagtgttattctatcaatcattttgtaaactgcaatcactggccagattgggtgggggatgtattagtcatgatgctctgctttttttctatattttccccttgtttattgtttgttgtggattgtaatgcagaagctacatatttaaacgttttatatttacattatttcatagggtagtcattgaatttaaagattaggtcatattctatttaattatttttatttattgagcacatttgttttaagcatagaattactcttctggcatgatgctatagtgctgaactttaatacacaaatttatttatagacagatctacttactgagcacattatttgttttaattatagaattactcttctgacatgatgctatagtgctgaacttcaatagacagagcatccttaataccttacaattcctctgtaagatatcagcataatgatttaaaacacaatattgtgtctgtgatgtgtatgtcaatgagacagaattccactgctagtttattttagcttttatctgtaatcatgaaagattccaattttatataatcacagaattttaatcatattttcagactataaaatagtctatcaggcatacatttctaaaaatgctagtcttactgaaaagttttattatgatatttgtcaaacagatttcccaagcagtccttttgtgaagatatttgcatatttatgctacaagaaagaatagttaataagttagtgaaagaaaaaacaaaaccaagtgatgggaaaaaaagctaaactgattcacatgaaactgtgcatgcaaagcacaaaattgcttagtttgattttgtgcaacagtcttgactttcacatttttggaagaaaaatacattctttagtggagacatggtttgagtattttgttagttaaatattatcatcactatgaggataactacctttaaataagttataatctatttcatgtattttattcctgcctcttgtctccagtgtcccactaagactactgatacaatgtccatagaagaggctaaaagttatattagcaaagtcactcatttttatttgatttttgtgtggtgtgctttagaagtgtgagacttccaagcagttaggaagctcgtgtttttatttatctgacgtttatgtaaagaataggaatctccatctgccaatattttttccctggtagagacagtaaatgtgatttcatcaacccatttagtaggttagcccattatctttagcatatggtccctttcttaggtgtttttgaatgggtttttaatcttttactgacacttcagtctcttttaagcctatatgcatataggccaacatgagtagcctaactcttacaatatgaaaaatgatatgaaaatagcaagatacaacacataagacagtaatgtgctatctgcatgctaatcacactattgatttagttagttagttagcttttacgtttttgacctgttgttttgagatctcatatctcgtttcaaataaaagtttaaaaattatttaatctctttatttgttttctaaaattacaaaaaaaagatctctgaaaactagtattacagaagatagttaaaatcacctataatttaccaaccaattatagacatattttacatttttatgtatctttaaagtctttttatatgcaaacattcaatacaaacacatagaaatagaaggtatggacttaaaaagtagattattttaaaaactgaataagcttcattcaacttggtaatatcatgacacacagtgtaccaaagatgcagagaaatatgcagaaaaaacttggttagccctaggaagaatctttcattattattaactcactttggttttgtatttttctgttcctacaattgaatttttgagacactggaaggtaactctttaatcacctgagttgcaaatgtggtactaacaattcagtgtcacaagtgcttttcaaagtatgttaagctttttgttgatgtcatgtcaggcatatggtaattgtctgggtcaccactataatattccttatttggaatgtggtttcctagcaactcttgctttttcctaatggctgaattgatttctggacatttgtaatgcttcctactgcatcagaaattgtcaccttgtgtgtaaatgttacaagaccaaatttacatgtagattccattttaagaaattattttgctttatcacttgcctttaatgtgtttgttcagaggttaaaccaatcaatcataaaaaatgaatttagaaaacctcattaattcagactctttagggaaatatggtaattttgacaaattccaaaatatatgcaaatagttcttagtggggaacctcctgaagttgaagaaacagagtaattttgatggtcaaatgaccatgtaatcaggaggttgttagaaacacaggtccggagtatgcatggggtgtcccaggggagaaaaggcttactttggaggcttgctgtttcaactcacatgaagcctgattctacatgaatctggttggagccttgctggcagcgacttttactcatttattcaacaaatgttttttgaatgcttatgattttctaaacaattggttaggtattagaaatgtgagggtaagcaaaccaggtacatccctgatcctcccacgaattacagcctatggaaccaacaactagaaattactaacttggtgaggaaggagaaatagactcagttttctctcaatactctttccaccttaacatcgagaggtttgggttaggcttttaggaatataattctttgtagagcaaatattcaggatgtcatttacattcagacctacattattttggtgtttttgtagatttcatatgttcttagggaagtgaggttgaaaggcattaaaaaccaactatgtggtaggggttagcttgacatttacatattatctcacttaatctacacaacaactaagaagggcatatatgcaatttttatatacttaaaagataaaaaaagacattggggttaaaaatatgtacaagattatagaggaaaaaatgcatactggacactttccagatgtcagacttgtgccatgtctttatgcactatttattcctgccccccaacccccccccaaaaaaatctgcaaagtaagtttcgttaatcttattttacatttaaagaatttgagatttagaaagtttatataatttgatcaaggttatgtagctagccaattgcagaactaaatttgaatccagatatatctgtttggaaaaaagaaaaaagctttgctttttttcagtataggaaactggagaatgcccagagtagaattttattacctgagtacttaataacaagagttacttctcacctagtgcttactacgtgctcagcattatgccaagctagagtgcgtgagcactctctctcttacatgtcctctcccttcctaatatatatgcatatacacatacacctgtataattatttacatgtatgtgtatattttaggcatattttcatatttgtgaaatatgcctgtactgtatatacataattattacaacaatcatggaccatggattagatgttatctctatttataaatgggaaaaccaagactgaaaggttaagggactttttgtcaagagtaaataatattactaagtaagaattgattcggaattggaattcaaatctgtttgacttcaaagtccatgctcgtaaccattaccctatactgccactcacaatacaactggaatgtattaatatgatttctaatcttatgactaagctaataactttaattttccttaaaaaattattgctattccctgttccttaagaaagaagtgtgaagacgtaatagcagtgcaatgtcttgaaggcattctaactcaaggcaaactcacatcgagatgttgaaataatgaggacaattatgtcgacatttaacagaatgagttgaaaattgatagttctatagaatttcaaaatatctgaagaaaaaattaagttgggaataatattgaaatatacacttctgtaatattagctttttataaaaaatagaagaaatgaactttttgtagaaacataataatccaaaaactaggaaagcagaaatttaaaaccgtatcagagaatccaaaaggcatatttgcttttttggacatattatcttccagatggtatcagttgatccttttggatattgttatctaagattattttttatttacgtaacgaaaagcactgattgattgaaaaagaaaaatgtagtcaaatagtttgatcagtcagcctgcaagcctttactgaatttctctcatgtgcaaaaccacataattgagttgcagactgaactgcatgagtgccaaatactaatctgctttttttcttggctctcaagtcaaaattctgtatacacaatacccaaacatctggtcacttaaatccattcagtcaaaaattcaattgaccgcccagattttctgattctaggattccattcaacttgtttgccttaattagttagtttatctgaaagctatgtcaaataggtaatagcatatatttagttatttcaatagtacttggcatcttacatatgaaaaggtacagttatggagggaagaaaacacaggttctgttcctcccacctccatcaagcttttaacagatttaatgttgttttctgccttctatactgtttgccttcctttttgaattggtctcacccatctctcactgccccccactctcgggacccctcagtctccatttctctctcaatttcctaaaagtgacatcaattttccatgaattacctaagaacgacttaccaaaaaaaattacattgttatgaataatgtacgcaaaactgttgatactggctaacttaggggaaagagctttttccatttttaatcttacagttttatatctgttcacattttccaaatatacgtatgaattatttatgtattgccttttagtatccatagaaattatatgggagttgccatcacggaccatttttctttccttctttaaagtttcctatacttaaaataactcataaatataatttctaaagtaagcacaaattctcacttatatatttggttcacaggaataatcagcaggcaatgcctacaactgcacagaataaaaatttttattggctaaaaattagtgggagcatcaaatgtctttgacaaaattacactgtgaaacatttggccagcctaatgagggtttatagaaataatgaccataaaagaaaactatactggcagaaattaatatgagcaaactactgcttaatgagtcccaaatcatcactgtaaagtttcaatgggaaagaattcatgccaattaaaatattttcagagggacacaactggaaatgtaaaatattagaataaatgtaaaatattagaatcaatttatatgtagtatacagaaaatagatcaaggaattaaattgacttaatagcatttagtccagaaaataattttcttcataataattcttcagtattattatatttcattcaatctttgtactcctttgttggggtgcaaatgtcttgaactataactgttttattagcctaaggaattatttgatgaattaacagaagctgtatcatggttctagacattcatgctcaataaactgaattaaatgttaccaactggtaggagaaagtagagaactttatttagttgtggcagtgatagctattatatctttggatgattatagtttttatctctctgatcctttgctgcacaagtaagtattcttttatatttgcaactttttgccatgtcttttacctcacatataaataagtaaatacattgacttccaggtttttaataaacttatagtattctccatttcttttattgtgttttctcatctttctcttactctaaattgcatattcataatcttgtccttttgaaaaatactaaacttatcccatgctcatattttaccccagcactcaaaatacaaattagtaattttgctacccaaagtataatgaagtaaagtagacctgcctcattacaccagtgagaatacctattatgaggttatgattagtgatcacactgtgctctatgcagcgcagcatcctgtgctatattaaaatctcttcactagttgtgttactgtagcacactatatccaaacattgttctgtgttatttttctcttcattttaactgtagtttgtgaaaactcttactttgtggttaagaaggcctgtccagggaagcaagagtcataccatattttaaaaatatacagtttatcagagctctaagcataatgtatcagccacaaacaatcatggcaaagcttcccttttaaacttggtgcttcaagggttgtttatgccttcaaaaatttgctccaaaattactaattcctgttttacactgggaaagttattagtgtgttcaagtagattgatatttagatttaaaaattatctcaggcaaacatatttctatccatctctatggcaatgttttgatggccaatttatgccagattctagagccaaatgtatttgcctgaggtctccagatgttttctgacttgctgctggtgtctgaaaaaacgttgcaactatgactgtaaattcaccctttttgctttactgaactggggctaagacacccatccttcttttcttgtggtttagcttagccagaaatgcaccagagataatttacaaaaggataattatatagtagcttaggaaatttggttgtgaataactaacattttgtaagcttttaaaagttggaaatttgaagatcaactctcatttcatacatgataaaaagatatcaaaaaagtatttgattatacttaagttatctaactagttagcaataggatctgaacatgtgaaattcaccagggaagctaatgaagaagataaggccagaagaaggagaaataatattgtagtttttctttttctggcaattgttcatcatgatagaagaagtataatttggaaagtgtgttttgaggttattatatgaaagaggtggaaaattgcacaaatctgtggcagaaggtccaattatcttgacctcttgagtgtcatttctttattatcagagtattactatttttactgtttcctttttaatcttttaaaactattaattctttcctcagttcctgtcttccttctgtgagagcctctcattattcatatagaatttagccaaagttgacgtggatttttttctccttttaacctttagtattttctatggaaatgatgggccagttatttgttagcttgtaaaaggaggaaaaaacaataaatgtgtacctttatatccccacacctcttctgtattatctctcagaacatattaattttttgaaaataccagatctttaaaaatagtggtacatcttcaggaatatttattttttcatcatttcttctatttgttaccatcctcaagtatgtcaaaaaattagaataaaattattttacctactttgtccaaatatcaagttgtaaatactattcatgtattaaaaagtgaaaaactatgactgttataaaaaatatatgctcacataaacgatcgttttatgtatcattccttgaagttcggcccactttagaaattcacatatagccatgcctccaaactcatcatagcttagaattgttccaactacataatctcaactccaaatgtcttttcatagtcacattacttgttcttctgccactttctattctaccattctcactcatcactgtgatgtataagcctttatccattcttaggtttccagtctattttgagtatattagttttctgtgcctgacataacaaagaaccaacaaactaagtggcttagaacaacagaaatttgttgtctcactgttctggaggctagaatcccgagatcaacgtgttggccgttttatttgaagacatgttttatttgaagacactagggaaggagctgtccaggtctctctactattactagattctggtagttccttggcagcataaaatccaatctttacatggcattctccctgtgggcatggatgtatctgtgtccagatttctccttttcgtttttttgagacagagtttcgctcttgtcacctaggctggaatgctgtggcgcaatgtctgctcactgcaagcttcgcctcccaggttcaagcaattctcctgtctcagcctccccagtagctgggattacagacgcctgccccaacgactggctaatttttggtatttttagtagaaacagggtttcgccacgttgggcaggctggtctcgaactccttacctcaggtgatctgcccacctcggcctcccaaagtgctgggattacaggcatgagccatcacacctggccatttctcctttttataaggatactagtcatattggattggggggtcccccctactctggtaggaactcatattaataattttcaatttgactaattatatcagcaattaccctacttctaattaatgttaaattctgagatactgaggattaggaactcagtatatgaatttaagggggtagggcacaattccatccataataccttcttatctagaaaagaagaatcccattatctcctatctcaacatggctcctatcacccttctaattttattcttgtcttccatcatacagagctacctaagtagaaaattcttgctctggaattgatggacattactggtgaaaattacataatcatggtaataaaatacccattaagaatgcatatgttttgaactcaactgggccttaaatctgtagggatcttgtttcaccatcccctagctatgactgttgcaaatacttgcttttttttttttcaataatttcaacttttattttagattaaggggtacatgtgcatgtttgttacatgggtatgttgtgtgatgctgaggtttgggatacaaatgatcccatcatctaggtagtgagcatagtcactacatttgtttgacttttaactttgctactcttactccaaacagacccctcctttcctaactaaatgaaatgctagaagacatcaatatgaataaatttgacattctttccacacccctccccaacactattctttcttcaaatatcttctctgcctttcatctctcccctttgactggccccagtgtgtcaacaaaacctcctctgtaattaatgcaaaaatgtcattttctttgaaagcttccctctctaactatgctacatgctgctgctttgtttatgatcaaaaaataatggaaagccactctgttgactcttcattgcctaggaaataagaactaaatcctaatcagtaagtacctttaatgtgttctcaagctagttgttgaaacctatattctggtgagctttcaagatggccgaatagcaacagtggtggtctgcagctcccagtgagatcaatgcagaagatggatgatttctgcatttccaactgaggtacctggttcatctcattgagactggttggacagtgggtgcagcctatggagggcgaaccgaagcagggcagtgtgtggcgttgcttcacctgtgaagtgtaaggggtgggggatttccctttcctagccaagggaagccatgagagtctatactgggaggaatgatacactcctacccaaatactgcacttttcccactgtgttcgcaaccagcagaccaggagattccctccggtgcctggctcagtgggtcccacgcccacatagcccagcaagctaagatccatggacttgaaattctcactgctagtgcagcagtctgtgatcaacctggaatgctggagcttggtgtggggaggggcgtccatcactgctgaggcttgagtaggtggtattatgcccacagtgtaaacaaagctgccagtaagctcgaactgggtggagcccaccgcagctcagcaaggctgactgcctctctagattccacctctgtgggcagggcatatctgaacaaaaggcagcagtccagtcagggaattatagataaaaccctcatctccctgggacagagcacctggggaaaggggtagctgtgggcaaagcttctgcagacttaaacatccctgcctgacagctctaaagacagcagtggttctcccaacaccacattcgagctctgttaacagacagactgtctcctcaagtgggtccatgacccccatgtagcctaactgggagacatctcccagtaggggctgacagacacctcatacaggagagctctggctggcatctcatgggtgcccctctgggacaaagcttccagaggaacgatcagggagcaatatttgctgttctgcagcctccgctggtgatacccgggtaaacagggtctggagtggaccttcagcaaactccaatacacctgcagctgaggggcctgactgttagaaggaaaactaagaaacagagaggaatagcatcaacatcaacaaaacggacacccacaccaaaaccccatccatagtcaccaatatcaaagaccaaggtagataaatccacaaagacggggagaaaccaatgaaaaaaggttgaaaattccaaaaatcacaatgccttttctcctccagaggatcaaaacttcttgccagcaagggaacaaaactggatggagaatgagtttgatgacttgacagaagtaggtttcagaaggtgggtaataacaaacttctccgagctaaaggagcatgttctcacccaatgccaggaagctaaaaagccttggaaaaagatgagaggaatggctaactagaataagcagtttagagaagaatataaatgacctgatgcagctgaaaaacacagcacaagaacttcatgaagtatacacaagcttcaatagccaaatctatcaaacagaagaaaggatatcagtgattgaagatcaaattaatgaaataaagtgagaatacaagattagagaaaaaagagtaaaaagaaattaacaaagccttcaagaaatatgggactatgagaaaagaccaaatctacgtttgatcggtgtacttgaaagtgacagggagaatggaatccagttagaaaacactcttcaggatattatccaggagaaattctccaacctagcaaggcaggccaacattcaaattcaggaaatacagagaccaccacaaagatattcctcgagaagagcaaccccaagaaacataatcgtcagattcaccatggttgaaatgaaggaaaaaatgttagggacagctagagagaaaggtcgggttacccacaaagggaagctcatcagactaacagcagatctctcggcaaaaaccctaaaagccagaagagagtgggagctaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaatcagtaccagccactgcaaaaacacgccaattgtaaagaccatcaacactatgaagaaactgcagcaatgaacggacaaaacaaccagctagcatcatgaggacaaaatcaaattcacacataacagtattaaccttaaatgtaaaagtgctaaatgccccaattaaaagacacagactagcaaattggatgaagagtcaagacccatcagtgtgctgtattcaggagacccatctcatgtgcaaagacacacataggttcaaaataaagggatggaggaaaatctaccaagcaaatggaaagcaaagaaaagcaggggttgcaatcctagtctctgataaaacagacttcaaaccaacaaagatcaaaagagacaaagaaggccattacataatggtaaagggatcaatgcaactagaagagctaactatcctaaatatatatgcacccaatacaggagcacccagattcataaagcaagtccttagaaacctacaaggagacttagactcccacacattagtaatcggagaatttaacaccctaatgtcaacattagacagatcaaccagacagaaaattaacaaggatatccaggacttgaactctgctgtggaccgagtggacctaataggcatctatagaactctccaccccaaatcaacagaatacacattcttctcagcaccacattgcactgattccaaaattgaccacataactggaagtaaaacactcctcaggaaatgtgaaagaacagaaatcacaacaaactgtctctcaaaccacagtgtaatcaaattagaactcaggattaagaaactcactcaaaaccgcacaactacatggaaactgaacaacctgctcctgaatgactactgggtacataacgaaatgaaggcagaaataaagatgttctgtgaaaccaatgaagacaaagacacaatgtaccagaatcactgggacacatttaaagcagtgtgtagagggaaatttatagcactaaatacccacaagagaaagcaggaaagatctaaaatcgacaccctaacatcacaattaaaagaatagagaagtaagagcaaacaaattcaaaagctagcagaagacaagaaataactaagatgagagcagaattgaaggaggtagagacacaaaaaaaacccttcaaaaaaattatgaatccagaagctggttttttgaaaagatcaacaaaatagacagactgctagcaagactaataagaaaagagataagaatcaaatagacacaataaaaaatgatacaggggatatcaccaccgatcccacagaaatacagtctaccatcagagaatactataaacacccctttgcaaataaattagaaaatcaggaagaaactgataaattcctggacacatacactctcccaagactaaaccaggaagaagtcagatttcttaacagaccagtaacagtttctcaaattgaggcaataatagcctaccaaccaaaaaaagtccaggaccagacagattcacagccaaatttaccagaggacaaagaggagctggtaccattccttctgaaactattccaatcaatagaaaaagagggaatcctccctaactcattttatgaggccagcatcatcctgataccaaaacctggcagagacacaacaaaaaaagagaatgttaggccaatatccctgatgaacattgatgtgaaaatcctcaataaaatactggcaaaccaaatccagcagcacatcaaaaagcttatccaccatgatcaagtcagcttcatccctgggttgcaaggctggttcaacatatgcaatcaataaatgtaatccatcacaaaaacagaaccaaaaacaaaaatcacatgattatctcaatagatggcagaaaaggccccgataatattcaacaactgttcatgctaaaaacactcaattaactaggtaatgatggaacatatctcaaaataataagagctatttatgacaaactcatagccaatatcatactgaatgggcaaaagctggaagcattctctttgaaaaccagcacaagacaaagatgccctctctcaccactcctgttcaatatagtattgaaagttctggccagggcaatcaagcaagagnnnnnnnnnnnnnnnnnnnngacaaaaaccacatgattatctcaatagctgcagaaaagaccgtcgacgaaattcaacagcccttcatgctaaaaactcacaataaactaggtatcgatggaacatatctcaaaataataagagctatttatgacagacccacagccaatatcatactgaatgggcaaaaactggaagcattccctttgaaaactggcacaagacagggatgccctctctcaccactcctattcaatatagtattggaagctctggccagggcaatcaggcaagagaaagaaataaagagtaatcagttaggaagagaggaagtcaaattgtctctgtttgcagatgacatgattgtacatttagaaaaccccatcatctcagccccaaatctccttaagctgataagcaacttcagcaaagtctcaggatacaaaatcaatgtgcaaaaatcacaagcattcctatacaccaataatagacaaacagagagccaaatcatgagtgaactcccattcacaattgctgcaaagagaataaaatacctgggaatccaactttcaagggatgtgaaggacctcttcaaggagaactacaaaccactgttcaatgaaataaaagaggacacaaacaaatggaagaacattccatgctcatggataggaagaatcaatatcgtgaaaatgtccatactgcccaaagtaattcatagattcaatgttatccccatcaagctaccactgactttcttcacagaattggaaaaaactactttaaatttcatatggaaccaaaaaagagcccacatttccaagtcaatcctaagccaaaagaacaaagctggaggcatcacactacctgacttcaaactatactacaaggctacagtaaccaaaacagcatggtactggtagcaaaacagatgtatagaccaatggaacagaacagaggcctcagaaataacaccacacatctaaaatcatctgatctttgacaaacctgacaaaaggaaaaggattccctatttaataaacagtgttgggaaaactgactagccatgtgtagaaagctgaaactggatcccttccttacaccttatacaaaaattaattcaagatggattaaagacttaaatgtaagacctaaaaccataaaaaccctagaagaaaacctaggcaataccattcagacataggcgtgggcaaagacttcatgactaaaaccaaaagcaatggcaacaaaagccaaaattgacaaatgggatctaattaaactgaagagcttctacacagcaaaagaaactatcagcagagtgaacaggcaacctacagaatgggagaaaatttttgcaatctatccatctgacaaagggctaatatccagaatctataaagaacttcaacaaatttacaagaaaaatacaaacaaccccatcaaaaagtaggcaaaggatatgaacagacacttctcaaaagaaggcatttatgcagccaacagacatatgaaaaaatgctcatcatcacttgtcattagagaaatgcaaatcaaaaccacaatgagatactatctcatgccctcatgcctgttaacatcatgatcattaaaagtcaggaaacaacagatgctggagaggatttggagaaataggaatgcttttatgctgttggtgggagtgtaaattagttcaaccattgtggaagacagtgtggtgattcctcaaggatctagaaccagaattaccatttgacccagcaatctcattactgtctgtctacccaaaggattataaatcatgctactataaagacatatgcacacgtatgtttactgtggcactgttcacaatagcaaagtcttggaaccaacccaaatgtccatcagtaatagactgcataaagaaaatgtggcacataggcaccaaggaatactatgcagccataaaaaggatgacttcatgtcctttgcagggacatggatgaagctggaaaccatcattctcagcaaactatcacaaggacggaaaaccaacactgcatattctcactcataagtgggagttgaacaatgagaacacatgggcacagggaggggaacatcacacaccggggcctgctggggggtcggggcttgggggaaggatagcattaggagaaatacctaatgtaaataagttgatgggtgcagcacaccaacatggcacatgtatacctatgtaacaaaactgcatgttgtgcacatgtaccccagaacttaaagtataataaaactatattctattgaataaacctttttgaaccataatatggcattaaacattccagattattgccattctgtacattgctatctctttaccatattcaccaagtttaccttagccatgttgttaattggtttgttatatttatattaggttttgttacgtttatattttgtttattttcttattctatccatctttcttggccagctcaaatcctaagaagtcatctccaacactcactatctccttagtagcaattacttccttcttccttaggaaactgataactttgtcacaatttactgttggtatttaacatattgtaacttgcaaataaattgtgtgtgtaaattcctgtgttgtatgtactaggctgtgagaactttcctgtttgggactatgtcctgttcatctttgtatatcatagtgcaaggaatttattatttgtgaattaaacagatttatcaatgtagaaatatataaaattctgcagcaaaatatggaaaattatatcctgatatacgtttgttaattctttattcatttttcatacattggttttacatataaaatattatcaagacactaccatgtgcttaatacaaggtactaaataaactgaaatttattttataatttaattctacaaataaatccactctggtagcatttggggaatataatattgactttatattttaaaataaaaatatgaaagtttattttattttattttattttgagaaaatactggcaaattagaaaatactggcaaatgtttttgcacgtggtctcttaagaaccatagctcagaaccctgggatgtgatacagtactattcacatcagtactactcagacacattgaaaacctggtcctgtgtcaagtcccatgaagggaatccctaagggaatagagaagagaatgctatttaatgatttgatgcatgatagtaaccacaggagaataaaacttcgaaagagtctttataaactgggtttaatgaaactgatcatttccagttctattgtatatcatttactgccttagctggcaagactctagaaatagaaatagagaagattcttccttctcatatgtgtacattttaatatcttgaatatagaggactacttatagaattcagtgaagtcaccaaaggttgaataattagctatttctgccctttactagttgttagatttatcattatcaacctttgcagtgaaaagtagaaaaaatacaaactgcaccaacagttgggctagtcatacattttacacagtgacaatatcccattaaaatggtattcttaaagaggagatgtgtgaattaatatgcagtggcacatagaattaaccaggcatcatcattttatttcagaagcactcatatgattaaatttctgagctaaaaattcatccttaaaagttatactttagcagaatgactgattttattttatagctgtcaatttgattgacaagtaggatccatcaagtgtgtttctattcttgtaatccagggacaccttgaaaagatttcgcaagagaaaagaaagaaatattatagaaaaaaaaaaggaaatcgcatgtctaattaagagcttaatttgtgatgaaaatacataattttttttttacatccactatggtgctaaaacaactacactggaaaaatcccttagttatggggtaattggtatgaatcaaatatctttcttatttagaaaccatttatagtgctgaattcatttcatttatagtagtgtcattttgtatttttatgcagtttgaattggtactgttttctaattgcagcaaggactttactgcataataatttaaaattttagctttgtaatagctcatgaaaatattcaatattttgttttgttgtgatggttaatattaggtgtcaacttgattggactgagggatgcctagatggctggtgaagcattgtttctgggtgtgtttgtgagggtattgccagaggagactgacatttgcctcagtgagctaggagaggaagacccaccctcagtgtgggttagcatcatccaatcagctgccagcatggctagaataaagcagggggaagaaggtgggataagctggcttgctaaatctgccggctctttttcttttgcctgttttggacacttgcttccactcttctgcccatagataccagactccatgttcattggcttttggaatctgtgacttgcaccagtggcttccccagggctgtcaggccttctgcagcagactgaaggctgcactgtcagcttttctggttttgagtctttccaacttggactgagaaattataggcttctctccccaacttgcagatagcctatcatgggacttcaccttgtaatgatgtgatccaattctccctaataaactctctcctatgtatacatagatccaattgtttctgcccctctggagaaccctaatacaatcatatttactggtgtatttagtgctagatgtttacatgatataatggtgtgagttctcaagaatctgagataaggtcttgggtgtaggtagtttacttggaaggagatcccagggtcaggaatgagagtgaagagtgagaaggaggaaagggcaatgtacgagtacgttttcaaggtcatgcctctgtgagcaatgtggactagattccactggggattgctcctaagaggcatagagaatacctcttaaattatctgtctagggaagagcaggcaagaacatatatccactggttcttctatattggttaacactccaaggacattaactccttctcacttccaggctgcattaacttacctcaaggcaaaaggtgatcagtatagaacaagcctaaaagctcctaagaacagtccagtagctatggctgaactcagaggtgggtgcagaggctgtgaggtggagcagcagagggattctgttaggcaggggttatgtaacatgattgattccgcagcccaaaggagaacttgacacccaaatagcaccaaaaacaatagatttcaaatattttctcttgtggacaatacatacattacagttatttatgtgtcgcttaatgacagggatatgatctgagaaatgaatcattaaatgatttcatcattatgcaaatgtcacagagtgcacttacacaaacctagatggtacagcctgctgcaaatttaggctacctgatacagcctagtcctcctaggctacttaacctgtaccggatgtgactatactgaatactgtaggcagttgtaacatgatggtaagtatttatgtatccaaacaagaaaaggtatagtgaaaatacagtattataatcttaagggattgccattgtatatgtgagcccatcattatccaaaatgtcattatgtgacacatgactgtatatgattctactgggcatacagagacaaaaatttatgaaataatacccttgctgtgcacaatgaggtctgatgttttctattctgttctacgctgtgttattctgttctatttaattaaacactgctcttcataactccctaaagtaatttttaaatccatggtttggaaaacattggccgaaaagataattaatttacctaagaaggtaaatattagcgtattaaaaataatggaaatcatgtaacctaagccatatacagtgagatgtttagaaataaaggtcatagttttaaggtcaagaaagactcaattcttaagaaattagaaaatagagtagcatggtttaaatgtgtaccatggttctagatttcatctgtcagtgtttcagaatctgcaaatggataaagaacatctagctccctaagagaattaacagggagggaacacagaagggctgaaaaatgaggtgctgttctccttcttttacctcagctgctgtgattcctgctatcccaattcatatacatatagtgaggagaattcgtatatacagcctgtataagtatgtgtacatatacacagccagctagatgttaccctataggtagagcttcctagtgccctatctcaggatccttttgcatcttatgtttgtttcaggtttattgttttgacagttgtcacttttaagcttcttttctcttttcatagagaaagagctttcagtctcctaagaggatagctctattatcataatcaccttttagaagagaaaattacctgtaatttttatgctctgaaggtgtgtcatcataattcagccacccactttaccctcaaaatcaaatggatttttttaaagaaacttctttattctttcttattgcattttctttggaggaaatgagagcttaagaatatgggaaatcccatcaagtttctatgagctttgctgcctctttctactgtcagctgttgtgtttaaggatatcacagccacagtgatctgcaagcactgctgttgtaagacttgtctcaacagagtacagtttaaagagtaagtgaacaagtaagggaatagtaaccctcacacaagccataactttccatcagatccctcatgcttacaagctccacctttgctgttgtgtacacagctcctcctggaagcccgacctccccatcccaccccagcactcctgtaaatctgtctcatgggaaagataacacaggagtgtgtgctcacaggttaccaatcaatatcaatatttcaccaaatctcagttgtaattgattatcttccagttattggagaataaaccccaaaaggggtggataaagggaaaaaatgcaaaaacccagaatgtcatgtgccttttgccagctactgctggatgtgttctacaactgagtacacagctgtttctaataaacactattagtactaatccttaagcagttattgccttctcctcattgcagtagatcctccagtatagcaatctgaaaaactgacctcattgtcaagtcaattggtgtcttgtgaaatgacaatttggtggtaaagtaactttcgcaaagtgttgcctactacagattctgaaaagtatcaaggttaaaaaatttatttaacttttcaaacctagaatttctcacatttattatttcatgggccgggcgcggtggcttacgcctgtaatcccagcactttggcaggccgaggcgggcagatcacgaggtcaggagatcgagaccatcctggctaacacggtgaaactccatctctactaaaaatacaaaaaaaatagctgagcatggcggcaggcgcctgtagtccgagctatttgggaggctgaggcaggagaatggcgtgaacccgggaggtggagcttgcagtgagccaagattgcgccactgtactccagcgtgggcgacagagcgagactccatctcaaaacaaacaaacaaaaaaaacccacatcttttgattcttaaaggacagtgactatttgcacaactcagtatggaaaataaggttttgcccagcgtgccattttttatcacgtgggtgcctttacactcctttttctacgatgctttctccaagttcccttggaatattctctcatcccttcaaatgacagagcttcctatgccagataatttttttattgtaccaccaatgtcaacctcagtgacattggccataaactacaaaatcatggctatatgtatatgcaaataaaaaatgtcacagtactgattttttatttttgtcccttgattcacttggtgtctcggtgtgacttttcaagccccagaggagtgaactccttttctcctttcctgtttccatccagctggttccagatcagcatcaaagtgaaacggatttgggtactgaaaaggtaatgagcttcacttatagggagaaggaaaacagaggatacagctatgcatattggttattacttacttccttgagtataatccttattcatttattcaaatatcatcatcatccttttgtttgtagtagtactggtagtttgttgagactctactttgtcccaaatattatttagagcatatgtaaatgttaattttttcagtcctcacagaaaccctataaagtatgtctcacattcttcactctacaaataaaacaggccaagaaaaatgaagacacttgccccagtcacatggtaatatatggcagaaccaaaaatcaaacttaggtcactttagttcaaagcttttttttttccctccactatgagctactgctctccaggcttgatcatctcttgggtgctagccactgatatgctccccagattccagtggctttcattcatggcttctacttcaccaggaagtgcctgtcctttagccaaagagaaaatacttttgtttttgccccagtttttttgtcctggtagtggggctaaagatggaaattcgccatttgtttctataatagatactgataaggaccaccaaaatgatggaaaatgtgcaagcttcaaagcaaaagcctacaagaagggagtataaactgaaaaagttacattagatagcacagatttgctgggctcaaaatatatccctctggctgtcattagcacagaactatagtaggatttaagaaatgtttgaagaattcatggcaaaagataaaatgtgttatccagttgcaagacatcatagagaccatgagggaccacatttgcaaatatagttcattctgacaacagttgtgtgtgcatcttaggacagtcattacatatggttagtcattatttatggaatatctattgtatacagatgggttggtagttaagaaggaaatattctttagctcctgttgctacaaaataaacattgatcagtgtttacaccatgccaagaaagtatttgaatattaaaatctcaattcactaaatggtggtatgtggcaacaaatggtaattaaaataaatatttgataggtttttattgtttaaaatgggaggcaatttagtgagagttataatacacagtggtataataaaatggctaataaatttcactgttttttaagaagtggagaaccaattagacaaagtacttctcatttattttttaagagagaaagagagtgtgtgggtgtgtgtccattcacacatgtcactacacattaccctagaacactgtggggtttagtaagacccttttaaatatagaatgccattaaataaaaatacagaaactagttttcagtctaaatatagtaatatagtaactgcttgttgcacttattgtgaatatttcagaggataaaccatggcaaatcgttcaatcctttccttttttctgtactttgttaactcatggtaaatttaacctgtttttctctcttaaatctaataatttttattcttttccttcataattaacagtgttttagatagtattttaaataattttatacaaagtagtttacactcacaagattttttttaaaattcaaaatatttgatgaggcagccttttcagaaatgtcaaagtagtaatgcttaactaaagtatatagcagtttaaggacaaagagaagtcaatcattatccatgttgacaacatgagtacccaccaaaatataatttttaatgaggtacacaattagctgcttttatatggatcataatataagttctgccccatcccccactccatcattctatgatgacaaattactatttttgaatgttggggaagcgctagcaagctctttctttgttcactcagtaaaacaggttttatatggctcttcaaataactcctaaaacaaacttattataagacatgacaagtaaaccttcctgcttattacttttcataagcacatcttcaaaaatgtccaaaaaaatgtaaggtcaaaaggataagggtggggaaagcttgtacaagataaaagttaaattctttgggaaggcaaccattccgatgatttaaaaagcatttatgtaacatggtgaaaccctgtctctactaaaaatacaaaaattagccgggtgtggtggtgggtgcctgtagtcccagctactcaggaggctgaggcaggagaatggcatgaacccaggaggtggagcttgcagtgagctgagattgcaccactgcactccagcctgggtgacagagcgagactccgtctcaaaaaaaaaaaaaaaaaaaagcatttatgttgatgattgatgagacacagaaagatatttgctatactagaagtttacagagtttctcatatcctcctcaactttcttgttttcagtactcttttcaattaggaatgataggaaactgtatttcttttccttgatggagtaacaaagggtgataggaatactccttatttaataatgatgtatgttatacatccatggtcttcttggtcgttcattcctgagctagtttctaaattagaacttgattcatctaaaaatggggtggattcttaaactagggacttacaggaaaaggcaaccttttagttttctgcatattgtattcaactctggaatcttgtgtccagttctgggcatgttcatagatttaattcatgtcaacaaatatttactcagtgccactttatacataaaacactaccctaggactttggttgtccaatcaagatcctatcacattctatattatgcaaataactagactttttacaaactgaatggctttccctggcctcagtgtatttacaaactagtagaagagacaaatacagaaacacataattaaaatacagaaaaataaatacaaaattagtatatggatagcatatgaaaggtaaaggaggtcccaatcccgccctctagtcatggaaaccacgagttcgttattaatacaaagtcaatggagggtaattgagtgacaggaagagagacaggtgctgggcagaaaccacatcagtgcacttgtgacattttatttaatggtaaattctatcatattcatggtaattgcctgtgactgcaaaatgaggaaaggttacatgtatttgtcttctcatcattatcaccactgtaaacttttttctaaatacccatatgtgggtggagctaatagaagccccacatttttgttagaaccattgtggtcacctgagaactcgtgacctttttcaagcgggaaggtacctctctggtagctttatgtattatgaatttgaagggacaagcttgggaacagaaagatcagttaggaggtgaccataggagtcacgtgaaagctgacaaaagcctgagctcaggcagtagtgttacagataaagaagaagagatggagcaggattcaaaaatatatatgtatataaacttacttgattagatgaagtacatgaaggaataaaagactactcttaggattatagcttgggtagtagcaatttagtggtgtggtactatgacattaatgggaacccactgaacatcaaaagaatatatttatacttttccatattagcaaaacctaaagaagactcagattaataggcaaataccaaacaaaaaaatgaagagggtacttcagaagtacctgtttacttattgaaagtagtatctgtttactcattgaaaattcatccatttgaaagcgtttacaatgttggtgggagtgtaaattagttcaaccattgtggaagacagtgtggcaattctttaaagacctagaggcagaaatatcatttgacccagaaatcccattactggatatgtacccaaaggaatataaataattctgttataaagatacatgcacacatgttcattgcagtactattcacaatagcaaagacatgtaaccaacctaaatgcccatcattgataggctggataaagaaaatgtggaacatatactccatggaatactatgcagccataaaggggaacaagatcatgtccttttcagggacacagatggttcctggaagccattatccttagtaaactaacgcaggaacagaaaaccaaataccacatattctcactcgtaagtgggagctgaatgatgagaacacatggacacatgaggggaacaacccacagtggggcccttcagtgggtagtgagtggaatgagggagagcatcaggaagaatagctaatggatactgggcttaatatctaagtgatgggatgatctgtgcagcaaaccaccatagcacatgtttatctgtgtaacaaacctgcacatcctgcacataaaagttggaaagaaaaaaaaagaaaattcatccatttgaaattcatgtgctacttttttctccccacttattatttgattttgttgagtgtattttgataacaacatgaactgtgaataaaatggcatgcaattgaaaggcagtaattgctaggtaagtaatactaagtaggtatagtggggtcatatttttaatcaagtgataaatagttggagagaacaaaaatgaacagccttgttatacatgcaaatgtcataacttcattcagttttatctgtctagctgtatgcactatgtggaagtgaatgcaagtcaaattcatgaagtaattatctagattaagaactaaaaggattcagtgcacttgattgttgacattttatttaatggtaaaatctatcatcttcatgataattgcttgtgactgcaaaatgaggaaaggttacatgtatttgtcttctcatcattatcaccattgtaaacttttttctaaatatccatatgtgggtggtgctagtagaatcaccacacttttgttaaaagcattacgtttgctttctccaggataattctgacaacaatagtacaaaacttatcatcttttattttggtcccttacctcctctatttccaataatttattggtgtctaatgtaataccataacctgttctcccaagctccatttctgtggttattttctccttttccttcttccttctcctttgatacacaataccatcacatgttgctgatctttccactgcactgccttttttgttcaataaaaatgtaaggtccccagctcacatgtatgcttcagtgtgcagctccagagctgctgtccaatatggtagccactagccacatgtgactattgaatactttagatatggctagtcaaaattgagatgtgctgtaaataaaaactacataccagacttgaagactttctccaaaataagaatatttaaaaagtcattaatgatttttaatttgattacagtttgaactgataatactttgaatgtattaaataaaatgctatttaattagttggacttttttgtttttaacatgcctattagaaattttgaaattgtgtacatctcctacatctgaggcctacattgtttttctattggacagcattgcaataaaggacactagagttaaagagggcatgctctctgctccaagactgtgcagctagactaactataatatcataaattggagccaggcttggtggctcatgcttgtaatcccagcactttgggaggccaagacaggtggatcacctgaggttgggagtacgagaccagcctgaccaaaatggagaaacgctgtctctactaaacgtgcaaaattagccaggcatggtggcacatgcctgtaatcccagctactcaggaggctgaggtaggagaatcacttgaacccaggaggcggaggttgcagtgagccgagatcacaccattgcactccagcctgggtaacgagctaaactctgtctctaaatacatacatacatacatacatacatacatacatacatacagtgatatggtccataggagagtgtaaagagaagagtgagtaaacatttctaacagggcatttgaggaaagatccatggaagaagtgatattgaatcatcatagaaggagggcaatggtgttagcatttcaagtacagaagacagtgtaagttaagtcttggtgacaagaaacaggctgctgaaacagtcacctcaaatattattttatcacatcactgctctatggccaaccatagaaaaataaaaatctatccagaaaatattttaagcttcttaccagtttttcttaaaagcatctgtttctacttccttacctactcccactgagaaaaaaaggttcctctcaggccgggcatggtggctgacacctgtaatcacagcacattgttgggaggccaaggcacgtgggtcacctgaggtgaggagtttgagaccagccagaccaacatggtaaaactccgtctctactaaaaaatacaaaaattagccggacatggtggtgggtgcctgtaatcccagctacttgggaggctgaggcaggagaatcacttgaacctgggaggcggaggttgcagtgagctgagatgtgccattgcactgcagccggggtgacagagcaagactccatctcaaaaaaaaaaaaaaaaaaagtgcctctcaatgaggtgtaaaggtagtggtacttacggcagactagaaagatgctatgtcagtcgtgctgctagggacctctgaggagctaaactctggttttagctactgaaatgggaaagaagtagctcgcctgtacccatgcttaactccaggagggaggggaaacacaagagtaacacttcccaatagtatgtctcctgagaattgggatatcttatggttcaccataaagtatctgttgagtaaggaaacatgaacaaaggaaaaagaggcagatagaaatgaagaaagtagggaaaatcaattctaaaagacatgttttatagataataagaaactaattaggagcataaaagagaattgagggttatagctcaggcagtgcagtatcctccacaggtttgaattcaggcactggcctgtgctgcccttaggttgtaggcaagctgcttaccctctctgactttcaattccctaatctgtaaaaagtaaagtctaagaattagaaacaaggtaaaacatagtgtctggcactctgtaagtgttaaataaatgttaattttatgttcgaccactgtttgctaaataattttgaaatgtatccttttttggttgattccctgggaattcagttaggaagagaggaagtcaaattgtctctgtttgtagatgacatgattgtatatttacaattgtctcggcccaaaatcttcttaagctgaaaagcaacttcagcaacatctcaagatacaaaatcaatgtgcaaaaatcacaagcattcctatacaccaataatagacaaacagcgagccaaatcatgagtgaactcccattcacaattgctacaaagagaataaaatacctaggaatccaacttacaagggatgtgaaggaccttttcagggagaactacaaatcaccgttcaaggaaataagagaggacacaaacaaatggaaaaacattccatgctcgtggataggaagaatcaatatcatgaaaatggccatactgcccaaagtaattatagattcaatgctatccccatcaagttaccattgactttcttcacagaattagaaaaaaactactttaaatttcatatggaaccaaaaaagaacccgtatagccaagacaatcccaagcaaaaagaactaagctggaggcatcacactacctgacttcaaacaatactacaaggctacagtaaccaaaacagcatggtactggtaccaaaacagatgtatagaccagtggaaaagaaaagaggcctcagaaatattgccacatatctaccaccatctaatctttgacaaacctgacaaaaacaagaaatggggaaaggattccctatttaataaatggtgttgggaaaactggctagccatatgcaaaaatctgaaactggaccccttccttacaccttatacaaaaattaactcaagatggattaaagacttaaacgtaagacctaaaccataaaaaccctagaagaaaacctaggcaatacccttcaggacataggcatgggcaaagacttcatgactaaaacaccaaaagcaatggcaacaaaagccaaaattgacaaatgggatctaattaaactaaagagcttctgcacagcaaaagaaactatcagcagagtgaacaggcaacctagagaatgggagaaagtttttgcaatctatccatctgacaaagggctaatacccagattctacaaagaacttcaacaaatttacaagaaaagtacaaacaacccatcaaaagtgggctaaggacatgaaagacacctttcagaagaagacatttatgcagccaacaaacatgaaaaaaagctcatcatcactggtcattggaggaatgcaaatcaaaaccacaatgagataccatctcacaccagttagaatggtgattattaaaaagtcaggaaacaacagttgctggagaggatgtggagaaataggaacacttttacattgttggtgggactgtaaattagttcacccattgtggaagacagtgtggtgattcctcaaggatctagaaccagaattaccatttgacccagcaatcccattactggatatatacccaaaggattataaataattctataaagacacatgcacatgtatgtttattgtggcactgttcacaatagcaaagtcttggaaccaacccaaatgcccatcaatcatagactggataaagaaaatgtgggacacatacaccatggaatactatgcaaccataaaaaaggatgagttcacatcctttgtagggacatggatgaagctggaaaccatcattctcagcaaactaacacaagaacagaaaaccaaacaccgcatgttctcactcataagtgggagttgaacaatgagaacacagggacacagggaggggacatcacacaccggtgcctgttgtgagggtggggagctaggggaagggtagcattaggagaaatacctaatttagatgatgggttgatgggtgcagcaaaccaccatggcacgtgtataactatgtaacaaagttgcatgttttgcacatgtaccccagcacttaaagtataatttaaaaaaagaaaaagagatggtccactctaagagaagtggagccaccaaatctaccttaaaaagaagtaatcaaaaacctcaaatgaataagcattctaaagtggatatactatctaaagccatacaattaactagttaactatcacgggggagccagagtaagtatgttaagttctcttctattcattaaaccactttgagtgtaccatctgtttcttgctgggatactgagtgataaaactgataaatttttgttctttttttgtacttgttttaaaaatcaaaatgtgcgtctacaatgaaaagcaatgacagtttgagttaccaaagtgctaagggatttgctactaggatgggtaccaacaatgttagtaaagtcagtggagctgccctctgtaggctagtcctgccctccatagacaaaagatactgctgaaggactggcttccctgagagcaatgtggtggtatgctccccagatgaaagagactgtctggtagcacctgatcatcagaaacaagcaaaatgcaatgatcactgtaagtgtcacgtttggagataaaaggcaatcctgtactttctacctttaaaaactacagactttaaaaaaaattgaagacacacaagaaatggaaagatatttaatattaatggatcggaaggatcaatattattaaaatgttcatactacccaaagcaatctacagattcaatgcaatcactatcaaaatactaatgacattcttcacagaaatagaaaaaataattctgaaatatatatggaaccataaaagacccaaaatagccaaatccattatgagcaaaaagaataagactggagaaattacattacctgacttaaattatactacagagctatggtaaccaaaacagcatggtactggcataaaaatagacacataggctaatagaacagaatagagagctcagaaataaatttatacatctgtagttaactcatttttgccaagggtgccaagaacatgcattgaggaaaggatcgtctcttcaataaatggttctgggaagactggatatccatatgtagaaaaacgaactggaccactgtctctcaccataggcacatcaaatcaaaatagattaaagatttaaattcttagacctcaaactatgaaactactaaaaggaaccattgtagaaactctgcaggacattggagtgggaaaagattcaattagtagtagctcaaaaacactggtgaccaaagcaaaaatggaccaataggatcacatcaacttaaaaagcttctgtacatcaaaggaaacaatcaaaaaagtgaagatacaacccacagaatgggagaaaatatttgcaaactatctatctgacaagggattaaaaaccagaatatgtagggagctcaaacaactcaataggaaaaaaaactaataatttgattaaaaaatgagtaaaagatctgaatagacactactcaaaagaagacacacaaatggaaaacaggtatatgaaaaggtgctaaacatccttaatcatcagagaaatgcaaaacaaaactaccatgagcatctcaacctagataaaaatggcttttatccaaaagacagatgacaatgaatcctgctgaggatctggagaaaggggaaccctcatatgctgttggtgggaaaataaattagtacagttctgttggagaagagtatggaggttccccaaaaatctaaaaataaaactaccatatgatccagcaatcccactgctagttatataccccacagaaaggaaatcagtatattgaagagataactgcactcccatgtttattgtaacgctagtcacaatagccaagatttgcattcaacctgtccacagacaaattaataaggaaaatgtggtacatatgcacatggaatactattcagccatgagaatgagatcctgttatttgcaacaacatgaatgaaactggaggacattatgctaagtgaaataagcccagctcagaaggatgactattgcatgttctcacccatttgtgggagctacaaattaaaacagttgaactcatggagatagagagtagaatgatggttaccagagactggaaagggtactggaaaggagagaggaaaatggggttggctaatcggtacaacaatatacttagatacaatgaataagatgtagtatctgatagcacaacagggtgactagtcaggaataattttttgtacattttagaataactgagggaatacaactggaatctttataactcaaataaatgattaatgtttgcagtgatggatatctcatttaccctgatgtgattattacacattgtatgcctgtatcgaaatacttatgtaccccataaatatatataccttctatatagccataaaaataaaaaattaaaaaaataaaaattaaaagaaaatactaggagagtattttattccatcaattctaaaacacacctttttccttcctgttgtttaaaatcactgaacccaggatatgtcttaccatatttgaagaaagaccatgggtcctagtgattgcaaacattcttttgctcatcttccgctaaaatcgagatgttccaacctcaaagcctgaagagtgaaacctcttaagaaatattcttgatgtcccagagaatgaaacaggtgggaaaacatggacaacaatacctccaacttgaaaagtgattcagaagagttagaccctgaaaatgaggaactttggcaataacttcacagcattattgtgcttatattttctttttatgtgtgactagaatgaatataataaaaaatatatctaaatcagtcaaatattttagcagttgttaaaggaaatactaagatatgcaaacatgtcatggtttaattttttcctggtggtacacaaaatactcataccttttgctattgatggagtcttacattctatgaaatacatttatttttttcaaacctattgtaaaagggtacataaaagataggacagagcaacaccctcaagtttgtaggatattcttatatatccttaggccaaggcaggctaagggcagaggcatgaggtaagcaaaatatatctttgattttgactttctgttctctctcaagtagagagaagcaggtcagtgtaactaaagggcaaagaatttggagtgcagtttagttcttgctccagtggttgctggtatgtggatgtgtgtgggtcatgtcaactctgtgttttttctgaggatactgataaggttcattaaaagtgtatttgaaaggtgccataaaatactattaaatcattctttcttctttgcctgttttacaaacagaaaagaaactcagtatagtttgtctcaagggagattactatattgttacctattcacatccacagtcatacactgtgactaaccagttatagcctacagtctacatgtggccaaatgtttcagagtctctaggagatagaggaatgctcccctaggaggagttgaggaatgcattttcaagagaggactgataatatttctaagagagattccctgattgccttcgatatccaagtttgggcatctcattgccaaggttccttctcctggcctgcttcctcagtctttctccccagctgttgagggctgtattccctgtccaagctcctcctcctttccaaattagttccaatcagttcccctggcctgtccccaccactcggtcagctcgctcagtacttctaaacctcatgtgtctgctccgtatctctgttcttcagagccagtctttctgtatcttcagtctagtaagtgctgctttcataaactagacttaaaatttcatcgcattttaataaaaagtaattactttatatatgatctttaagcagctattctcttaaagaggtactaaatggtgagactttctggtaagggaagaagagagaatgatgccttgaccagtgtttgaggagttaacttcttgagaaaatattgcttacagtctggtaccaacatattattggcagtaatattcattaaacattgttagcatattcgtagtctctaaacaatggctttcaaatattttgactacaactcataataaatacattttacatcctgacccagagcacacatatatgtttatgtatataaaaagtacatctaactaaaaaagattcatttaaaaaaataaaactcctagccttacaactcactaaaagattgcaaccagcagtttaaaaaaccgtgatacataacatgtccttttggcaagtttgaacagcaatgtgtttggtggtttatgttactcgctggaaaacaagcgtttttgaaaccattatagtgttgaaagaaagtataacaaataatcttagattacagttgtctgtgattattccaaatctgaattttccattcctgtgttatttttctcagggactaaatttctaaatgtgattttgtagcagatgaatgagacagggaaagtaaggctattgtttttatgaaatctaggctacattttattccaatcttgtttctgatatcttttctcttaaattgatgttatcattcagcttccattaagaaatgacttctgcatccatttgccttgtgtgtatatgttcacaaatgagtcaatcatatttcattccttaatttctgtagtgagaaaaactgtccatcctaaaggaagaacttgaagaatttcttgctctcctaatggtttttcactaaatccaattctactaaacatgtcattgttaggaataacattttgttttgttttatttcaaggatatgcttcatcatcatcattaccaccatctaaatgcattgttggcagtatggaaaggcaacaataatctttaacatttaaatattttctagtaggttacagatgcattaaatattccattttgtcttagtgaacaaattcaataaatgaggctaaatgtcttatgaagctaactttatgtacttaaaattgaagaatatgaatataaaaatatactatatttaatccatctttagttaatttttgtaaggaagaggtctagtttaagtcttctgcatatggctagccagttatcccaacaccatttattaaatagggagtcctttctctattgcttgtttctgtcgactttgtcaaagatcagatggttgtaggtttgcggcctgatttctgggctctcttatctgttccattggtctgtgtgtctgtttttgtaccagtaccatgctgttttggttgctatagcaggtagtgtgattcctccagcttggttctgtttgcttaggacttccttggctatttgggctctttttggttccatatgaattttaaaatagttttttgtaattcagtgaagaatgtcattggtagtttgataggaatagcattgaatctataaattgctttgagcagtatggctattttaacaatattgatttttcctatccatgaacatagaatgtttttccatttgtttgtaccatctctgatttctttgagcagtgttttgtaaatctcattgcagagatcttttacctccatggttaattgtattcctaagtaggtagtttatttatttatttatttggtggctattgtgaatgggactgcattcttgatttgggtctcagattggatgttgttggtgtataggaatactattgatttttaaatattaattttgtatcctgaaactttgctgaagttgtttatcagatcaaggagttttagggtagagactatggggttttctaggtatagaatcatattgtctgaaaacagggttagtttgacgtcctctcttcctatttggatgccttttttttctttctcttgcctcattaccctggccaggacttctagtactatcttgaataggagtgttgagagagggcatccttgtcttgttccggctttcaagggaaatgtttccagcttttgcccatgcagtatgatgttgattgtggatttgtcataggtggctcttattattttgaaatatgttcattcaatgcctagcttgttgaggtttttaacatgaaaggatgttgaattttatcaaaagccttttctgcatcttttgagttaaccatgtggtttttgtttttagttctctttaggtgatgaatcacattaaaggcataaatgtataacctaaaactataaaaaactcaggaggataacctaagaaataccatttcagacataagactgggcaaagattttatgaggaagatgccaaaaacaattgcaacgaaaccaaaaattgacaaaggagatctaattaaactaaagatctgcacaccaaaagaaactatcaggagagtaaacagataagctccagaatggtagaaaatataaggtctaatatctggaatctgtaaagaacttaaacatatttccaagccaaaaacaaacaacttcattaaaaagtgggcaaaggacacaaacagacacttttcaaaagaagacatacacatggccaataagcatatgaaaaaatgcccaacatcactaatcattagagaaattcaaatcaaaaccacagtgagataccatttaacaccagtcagaatggctatgattaaaaagtcaaaaaataacagctactggcgaggttgtggagaaaaacgaatgcttatacactgttgatgggaatgtaaattagttcagccattatggaagacagtgtggtgattcctcagagacctaaagacagaaatatcattcaacccagcaatcccattactgggtatatacccaaaggaatatacattgttccattataaagacacatgcatgtgtatgttcactgcagcactattcagaatagcgagatatagaatcaacctaaatgtccatcaatggtagactggataaagaaaatgttgttcatatataccatggaatactacacagccataaaaaaagaatgagagcttgttctttgaagcaacatggatggagctgaagccattattgtaagtgaactaacacaggaacagaaaaccaaatatcacatgttcactctcacttttaagtgtgagctaaacatcatgtacatacagaggggacaacagacaccagggcctactttagggcagggggtaggaggagagtgaggatcaaaaaactacctatcaggtactatgcttgttacctgggtgatgaaattatctgtacaacaaacacccgtgacatgcaatttacctatataacaaacctgcacacttttaggtaccgctgaacctaaaagttttaaaaacagtatatattatatactataatatatatatatatatatatatatatatatatatattccatgctgattaaagaaagcagttttgtcattaaagaatgacatttttgcttatcacttgagaataatgtgcctgtttatgccaatgtagaaaatagactctaatttttcattcaacctatgcattccacaaagataattcctgagggttagaaatgtacatagacacaagaagattacaatcaagagaggaaacaggtttataaaaaataattaaaatacaatgtgatcccttagctagaccttgaaagacatgtagaggggaaattattccaaatgagacagcagttgtgagaaacaatatcaagatattttcactctttctagcctggcataattaattgtgattactctggcaagtatgacatcttctaaatttacaaaaacagctattttgtcattgagggaatcattttttgctgtgctgatattacaataataagctggcttgtgtcattgcagaaaatggtctgtaattaaatcttcctgaacttctaaagagcagtttccacaaaatggctgtatcttctaatttcctttccattttctcagcaagacatagtccctatgacaaaagtaagattttttgaatatatttctcagtttcctggcaaagttgctcatttgcaaagtcacacacccagcccacagaaatttaaaaaaaaacatattttagtcattcatttggcaatgctttttacacaaacaggtaattaggaacactgaaaagacttaaaagatcctcaatctgaagtgataacgctcagagtatgtattggataacggcagtaagacagcagtccccaccaattcttccttctagcttcaatccccatatcttcctcccacctaattccttcccaggttttaaaaagaataaaagactttaaaaaatgaatttgtggcagtatggaatttttatttatttgcttatagcatgtctccattactttaaataccataaaagcagacatctcatctgtcttatttattcctctatacctagcacatggaacaatataaagcatgtattacaaactcaacaaatatttggtgaatgaatgaataagtgaaataaatcaatattaaatgaagtaaatcttctccttggcaatcatacttttcataaatatgaagacattgtcacactgtcattcttatcaaaagtaagggagagggaaatgagcattttgtgattgtttaaacattgcagtcaacacttattgaacatccactacttcttacataaagataaatagagatagtccctcctctcagagtgtagatttagatggggttgcaaatatgcaaacagataagtgtcataatattgatcttcggtaattataaaatttacatcttcagttttaactattcagaagtgatctcagagtagttatatatagtaaatatatttttgcctaagcatgcatgcatttaaatcacccatgctgcaaggcttgagtagagagctagtcagtgattttagattagtgttcaccatctgcacatccacatggcttgtgttctgtctcattcttagataaacattttttgggaaaaatgatttgatgctgtggcatcatgaattcagggatttccaaatatttgtttggagttccaaagaggtgtcttctctatctcttcaggagaattgtcagagtctactatgatatatatgtactaaaatacaggaatgtacaagaaactgggatagcagagaggatgggatgataaactgtggctagtaaagggtgagagaaaggagggcaagaagtcaggagatcgtttgctgagaagttgtatgacacgagtgttgaagattaacagatcgaataggaaattgttaggtaattaaggtaggtaggatggtgcaagaagaagaaatagcatgtataaaatcccagaaatatgaaattatttggggaatttagtaaacaagaaggcatgcggtgttttaagagaaacagttataaaggtgggaggagcatcagatgaaatgggacatttacgaggagccaggccattaggcattatgacttcctttcacagggatctctagatattattagtgggaagttgggagccattgggagattctaatttgggagaaacctgttcagatgaatgtcttagaatgttttagaaagaaccatttggtagctgtgtattggaaatttgaaggggaaattggctggagtcaggtggagaaattagattagtgtgattggccaggtaagaggaggaaaatccctgctaaagtaggaacagtaggaatggagaaaagcagaaaatatggagacatttagaaggcaaaattggcaagatacttcctaagcgattttagtgtacaaagtctagtttctgaatataagttgtttttccttttatttttaagaaacctgtgattttttttccataaatgtgtatatcttttttcactgaattctttttaaatgactggagcaaaggagtccttgaaaaatgtgacctgagtaccgtgtttagtagattgaaaattcttcaggggcataagaaattaagaatgtggttttcttccaagatcaagaagctaaggtcatctaatggagaagttcatgtcatccatcacatgttctcatcttgcagatgtggaaaaatgccagtggctggcttctgtttgacagattcagtgagcctgcttcagaggactctgagccaggaaactctcaaggtgggctgcatcccacaggacagctcttgaatttggacagctcttgaatctggtctcatgttgtcaggatgacttggctcaccacaacgtggatgtccttctttgtagcttccttctttcttcagaccttacacaggccctgctatgggaatggctcctgtcctaacagatttgcgttgatatcaaggactccttttttccacactttacctcatacttcaacacttgacttcttgtgcatctcttgcttcctagttttgttctgccattttgttctgaccaacagtcccaacctgttggctctaaaatttcacactcttcacttggcttcaggtcctcggttttaccccgattacgaatcttttaaatattcagttccaaaattattcatccagctctttttgtttcccatgccacatactctttggtaagtccgccacagccagaacatccagaaccacctcaaagctggtatctctcaattcagatttaactcttccattcaaaattatttcacaatctgccaccacctttatctcacccaaagggaacttgttaattttcctttagctcttattccaatccatgacaccaacccactaagccaggtttgggacacccttctttgtaatgctatctcttgtctttaatatccagtcagtcaccaagtcttatcaatttttctcctacatgtgtctctaatcagtctccttctttccattaccattaccacttaaatgtcactaaaaacttttagcctgtagtgtttcctgcccacccgcctaaggtcattctccatcctgtagcccatattaatactctaaaacagaaatacaatctgtcaatgtgctacttaatttttgcttgcttacccaatatatatacacttattgatctgtttttctgtggtttttgtttttgttttgttctgagatggagttttgttcttgtcgtccaggctggagtacaatggcccggtctcggctcactgcaccctctgcctcccaggttcaagcgattctcctgcctcagccccccaagtagctgggattacaggtgcccgccaccatgactggctaatttttgtgttttttagtagagacgaggttttaccatgtcggtcaggctggtctcaaactcctgacgtcaggcaatctgcctgcttcagcctcccaaattgctgggattacaggcgtgaaccaccacgcccagcctgatctgctttttatgtgtcaggcactgtgggaggatgcagtgttatcacaataaataaaatatacttagtcaatcttatactcttgatgcctttcagaatctgttaaaagcccttacagttcataaaatcctagtctgttccagcctaccagctgaaaaatggggtattgcaatgggtaagatctacttttcctcgtcctctccctgcccccagagtactgcacagtctgtggatgggtatataaaaggaggaaaaaaaaaaaagatctggagtaagaaactagagtccactgctgtcattttagtagtcactggagagtcaagcatttaattaaacatgcaaatgcctgtcactgactacttttaagctcataatttaccatttcaaacatttggctcaaagtactctgaaatattactaacctccatcaatgggaacaaatactttattaatattgtgataaaaagtaattacatattaaaatattaccatatactatacatgatactctaccatggcttcatttttgttttgataatacctttacgtgattaaattaacttttaaaaatatatttttaaattgaactatttggtataattctgataattttagaatatgtatactctcctaaatatacaccatgaaaataaatatcacagttagaattttagccaataagaatttatgccaataagaagatacatagaaatatcataaatatctgagttgttctctaccaaaataaaggatttcttaaataattcagtctgcaatcctaattatttctgcacagtgtaattaaatttctattgtgaaaattaatattcttaaaaagtaataacatcaattgttgcaggcttctttttaataaacatctacataaggtgtctgtatacttggagatatgcttatctgagtaggagaataagatttggtggtaaagctaatctagtaaatgaaatcaaatgagataatagatgcgaagggcttgacacagagtgttgcacactctaagtgctcagtaaaatgccagagatgatgaggatagtgatgctcacatctgtattgtcaggttatctcgttatcctcattttacacatagagatatgaaagctgcgagagtaacaatgactcactcataagggcaggcagataatatattgcataaccaggagtgaaacactgatttttcaaataggcttaaatccaagactcttaaaccatgctttgagcaagaacttctcaggatttgaaaaataaaaagccttgataacccagtgtggttggaataagcactcaagagcaagagagccacagcttcctcctgtgtaaacaggataaaggcacttaagggcaggtgaccagagagagtgagatggggccggagggaaggatagggtgatcagattcagggattggagccaatttttgtggatctagctacgtgacaatatgaaaaatgaacccaggtcaacaaaagttccttactgggttatagtactcttcttccttttaacttgagaagtagaagggtctgacaaattgagtctgatgaataaactcttgtgttggccaattctgcctgccatgtgcccttagactgcttgcagggctgaggcccacagtagctgtcctggccttttgctgtgttactggttcctggtgtacatctctgaaagggctcaggccacccttagataattccacaaggcaggtgccatggcttggatacactcacttgacccaagttagcttgttctgtttattcatgtggttgtttttaacttggtagaaaaagtaaactgaacgggaatggaggaataccttaagcaagtttctgtcaaattattatttacttaaattcattttttaagaaactccctctacgaggtgaaacagttgaagaaaacaaaatacatttcaaatatctaatttaaaaagcatattaatttatgttcaaagatgttttaagaagtggtttaaattcatatttttactttttttttttgagatggagtttcgctcttgttgcccaggctggaagtgcagtagcatgatcttgactcactgcttcctccgcctcctggattcaagtgattctcctgcctcagcctccaaagtagctgggactacaggcatgcgccaccatgcccagctaatttttgtacttttaatagagacagggctttgccatgttggccaggctggtctcgaactcagcctcaggtgatctgtcctccttggcctcccaaagtgatgggattacaggcgtgagccactgagcctggccattttttacttaaatattgagtcactgctgtgtaccaggaaggttctggtgggtgcttggaatattacagtgagaaaaatgttgttatatctttgttttcccagaagtcagtactaagcaaaggagacaggtaatgaaaacaaaacaaaacagtcaaaataaagtgtaggaaatgttaggagagaagaatcgtgaatacagttcataccagggattcctaagttcctgatgaaaggcttcccaaagtaagtgacttctaagctgtggtctgaaaagtgagaaactatccagctagatgaagggttgagaaaaccagaggaaacaacttatacgcagacatggagcagggatgatggctaagctgggcctctgtggtgatgagaatttctcaagagaagtgttggggcacagtcagaggaaacaatcataaaggatcggggagacaaacagcttgctgtgttttaagatatgcagttgactttgtatcataataaaatatatcaaaataactattttaatagtcctataaaattacacatatataaacatataaataatagtgataaattcatttgctattgaagatattgctttggttaaaactacatatttcttattctgaatttcacatgtctgggggaatggggtcaaaacaaaacaaaccagtgctaaccattctggttctatatgcaaagggattccttaaaattgacattgtgtgcaacacacacacacacacacacacacacacacacagaactggtctttgatgactattttgtataagttcttcatttagcaggtgctctttctgaaaaagaaaatttcctatttttttttcttttgtttgcttgaatgggatcgatgactggctaatcgtaaataaatactaccaagccttttatttcaaacttcagagctttcttctcaaagcccaggttaaaagaagagtcccagttaaatcaagtgacatattctagtccatagatttactggttcatggttctattattcttttattttgtactaagggcactatcaaaataaataaaaacatcacagctgtactgaaacactaaaagaaaaatcttgaattttcagtagtgattttagaccccactaccaagatttttttttctttttgcagccattaactagttttttaaaaatagctaaatttgggaggatctcaacatacaattttagaaagtctagtctgagattactttatcagttattggaataatctgacaagcagaagtaggactaggaataaagcattgattcaagatttcttgtttaaatggtgcttctcattctttgtttgcaaatcttgaggaatacaaagatgaatgagcatccagtccctttggtgtcaaaaatatcatgctgcaagtatttagaagagggaaagaggaacatttgtgcctggcatagcatttcctttcattttcatttattcttctgcttattaattcacttattcagtcaatcaacaaacatttaaagattgcctactcaatacaaaatccactagtgggtgttgatgatgcagcaatgatttggcactgaaaagaaacttaaggtaatggttctcaaaatttgagaaatctgtgaacttctttgaaaaggtgataggtactatggatgcaacataggcatatctgtgctcataacttcagtggggctgaggaggatgccttgaagcccaccattggattccttgggacttatgaattttgcttagcaatttcttaattacagttttgttcattgtttgaattttgccatccaatccaaagcttttatccttattataaggttgatttcgttttcataattaacccctaaaagtaatattgggtcaaatcttaaagacacttctccagttgagagacctactgctgacgttaaagaaccaacctgctcagtaaaatgaacatgagcgccatctaatgcccaaacagaataaatgttggtaacaacattaatacacagaagattagagtatggggtgtatgtacaaaggaattaactttgttatcggttggttgactcatttctaacacttgttaattattttttgatattatcattttcaattattttatttcacataacagtcccttactgtctgaatttgaagataagaaacatttttaacaataagaaacattttgttggccaggcgcggtggctcacgcctgtaatcccagcactttgggaggccgaggcaggcagatcacctgaggccgcgagtttgagagtagcctgggaaacatggcaaaaccccgtctctactaaagatacaaaaattagccgggcatggtggcgcacgcctgtagtcccagctactcggtagattgaggcaggagaattgcttgaacctgggaggtggaggctgcggtgagccaagatggcaccactgcactccagcctgggtgacagagactctgtctcaaaaaaaaaaaaaaaaatttgcaaatatgtcctttttattggtggagaagcatatgacttacatttttaaataaatttttgattttagaatgtttttcgtttttcagaataatttgcaaagatagtccatagaatacccaagtatcccacacccagtttcacccagaactaatatggtacaattgttacaattaacaaaccagtatcaatacattattattagctaaagtctacaatttattcatattttcttaattttcccctaatgttcttttatgtttcaaggtcccatctaggacaccacattacatttggtaatcatacctccttaggcttagttatgacagtttgatttacatttgatattgtatgtctttgaattttattttagctttctgttatttttcaaaatcttaaaacaatttaacttttcagaaaacactttcccttgttctgttcccttgataacactgcatgactatttaatcagttttataggggtttgtataaacatacattatcattatgcatcgttcatctctaataatgaaaaaaaagggttaagaaagaggattatcaaaatgtttaacttgccaagattgccaatataatacaataaataaatgatgggtcagattccaaagcctatgacaccttccaaaaagctaacacatcttttggcgtgcataagcttaaaatgccctccaccccagcaccatgctgctgcaagggcttctggaatgaccaacgcccaagacaaagtcgtttgcctttggagtcccattgcccctcacaagcactttttattttatataaaaagtttatataaaatgctctataaatgagcctgggttgccacccaaactgttttgtgtttgccacgaaaacagatgtgctgaggtctcaaggaaacttctgtcttacactaactggaatgcattaagtctgaggagggttcacagttctgtcctagttgctaatattttaattaaacatatatttttgtggcctttaaaagccatcaggagatataaaggaatatttttttgataacttcagtgtcctgggagcaaaatggaatattgtgtttcctaattgaagaagtagtatatatgtgtatatggatgtgaaggaatttatagaatgctggcgaaaatgatttcctgggcaaacagtagaggtatataaattacttggatcctgcagtattgattatttgtgaatatatctgtaaaacattaagtgatttttgtacactcatagatttcaaccttggatgcatattagaaaccctagggagggttaaaaatcccaatacccaatcttcattccaaaccagctaaatcttactctccagtaatcaaattcaaaacagcaattttaaagctccccagttgattccagtgtgtagccaagagttctacattgtaactcaggggtttaatattgttcctgtacttttattctgcagcataaacttagctatgctatttattcttatttttaaaagaaggtatggcttacgaaagatgataagcattattatgtttaacaatcaaactcattattaaaattcctttttttcttatacttctgtcaaatgcattgttttttctctgagtaatttagatgaatgaattaataactgataaacacacatgtaatactatgagactcctttcctaaatccttttatctattttcaaaggattttatttctacatatttaaagttttttaaatcattttttaatttgtgcttctatgaaatttttttcttcctagaaattttattccggattatctgttaagagctgcattttgacagaaaatgattttccttattaactgagtgaattgataagtaagtaggaatattttccagtggtagtctcaagatagaaacttctaagagctttgaagttttagcaattaacagactttattaaaaatgaagccactaacaaggatattaatacaaggtagatttcaatctgggcaattatacaatatagacgtctttattactaactaaaatatcacagaatgatttgattaatgctataaatgtgattagtagaataagtgtatccttagtgccattggttagatagccaaagactggatgtcagagaaaggtttccaattcttttctacatatgagaatcaaaatcaaattatagaaaaaagtcacaattgttttcttgaattccttaaatatgtttttcatccttgaattctgctattactcttcattatagtggtcagtttgtgtgtgcttcaagtatgtcactatgttgttaaatatgtcagctgtctacatttctaacacaaaatgatcttttttttcaaccgctaagttatatgctggttatttctaagtacatgcatattcaatctaagtatctcagttgatttaaatcagtttcttactttgaaaagatttttaagactttttttgcacagaggtaaatttcagattcagcttataggccttaataataacactcctacagactgagtcaaatttaaatatcttatcaggtattaaatatatttaaataaaaacatacacattaatgagtgccctgtgagaaagtggtggtgaatttgagccatattgctatatccccacagcaatatctgacattttattcagtgccatcagctatatgattctagacatgccctcctaatcagtggtttgtagggttttatccttcctcatcagaaaatgtaaacaagattacaaacccactttcttccccaactgtaaaatattaattatttaaaattttaccgtgttttattttatacaagtgataatagctcatattatatggtctgaaattaccagtgatgagaataattatttggtcagatactttctgtaaagttaaatttatctatgaatggtgcttctgtaatgttgacagtaaatacagtaagatattttgcccaaagtgctgtttgtcttagtgtattacttgatgtgacattctgacaccatcagactggaggctgagtcctctgataaaaagaaaaatgccacatagccacagaaattatttcaccctgtttccttgcacatctgggaaataagcaaaaattgtaaaagctgctagagtgagctgattgttttcttcctaagaatcttgagctttcaaaatttgaatttaaaataatggactttcttgtcagaaaaatattgattattaagaaaagaatgagacaaaaatgtaaaaagaaattttacttacctaattttattaaaggagtatttaataaaactttatgatacattttaactaattctggtgaaaggattaaatatttgtttcacccttacctcacaatgtgcacaatgattttaagctcctttctgttaaagcagttaaagacttttccaaagtctaaaatcttaatcacataaatctaaaagcaacacttaaatgcaaacatgagtgaagagcttacgggctttttctactaaaagactttcttctttttctattatagacctatttgaatttggacatttttcttgcacaaataagactgtttcaatacaaatttgaatgtattaacttgctagctcataatgttactcatggtttcagtttgacttgcacattccagaataaatctatttacttaattataaatgggtgtgtgtcattgtccttgacaccatgagaaatataatggctatcaggaagtgggggaaaggaacttagatcttttcgaatgtctactatgggcctgttgtttctctcagttgattctgctaacagcccacctaagaaagtattaatcatgccaagaaggtattatcattattatcttatgaatgaaaacttcacagaggtagctgaatgcctaaaattcacacagctagagtatcttttaagagtccttcttttgcaagtgacaaaataaataagctggcataaacaattaaaggaatccactgactcaaataacagaagcccagaagtaggactagctctctaagaggctagatatagctgcaaaattgatattaccatgaacttggcatctctgttgttctctttggtttcccttcccagcattggccttatcctcaggctctacaagcggatctgctgcagccccagtccccctcactctgacaactatggtgtcaaattggctctagccgttcactagaacgctgtaccgtgttcacaaatgtatcctgcactagctgggggaaaagaggatctctccttatagctctcttataattcctgagatttactctttttttttttttttttttttttttgagacggagtctggctctgtcgcccaggctggagtgcagtagcgtgatctcggctcactacaagctctgcctcccgggttcatgccattctcctgcctcagcctcctgagtagctgggactacaggtgtcctccaccacgctcagctaatttttttgctaacctcggggaactgtcatacccttgccagtttgggtctgttcctggacctgggggtggcgtcagtcccaccaaacctgcggagctgagaacgggagaaagcgaattgcctaaagaaaatcacaatgctattggctggaaaatttctaccaccgttaagtagtagagccaggattggatataaagtctgcactgtgtccgttatgcaacagaactaacaggacataacttcctccttctgtttacaactggcatctagtggtcagaggccagggacagtaatcatcctataatgcacaatgcaggccacccacgaaaaggcattatccaacccagaatgtcaatagtgccaacactgggaaaccctgtgctatatgatctgctgtggggcatattccctcagccttacaaactgcctccctcccctcttctttaagcagcagctaccttgaggggcctcctttcagttacaaaaatgtgccaaagctcttcaggctttaggatctttgaacattattttcactttacctggatgttctcctcccacccctctgactacagctgcatcattctttccaaacctagccaaaggtggggaagcattgagctcaaagagtattttcttgagaaagactactgattctccagagtgggtcatccccacccacctgtcagtagtgccctgccctcttttatactttaactttgtagcaatgatcataatttcaattagctattgtatcttttacagcaaatgaaaactctaaaacaacaaatgaagacttatttctgtttatactctgagcacttagaacagagtctgtgattaagattggatgtattttagatgaggcaatcaataagagtaaaagctcacaggcttgaatgcagcaagcagtttagggagtgtgctgagtagagcagtcaggaaatatttagtgtagaaaagcatgaacagtaagatggagaagggatggaaggtttctggtgttggatttaataattgtgtaactagtattttctgagtttcaattggaatatgctaactcttctgtgtagatgaagtaggtaaaaccagattaaatctgattttgtttatctgattaagtctgatgggcccagaagaaacagcctgaggcatcacttaaatttgggcattttttataatgcgctgaactcggagccaagtgaactaagatctagagctgagcctaacactaatgtaatgttttcattgtgctcttttgagcttcagtctatttgtaaaatgagggagctggactaaaggatccgtgccgccctcctaatccaacactcctcctttactaagctaaaagagagttttggcttgctgagatggaactgtgcaagcattctacttttaaaagttgcaggaggaattttttttaatgcagttgtttgtgaacctggtaataaagaagcagaatattgtgagaataactgaatcttttgataattggggactttaacgtgtcccagagttttgcattattttatacattgaatatataaaagattgggtgatagatagcctaacctcacgatatatccttaagtttttgtgtttttcaataaatccctaggacaaatattttttttccatgaacactctcttaaaataaagtctagtatgctttgtcaaagctttgatcagatgaaagcatttatatttctgtttatcctcgtttaccaagattaataggttgctagaggtctgagtacagagtttctcagtcttggcactgttgatatttggggctggaaaattcttttccagggctggggagctgttacaggaatttctaactctaacagatagatgccagtagcacctctccctcccagttgtgagaatcaaaaatgcttccagacattgccaaatgtccactgaggggctcagatgacctcaggtgagaaccattggtttagtgcaaagtaatctcctttaactagagcatactggccagatggatgcaaatattactgcttggttaacccatttaaacaaagttaaatcttgcccaaatgaatgtaaagccctcattgatagttaaatgtatctcactgtttgtcttactgctagatactcttggcacattctgaatgagggaatcagtgacttccttatataggcaacaattcctgggaaatctcaataaattatcagaagaaatgcaaaagaaaacagtctgctgattcagcttgtaagtttccagtggtatcgccttacttcccaaactaaataattctctgagtcctgttccatgataggatagtgactgtgggtcagtgctgtttatgtggttgttgatactcttgtgcctcttttagatagttttctaagagacaagacttttttttttaatgactgttcctctctatgaccctctgccccctcaaggatatcagagtttttgtcttcagcatttttcgggttataataaattataattctaaaaattaggctgaaaagaaagcctcaggtcttttgaaaggaggcagaaatagaactagataagcctttcaaatagttggtatggagtatggagtttgttttttttttttaacagaaaagaaaaaaaagagtgtaaaatgtgtcagtgtaatactcacttctgctctcctcctgcttgaaaagatcgctgtagtaattagaatctcaaacggacagtcttagcatctaaagtttgggtgtacttctagcaaacatgcattgcacaagataacaatataaattggccttctgaaagtaaacaaacccaaagaaatatactaatgttgggctgggcgcggtggctcacgcctgtaatcccagcactttgggaggtcgaggagggcagatcacaaggtcaggagatcgagaccatcctggctaacaaggtaaaaccctgtctgtactaaaaatacaataaattagctaggcgtggtggcgggcgcctgtagtcccagctactcggaaggctgaggcaggagaatggcgtgaacccgggagacggagcttgcagtgagctgagatcgcgccactgcactccagcctgggcaacaggacgagactccgtctcaaaaaaaaaaaaaaaaaaaaaaaagaaacatactaatattgtagtgtgctttgctgattttagagaaaggtgctttacacttagtttgtttaagaggaatactgctactcagcatgttttgctttcagtccaaatagagaatccctcatcagaaacaggcttaagtttttcaaatagtttactttttttaaaaagtaggtctcacttctgcttccagccaatatggagtacagtgactagatttgcagtctcatctttaaaaaaactttttaaaatcaggacaaaacatacaaaagaacagttttcatgacagtggacattagacaatggaagatagtgattccttagagataagaaacaaattaaatgagccctatgattgtcctagctaaatgccttgagaggcatccaggctgtggctcagggaggggcaaaccaggagatacccaacaaacttcttgagttgaagagatggagctgagagtcttgggagaccaaggaggctaaaggtcatagacagagtatcagagaagtaagagttgcaaaaagaccctctgacatcttccaaggatcctcattacgtattctgcagggtagtgattagtgcacatatgtgaagaaactacttgagccctggtgtgagggagatacccaaaagatcagatggaaaagcacctagcacttatacaggacttggaaaacaatgcctgtttccatcaggcagaatggaaaacctcataaatcaaggacactgcagagagtactcaaggttcttgccttagtaagggagggtaattagcccttcatgaaacactgttccagtcttgcctaacaaatcttaaaagcaagacttgaaaggaacaaattttttccaagtcattaaactgcatcccagaacaaagctcaataatatttatgagattataaaaatatccagcacttaagaagtcaaatttatgatatctggcatccaatccaaaattactagacataaagaaaatctgagacatgggactcataatgaagagaaaaattaatccaaatggataggtacagagctgaaacagatcttagaattagcagacaagggcattaaaacggtgatttttaactgtattccatattttcaaaagctaaattgatacctggaagatttttaaaaattccaaattgaacttctatagaggaaaattacaatgtctgagatgaaaaatatgttgaatgtgattaataacaaattagacattgcaaaagaaaatattataaatttgaagacatagcaatagaaattatcccaaataaatggagacaattattttaaatgaatagatcatcagtggactttggaagtaattcaagctcctaacatatgtgtaattggaatctctgagagggagaggtagacagaaaaaaatattcaaagaaatagaaaattaccaaatttgataaaaactataaacccacagatccaagagctcaacaaacccaaaacacaagaaaaaaacatcaaggtaaatcataactaaattacctaaaactgatgataaaagaaaaacttaaaagcaaccagaagtaaaagatatgttatatatagaagaattaagataaagatgatagcagattttttatccaaaatgatgcaagatgggagccagtggagcagcatctttaaactactgggggtaaaaaactctttaaacctagaattcaatatgcagtgaaagtatctttcacatatgaagacaaaattaagacttttaaacataaaaaagcagagggaatttattatcagtgggcctacagtataagaaatatttaagaagtcctgtaggaagaagaaaaatgataccagatacaaatggatctacacaaagaaatgaaggtcactttaaatgataaatttgctatctttccacatcccatgagttggaacatgagggtgctctggatatgtgccaagacatgaagaaggaccaatgaaaaggaccaggtccttgaattactgaggggaatagagcagcctggcaatctggatgacccatctaggaactattattgaaagacaaataaaagtctatgttttcaaagtatctatattttgcagttttactgatactaccaattgtttcttaattaatacaattatttttaaagctgtgaagttatgtctgctacatcaagatctttaatttacttggaatgttttttccacataaaacaaagttgatccagagcattctaataaaaaagacatctttttctcacttatctgaaatgccaactcttttataaatctagcacctacatatgcatggcagcctttctgggttaaatgctccatttgtctatttgtttatatgatgctatccatgcactaattagatatgtttatggtagggcaaatactgtaacttgtcatctttctcagatatatcttgactctttctaccatactgaattttcaaataaattttagagtcaattttttaaaagtaggtgaaaaggttataaggggatgcagctaggtcacattagtttcaacctatctttttatgagttgatatatgcagaagtctccagccccaatacaagggttgttctcagactgacttttttccttacaaccagagtggcaaagagagcctggtggtgaaggggtgatatttggctacttggtaggcatctaggggtcaggtttcctccctccaaggaacactctacattcccctagaactaaggatatcatctcccacttgttatccattcgcttcagttatttggtgtagactgtgtcagtataaccccattactgttatcgtgtttaattatataacaactgtacactgagagctttttcaaggcatggaccagacagactaatcagagagtaaatacacagcacttaatttactcttcagaatttttaatcaatgcctattgactgtctcaagggttgaagtctctattttaactccattttaaaatggagttaaatggggaattcagccaatttattcaacatttatcactaatgttgaatacctgctttactctaggtactatactaaatgtcgaatattcagcagtaaagaaatatatatactatatacatgtatataatatataactatatattatatatataactatattatatacatgtatataatatataactatatattatatatataaatatattatatacatgtatataatatatataactatatattatatatatataactatattatatacatgtatataatatatataactatatattatatatataactatattatatacatgtatataatatatataactatatattatatataactatatattatatacatgtatatattatatataactatatactttatacatgtatataatatatataactattatatataactatatattatatacatgtatataactatattatatataactatatattatatacatgtactatatattatatacatatagttatatacatgtatataatatacataactatatgttatatacatgtatataatatacataactatatgttatatacatgtatataatatacataactatatgttatatacatgtatataatatacataactatatgttatatacatgtatataatatacataactatatgttatatacatgtatataatatacataactatatgttatatacatgtatataatatacataactatatgttatatacatgtatataatatacataactatatgttatatacatgtatataatatacataactatatgttatatacatgtatataatatacataactatatgttatatacatgtatataatatacataactatatgttatatacatgtatataatatacataactatatgttatatacatgtatataatatacataactatatgttatatacatgtatataatatacataactatatgttatatacatgtatataatatacataactatatgttatatacatgtatataatatataactatatgttatatacatgtatataatatataactatatgttatatacatgtatataatatataactatatgttatatataactattctatacgtgtatataatatataactatatattctatacgtgtatataatatataactatatattctatacgtgtatataatatataactatatattctatacgtgtatataatatataactatatattctatacgtgtatataatatatactatatattctatacgtgtatataactatatattctatacgtgtatataactatatattctatacgtgtatataatatataactatatattctatacgtgtatataatatataactatatattctatacgtgtatataactatatattctatacgtgtatataactaactatatattctatacgtgtatataatatataactatatattctatacgtgtatataatatatacacgtatataatatataactatatattatatataactatatattatatacacgtatataacatatatttatataataatataatatattatattattatatatttatagaatatatattattatatatataaatatataataatatatattattatataaatatagaatatatattatatatacatatatataatatatacatagtataatatataatttatataatatataatatatataatttatatatattatataaaatatataaatttatatatatatttatataatatatataaatatatataaatataaaaatatataaatatatataaatttatatatataaattaatatatttatatatattatatacaatatagtatacaattattaataactatatataatatacatgtatattatatatagttatatataatatatagttatatatattatatacatgtatataatatatataactatatccttctctgatgggaaaatccaacatttaaacaaaataaacagaaatataaatatttaatttataattatgtttaatgctatgaaaggaacaaataaggttttatttaagaataactggagggagaaagtggagaaaaatatacttttcaagttagaccatattacatacagatgaaatctgatttaacctgtaacataaccagatttatgtagcaaattaaacataaattttttcatatacttaatctatttatttgtgtattcaatagcatttatcttctttgagccctataatgatccagctattaggctcacaaaaatgaccaggactcagttcctgtctttgaggagctcatagtttttttttattattattattattaattagcagtgcctttcattaaaataattgcataccaaatggaaacaaatatgttccttttcctctttcattcttctttagatgaggataggaattcactcaggctccgtgctggctggagttgttggggtgcgaatgccacgttattgcctgtttggaaataatgtcacactggcaagcaaattcgagtcgggaagtcaccctcggcgcatcaatgtcagcccaaccacttaccagtaagtgttctctggcctcctccttcctgtcttggcctttgttttgggctgctatgctgtcatctgtgagtccctgttctttttcttgatcctgtcattctccaagatattatgagtagaactgcccaaacccaaaagatagatagtaattgtgacacaaacttttatttgcactctgtgagagtgcatgaaaaatctgacatgactgagaggtgaatataggtttgtcatttcccacagtctctgtccttcttaagtatacctgtttaaaatacaggagagcaaatgttcttaaggatctgcattataatagaaatctcaatattttcaaaatgtttctgtttataaaaatggaagaaatacaatagaaaaggtggttggactgtttttttgaataaataaataaagtctttaaatttatatatatataaattataccttactcaaaatgcttgggaccacaagtgttttacggtttgaaattttttgagttttggaatatttgtgcatattacctggtgagcatcccaaatttgaaaatctgaaatccaatatcttccaaagagcatttcctttcagtatcgtgttggttctcaaaaagtttcagattttggagcattttggactttgggattttgaatgctctgctataccaggtacagagtaaaacattaaattctttttatcttaaagataatctttgacaacactacacatttttgcctcctgaattcattcttattttgtgtctggtagaaatttcccctattagatattaagccctgtatatgggcagcgactgtgtctctcacagtcataatgatgagtttggctcatcattatatccccaaacttataaaaatgtctagcccataataagcactctgtaaatatttatcaaattaatgaataaatacattgataagatggacattttcaaaattaacagcaaagaaaagcatgaaaatgtcttactttatcacactttggctttattctgggcattactgtacagctgcttaattaatttcatgttttaggtaacttagaatcatactgaaaaaaatgtatagtaggaatagtggccattgatttttctattaacatggttacaaaaaactcaagcagaaaatttgaatataaagataaaagttgactataataataaataaaatagtgatattttcaaacttttgataccaaattagagggtaatttggtatcagaaattccagagagggaatttaaagtttttagatgaaagcagatacttccagattctgcaaaatagatgagaaagaaaactgaaattacaaatataaaattaagagaaagtgcacattaaaaatacattttaaagctcttgctaagctcattaaagtagtggataccttgattttacagtttttgaataaagacacacctcttactaattttaaggaacccaagagattttgagggcctcacagacaacttctggacaaagtttcaggattctatctaatcattacttatctaagaactatatgctattttcaggatatttataagaggatttgcatcttttaaacttctcccaattttcccaacacaattctgggcatattacagatgatctgacaacaattaccatggcaaattgaattttgtcaaattctctagtagagatcagtgattctgatactttctgctctatacgatgaaaaaagttactgaagatcagctacctcactcatatcctattacatggttccatttattcccatcatggtattgatacttattttccatgtttgtgtaacttagtgtagatttatgtcttctgtgacaacttcacttaaaaaaaaaaaaaaaagatgtgtaaaagaatgggcccaacctgtgtgaggaggagttcatgccctgttgcttagacatcataacagtagctggctttgtttacatagtgatgtattaaaaaaaaaaaaaactctgccagccatacaagtctgtgcattttggtggtgactcagagtttttgtagtctttttcacagtttatgatgatccttagtgattaacaaggtctgaggaatgaaatcatttcaactactgcatacactgaagcttactgttgtgttattgttctgcaccttcacccccaggccccccaaaatcaaacagagccatagatagacacgttgagctgacaggtgggtagattcttagaacaaatataatttatgaagtaaaacccagtattaagctcatgagagtttgaaatctctattttatccctgaattacattctgtagaatgtccaacattacctgtttatcttgaaaactatatgattattataaactttggaagtggactgttttgatattatgataaactgaaatcattttttgaattgttcattccaaatgcattttgtcttaaatattcaaataattgaattttaaaaatatttttgtaactattgtggagtactgaaaagataataaaatatccatgatcctaccatagttaaacactttatattttgcttcagatatttcttaataaaaatgaacaaaacattttctttgtaattttctcagtctttcattgtgacatcctaatgagtttggtgtgtttcaaaggcccgtgttttgtttttccttcttttttttgagacgagtcttactctgtcgcccaggatggagtgcagtggcacaatctccgctcactgcaacctccgcctcccgggttcaagggattctcctgccttagcctcccaagtagctgggactacaggtgcgtgccaccacacctggctaattttttgtatttttagtagagacggggtttcatctttttagccaggatggtctccatctcctgacctcgtgatctgccctcctcggcctcccaaagtgctgggattataagcctgagccactgcgccctgcctcagtcccatgttctatatattaactttctacatatgtatccatgaacaatataattttattttacatgttttaattttcataaatggtattttactgtatgactgttatcactaactttggtttcttttaaacacaatttaatacttttaagatctatccatgttggagcatctttctttggaaattccaaagaaagaatgggtttggtaatttggtcgaaggtgcattttgagctgtaactaaaagctgagatagtaatcagtttattcctatgtgtttttattaacaaaagtcccttactgatgactgtctaaatcatagacagctctagctcatcattttaatcgctgtatgacatttcagtgtatgactccaccatattttaatatttcatacatatattcctctgttgatcaacacttcggtatattttctattttttaattatcacaaagtttgttcctgtgaacattatttacatgacattacaaaaaagaaatttttattgagttttaagttttccaaattagacattttcatttttcttcaataaatgtgtttacacacatttttgttcccatcatcccaatgatgggataagttttttatgggatatggattttaaatagtgcacataatatatgcaccattaatatatgcactttaaatagtgcatataatatatatatcatatatactaatattactttactgcatataatatatattttaaaataatgcatatattataaacaactgtcttaacatcatgctgctgatctataaaacagaaataattgcttatatgaaggatggctttagcaaattttgaaataaatgatttatctcagcataattattttttcttgctacagtgcaaactaaaagtgtagaaagacttgaattactttggtatgaaatttttcttaatctttaaacatttttgcttttctcattttacaattgatctacttccagatgttttagaacgcctatttttaattgactgtgaaaggcttctttctgttaaaaccaagcttcttcctaaccactgctacctgaacagctcattgtatgagagcatgtacagtcgagcagattaggcagtggtgaagtgcatgagctcagaatcaaaatgcctaaggtagaatccaggctctaaattttcctgtctacatgaactttagtgacttaatttctttggaccaagttatctcatctctaaaatgggtacatgtttatgaagattattgttggcatttaatgtgatatttttaaagctccttatacttggaacatattagacattcatttactgcttcatcctgttctttccatggaggaagaaaccatcttattccttcacttgaatctcataatttataaatttagccatgatgaatgatgtgtgctagtaggattacagacctcatctggaaatttgagagaaagaatgggtttggtaatttggtcaaaggtgcattttgagctgtgactaagagctgagatagtaatcagtttattcctatgtgtttttattaacaaaagtcccttactgatgactgtctaaatcatagtcatatgattaaaaattggctgtgtacatgggaaattcccaaatttaagctaaggtacataattaattcaattaatcacatgattaattgaattatgtacctctgcttaaatgtgggaatcatatatgtatatctatatacatatgattactaagtaatcattacttaataagtaatcatatatatgtatgtaatcgtatatatagtatataattaatctaattagtaagtaatcatatatatgtgattgcttactaattagattaattacttactgttggcttcaacaacacaaacattattttatagttctatagggcacaagtctgacacaggtctcacctagctaaaatcagcgtgggcgtcatgaggccttcattctttgctgaaagttctaggtgataacatgctttcttgccttttccagctttgaggccactctcattcctctgttcagaaccttcttcttccatcatcaaagccaataatagttcatctttctaattctacttctatcatcacatatcttttactgactcttcctccctcttctacttttaaggactcttttgtgattatgtcaggcccactggataatccatggtaatttctctattttaatgtcatctgattagcaatcttaattccatctgcacccttaattcatcattgccatgtgtattagtcaaggttctctagagggacagaactaataggatagatgtatgtataaaggggagtttattaaggagtattgactcacaggatcacaaggtaaagtcccacaatagggcgtctgcaagctgagcagcaaggagacagtccaagtcccaaagctgaaggacttggagtccaatgttcaagggcaggaagcattcagcatgagagaaatacgtaggccagaagactaaaccagtctaatctttccatgttcttctgcctggttttattatggctgtgctggaatagattagattgtgtccacccagcttgagggtgggtccgcccttcccagtccactgactcaaatgttaatctcctttggcaacactctcaaagatacacccaagaacaatactttgcatccttcaattcaatcaagttgacactcaatattaaacgtcataccatgagacctaacatattcacatttttcagggattgggatgtggacatcttgggaggtgggggttattcttcctacaagaagggaaaatttaaatgctaaaacctgcctggaaatatagccccaatcttacttctgcatacttgtctttgaggatttgaaaaaaaaaaaccatataaattatgtaagcaaaatctagggaggaaaaagaactttcacaaatgagacctctggcctgtaaaggatttttactgggacttaagatatagattcctgaagacaggaatctagtgtaggactgaatgatatttctatatttaagaagcagtagagcccttggcttgagaagactaagaagctatcctgagaaataagcagtttttataaagatgactgcagtcctctcactgcataacctgccctcagacacagatacccacatatcatctcttacaaaactcaagaagttataatatttaatttctctttagacctctagcaccaagtttaaaattgcacagaccacatttttgtgcaagagtttgatacagtgcataattcctaccctaggaattaagagaactgcatctaatattggttaagctatttgatgtcctagatgagctctcatgcatcttttagctccaatatctcatcatagtcacagcaaacatttattgaattactgacaatttatttatattgtcatttaatccttacagcaagagtgtgagttctgaattgtgattatctttgtttttcagatgagaaaaactgaaacttaggttaaataagtcactaagaacattgagctaaataagtgcgggagtcataattcaaacccgtagctgccctactctaaagcctgagatcttatctgtggccaagctgtcccatgggttgataactacttgaaataacatggaaaaaaacaataattactttttaaattttttagctgacacattatagtacatgtttataggatacagagtaatattttgataagtgtttacaatgcataatgattaaattaggataattagcataactatcacctcaaacatttatcatttctttgtgtgaggaacattcaaactctgctcttctagctttctgaaaatacacaataaattatcattaaccctattcaccccaagtgctacagaacaccagaatttattcctcctatctagctgaaattttgtatctgttaacttctctacattgtctcctcccccttacccttcctagcctttaatacccacaattctactctctacttttatgagcacaaattttatttttttaaagacccattaatttctgaatattactagcctcgatgagaggatttcttctgcaagaaaatggtgaagagagcagtggggagcaaagtggaattacagcaagggagattcgttttctctttgtagatataatgccctcaggttgaacttttgctattctggagttgtttttatactcaggataataaaaaggaaggatattatttctaacgtgtttatttggagtgtctgtatttctaactatattagtatctctgtctctagctctgaaatgaacatgagtatatgggacaaacttgtggcaagtggaagcttccaagtgaaaaaaaaaattgtctgttgcctctgtgaggctaaaaaacattttgtataagcatgtctctaatgcatataataatttactgggaatataggcttgcttttaggaatttactttataaacaatttggaggaatgcatatctttctggtaaattcagagaaagacgaatggaataattgaagaatgatgacattccttgggtatagtttttatttcattaaactataccttcgatatagtttaataatcagtaatactagtcaaaaacactagctagaaactctgcttctgttcctttgtcaatataattattatacaaggatgagatactatgttataaatatttactcttcttcctatggacgcttaatgtggggaaagatccaaagaaacttcaagaaattcttatctagtagtttttctgtagccttttcttaaaaaaaaaaatcaacatgctcatctgcactagtgatttgatatttaaaaataaaaagtattcgggctggcatgctactatccttcagtcttttaaataactttattaatcatcttatccttttctctatggaagcaccaaaacagtaaacatattttacaaaagaaatataatcagtaaagacaaatgacttagtagttttcccaaaaggataaactggagcggtgcctcaagaattacatttctatttttccaattacaaacagcaacattaatattacccttttaaatgtgccaataaaagtcatatctagcacaattgaatgagatattctactcatttcaatacttctttttactatctctttctttgtctctctgctatatatcaaaaagcattttccccagaaaatgtaattctgtggatcaggaatctgatgccttcccaattttttaaaaataagtctgtcttttttgggggtagggggattttagaatattccacttcagtcattccatatatttaccagcatatttaaggccattgcagtgaagtctttaaaaatcagaatataatgttgcagttatttttacagtaaaaatagtaaaaacttacctattagcttactcttaaaggtctaattgctaaaatttgtaagaatcaatgagaaaatatataattatgtactttgcaaaagtggttggttgttttcatagatatgaaatgaagagtatgtctggaaatttaagacatatttttccctgggaggccgaggcgggcggatcacgaagtcaggagatcgagaccatcctggctaacatggtgaaaccccgtctctactaaaaatacaaaagaaattagccaggcgaggggacgggcgcctgtagtcccagctactcgtgaggctgaggcaggagaatggcgtgaacctgggaggcggagcttgcagtgagccgagatggcgccactgcactccagcctgggcgacagaccgagactccgcctcaaaaaaaaaagaaaaaaaagaaaaaagacatatttttctttatgatttagtttattatttggcataggtttggcttatatgattaggcataagattaaatctagaagtaaagttttgctgtttttctttaggtcccattcctaactagtatgaagggaaagcttggtggttctctcttctcatgacggcagggctaaaaagttaattacctagttccaggattcagaatttaaaggcattaatctggtattcatgtcgataattcctatttatatgggagacatctgttaatttcacacacagaaagaatttccttgaagtataaatactgtgattggcaactctgcttaaatgtgggaatcatatacataaatatatgtcataaataacgtttacaaagaatgccaagcttaagtaaattttccacattatctaaaatactataaggtgaaaattagttactaaggtaattaagcatgatttaaagcaaaagaaaaagtcactccttacattttcctttccctttctccattaaaaatggcaccatttctagtggcctggaggtcaatatttattttgtaattaacacagctttaataatcctttctgaaggttcttttagatgtccacagtttagctaaaaaggccaagttctttagaaaagtaagtgttaaacatgtttggctgtggaaacaattcaagtaatatctaactcaaaatccaaggtagaacatagataaaagtattactgttgaggattttgggggctgctgttacatttaagccttatgattagtgtgtttatgaagcattttctttgcatactcacatgtgcttgtttctggaaagagttttttttaatattctcatcagatttcaaaatggaccgtgattcagaaaatattaagaatcactactgactgattaaataaatgaatgaccaaataaaataatgtgaatttcatattcctgttctgccactaattagtttatggccctggataagccacataaatgatctcatctttcatgtacttataaactaggttaggtctagataattctacaaatattttgtactaaatcctggaacagaaaaagtagcattaatagaaaatcagtgaaatctgaataaagtctgtaatttacttaatagtaatataccattgttaatttcttagttttgacaaatgtacccaggttaagtggaatgttaatattagatgaaattgagtaaagaatataagagaactcacttcttgcagaactatactatatatctttgcaattcttctatattatctttgcaattcttctataaatctaacattattccaaaaaatgcttatttaaaaaattattatagttctgacatccagaccaggcacagtggctcatgcctgcaatcctagcattttgggagtctgggggagaggatcacttgagttcaggagtttgagaccagtctgggcaacacagtgagaccttgtctctactaaaattaaaaaaaaaaaatccccagacatggtgcatgtgcctaaagtctcagttgctcaagaggctgaggcagggggatcacttaagcctaggagatggaggctgctataagccgtgatcacaccactgcactccagcttcagcaacagagtgagaccctgtctaaaaaaaaaaaaaaaaaaattctaacattcagtgaaagctgtaaatttattttcaacttacataacagaggatcttatatattattagagacccactgaatgtttttgagcctggaaacaacatgatcaaagaaaagcttacttggaagtgatgttccacagggagtggagtagggaacacctagaggtgaaatgaccataagagaagaggtcattgttgttccaagcctaaggtacagtcatgaactaaggccatgatcatgggaatagaggtatagaaggtatgaaaaaactttaaagaaataattgacagggctgactgggcaaaaacacatagccattctatatattgtatggttaatactgtgccttgaaattggaaagccatatttattcactctcagaattaatgccttatgaatatatttttaactttaaagttcttacttttaggtttagcatgtaatcaagcctctatatcgttttaaatttctccttttttctaattgtgtgtacattgtcctttgaaggaaatggcaaaattttatattatattgtttgttcgtatatggtactatgttgtattaaggaaatatgtttgtttcaaatcctctcaaaacaggaaggtagacttttggaagtctaacttccaaaaagctgatcatgaattgtattatttaaatacattttaatatttaataaaatacagcatgtttggagtattcgtttttaaactagagaattgaaaccagtcttaactgggccttaatcttttagcagtcagttcttcccactgctcttttgtgtgaaacactgtgcatcaggaaaaatctgattgctctaaatgctatgttaagaatcctttctgcagctcttattaaagtgcaaagattctcatgcattagtcacctattactaaatcaaaattgctttgtaatcagtttttgtgatattagccaacatgacagtgtttcctctggagatcttacttgaaaatttttcagatttgcaagtctaaaactaacatgtttgatcacgctgctttgtatgatcctctataaactgaatactttataaattctcaagcttccctaaatgttagagctgtaactaatctttgaaataaattagagtaaaatctttctttttccacaaggaaattaagaaaccagagaatttaagcgacttaactaatgccatcaactaatttgtctctatctaacctgtatgggggaaagaaaaactctaaaatgtaagagattagatatactgagcctacctatacctcttctcctctcttagtttctctccacaaaaatgagtatttctgagaagcataattttagtggaatttgcaaggaatattttctataaaacattgttcatataagaagtcggttgaactcttaaagaaaaggaaaaaagtatgccctttttttagcctccaaatattttcctaggttgatttgccttcttgggggctgaagttattaaaatttgcatgatctccttagaatacatttaggctaactatttctgattggttgaataatatagaaaatagagaacatagaattcttaagtctaggaatctaatttggtactaatttttaagtaatgaaatcaactaatattaatttttaaaaataattgtgcatattttcttctttccacttctttatcttttatacagaaagaccagcacaatgatgaacttgtttttaagaaacacttttggtcagagaagtgaaaaatgtgaggaaattatttaacttacaagaactggttacagttatcttttctaatctctcacttatctctttttaaagttctgtctatagacatatcaaacttttgcatgaatgttttaaagtttaaattccttgacatttactagaagtggagtttttaggctgttaaaggtcaaaattgacagggtccagagaagtcaatggggtagaatgatctttagttatttagcatcctaaaattcaagaatgtaaagggcattagttttgccactcaaataggaacatcccagaagatgtacactctctagcaggtatcaggtatgcagagtatgaacctatacttaagcacactttgccatcagtacctactcctggggtgggttgcagaaaaaatgtgcaggggtgtcgctgaagtgcctctgagactctctgccttatcattttcaggggacatacaggaaggctatccctttaggagaacttattggcctgaattttagatcccacagattgcctcaaattataaaattacctcaacatctacaagtaaaaatatttgcaaccttaaaacgcataaacatttggtgagatcctttttctgttttatttcatcatgagctagattcttcctttccttatttggaaaggtgtatttccagagaatgaatcactgcatttcaggggatttcaggctgtctagccgactcaataacaacagttccattggacctatcttcagactgcatcagatcttggagcagtgaagcacaaagcagaaatacagggcagagttccttcctttcttccactcaagtagaaagaagaaggtaaataggaaaaattcaggaactttacaacacttaggaaaacataatgtgtcttgatgtcttttattttcatctttcagaaccgtcgtccttctcctacacccaaaaatgcagtgcccaatgctattacaatagaatccaaatgcattccttagcaaaaaaagatattcagatgaataatttgtaacaacagaaatttctaattaagcaaattgaggccctgagtttatcattacccttttcggaagttaataattaatcttttttgaaacgacaacaaaatggcttccagatatcactcaggtacacacttgccaccgtcctctcttccattttgttggaacaaaatgacatatacacatacaaacacacaaagactggaagaggatttaaaaatggaagagaggaaggtggtaagtgtatgcctgagtgatatttggcttaatgtctaaaagaaagctgaagtctcaggtcctacagaagagggagtgggtaagaagcaagtatattcactctaaatctaaatatcagcctgtttacatgcacacatgcatgcacacacacccaacctaattaggaggataatctaaaacatccaaaatatgaccaaaagagattccagaaaaagtacaagggtagaaaatactctagggtattttaagtcagaagatatacagggaataatgtgcttacagaatcatgagaagagataaaaatcaggttctaagctggatatcttgaaatgatacccataaaatatagaactggccaggtgcacaagctcctacccctgtgctcaccacgggaactgtaatagtctaggtcaggagccgtggccacagccataccagcctttggacgtcaggaaactgaaaaatggatgcctaaatatgcattcccatgattatgaagttagatgttagactaacgtgtcaccagtactgggccattttcttgacacttaggaagctaaaaactggagcctgcttctgcaaaactccaatatcaatagtcactgttaatggtcagttgccaagggaaacggaatctacttcacttctgccattcaaaactttgtcaggtcaatcttattttaggagcctaataattactcagaaccatagtagctagggaaattgggaaatgtagtttcaagctgggtagccatgtacttttgtagaactttattactaataaataaagggagaacaaattttgggtcacagctaactctagaaagatatgagaggtttgttctcctgagacattgaaccagaggaattctaaattcaggaaggtaaatatgggaggattaaataaaagtctacattcataacagtgagattcccaggttatttcctaaattcaacttccagaatgctggaatccaggtgtaatcccataggaatgattggaatattgttacttggacaaactggaccaaaggaaaaacagtaaatatattgatatttgggaaccctaatgaaatggtcagggtaaacctacaattcaacattattttgctacacacaaaacttctaaccatgtcataatgacttatacttaaatagaaagatatttacagacattagtaatttgttgaatgccttgacatgaaaaaagagaccaaaacaaaaaagcaaacaacaaaatctagtcaattaatatctagaggaaaaagagacaatatagagaactaaagaaaactataaaaagatgattaatattctcatagatttaaaatagtaagaacacaacataagaaaaaataatcataccacaagagtggaaattaaaatgagatatctgaaattttaaaattctttatgtgttgggaaataatgttggatgcaatcttccagaaaatagaatgttttaaaatgagggaataattcgagaaaaaggaaaacaaattagaagattaatttaccaggtcaatgtctgactaagccaaaatgcataaaaagaaaacatataaaacaaggcatacaaaattattaaataactttttaaaaattcctagaactgaaagacatagtttgctacgtcaaaaggttcaaaaggatccactaattgtcattgtaccaaataaaaaagatgcacttagccatattattattaattttcacaataccagagatagaaagacgatgatgatgatgatgatgatgataaaaaagactaggagaaaattcacatgcccaggattaaaaaacagaatgacatcttactttttaacagccaaatactgaggagaaagtcaattctaaagaagaatttaatacctaattaaaccaatcaagttgagagaagaatgaactaaagatatttccgacatctaaagtctttaaaatgtcactgtcctcatatcttttctacccctctacaagatgcatcagattctactgcctcttcctttgcccttcaagtatcgcttggtgagcagtagctgggtagtgagtagacaaatttgtgattaccccctggtagacagcattctgagaatgtcactctcttatagctctgcacattacacagatctttccagttgttgaaacaaacaaaagattttccaatttcacacagtgatttcaaacgtgcagatgtcagagagctatatatactagtctgccgctattagaggctggaactggatctattcatttcagcaaggtttattctgtccatggggttgtccagggggcaaattcgcaaataaaaataatcactttatggaaagacattttcagcaaaactcaaaattctcttgtttccctctcagtcttctcctgtcccatacatattatcgtcagagataggaaagtatcggttcaggcctagctcacagaaggcacttaatgattacctgttgaccagttgactgctgaactcactgacccttttttaaaattctgtgttttgtgttaaaatttgaactacatttagatcatttgtacttcagtatgaataagtgtcagaccctttcccaaggtaggatgtaggacagagcacagagcttggtgaaaattggaggaaatgagcataaaaacaagaggtgagagagtcagaaaccagcttcatttctgcagctgtgatggagaagctccatggacctccatggaatcaagcttcctgcacatgcttgggagccatccattgatccaaagcagcagtggatttttattttgaaaaacaatttgtagaaaaaactgttgagcagagaaagggtgacaggcaggtaaactaggatttgtgtgatttccaaatgcttattaaacatgttgccaaaactcccagagtgtgtaacaaccagctggggattacagctggggattaatttagaggattaatttagatttatatagaatctaaccttccatatcagccctgaggtgctaaagaaatggattgttaggcagagctttagagccaacccagggacttggacttaataaagcatttcagaggggatcctaggctctgggatgatcaggttctaaataattcctaatccttgtatacatttgattgcttactcagtttcagcaccatgactcatatcatcaacaggcatgctgtgtgaaatgattcccctgacctcctccacaaaccccccagtaagtcattcagattgtcctattggaagtcaactgaatattgcacttcagtgttcttatctacaaagtctgctgtaataaatactggatatcataggagcttgaatcaatttatccttatgtgctctcatttttactattgaaatttaaaactgtatttagtttatggataccaaaatgtttactgggaaaagcaaataccatttcataaaaactgttgtctctgtaatttctagcaaagtacatgagatctatttaaaatgtcaagagatcaattcattgtgaaaagtttcctcccagccaatgtgcagtgaattatttaaaagttctgacatctgaagcagctggtaccatcttctttcagtcatttacaagtaccttcatagatctaaccccatttttgttttgggttgaaaaatctcaattatagcaaaacaaagatcttggtgagacaaactgtaaacgatacatttgaggacttaaaagatagggagaagagagtgtagctcatgtgcagtcctaattgttgattatgggctttaaggaaactttgtggaaagactgaactatggctatatgtggttcttaacttttgtacttaaatccatagtcatcatctctccctttctcctgtagaatttcttcctttagattgtatcagatgttgtatcattgtattgctaatttgtttcaatgagcatttcttgtctttttagttatattaacttattctgcaagtccccacttactcgtctccattcagaggactatttacaatgtcataaccactaaaaaaaagtttgattgattgacatcaatgattgacacctatatattacacattgatgactgttctatttgagcttagcaaaattgttgtggaattcactgctaaattaaaactgctgtatagagctttttacattttatttctgaagtgactgattatatattaatagtaaagaaaattgacatttgtgaaaatgaaagtaaaaagtactgatgacttccattcttattgtcattaattatttcttagtttagttgttttgtgatggagagctatcttacgtagtcttgttatttattgttgggctaagcttgactgtgtttacaggtctaggttccagttccattgtcactactgtcttgctgtttcctggagcaattcagtctaacttattctgaactcattttcaccctctataaatttggtggagatgagcatttttcagcttttaagttcaggggtacaagcacaggtttgttacatacaaatgtatatacatacttacatacatttgtaaatgagtgtcatgggggttcgttgtacagattattttatcaccaaggtattaagactactgcccattagttattttcctgaacctctccctcctcccatccttcaccctccaccctccaaaaggctccaatgtgtgttgttctcctctatgtgtccatgtggtctcatcatttagttcccaattataaatgagaacatacagtatttggttttctgttcctgcattagtttgctaatgataatggcctccagctccatccatgttgctggaaatgacatgatctcattctttttttatggctgcatagtattccatagtccgtatttaccacattttctttatccagtctaccactgatggacatttaggttgattccatgtctttgctattgtgaatagtgctgcaattaacatacacatgcatgtgtctttataatggaatgatttatattcctctgggtatattcccagtaatgggattgctggatcaaatggtatttctgtctttaggtctttgaggaatctccacactgtcttccaccatggctgaactaatttacattcccaacaactgtgtatacatgttcctttttctccaaaaccttgccagcatctgttatttttttacttttttttttttttttgagactgagtctcgctctgtcacccaggctgtagagcagtagtatgatgtcagctcactgcaacctccacctcccggttcaagtgattctcctgcctcagcctcctaagtagctgggattacaggggcgcaccaacatgcccggctaattttttttgtatttttaataaagatggggtttcaccatgttggccaggctggtatcgaactcctgacctcgtgatctgcccaccttgtgagcctcccaaagtgctgggattacaggcgtgagccaccgtgcccggcccttggctttttaataatagccattctgactggtgttaaatggtatcttattgtggttttgatttgcatttctctaatgatcagtgatgttgagctttttttcatatacgtgttggcttcatgtgtgtcttattttcggaaatgcctgttcatgtcctctgctcactttttaatggggttgtgtttttttcctgtaaatttatgtttcttatagatgctagatattagacctttgttggatgcatagtttatacttttagcttttgcatacaactatattatgtgaataaaatgggataaggcttttgaaagaattttgaaatgttagaaggagacttgttttttatataccgaatgaatatcatcattttgtggttttttttaactgccattatatcctttagcaatcaaaatactatagctctagtttttaaaattaaatatagactgttcatattataacttattagtactaccaactattgttttaggtaatattttctatccattaatagcattcgaggaggaatattttcttcttctccttagagatactcataattgattgtgcaatgttcttatctgttcacacatcctttattcttcttgtgctcattgtttcttttgccccgacctgcctcctacttggagctgctgctaacatgaatctgtcttaggaggatggattgtttttaagaaaaagataatgggtttggatccaaggtgctttccaaataaagtctaaactcttagtttagggctttaaaactttttcctaacctactgccccagccttaaccctcattcttacctcactgggtaatgctatcatatggttagaaactttacaatattcttgtttctaaccctttggttacattgttttccttatccacttgttgaaactgtatatgcctttaaataacatctagtccatgaaagctttgtggtcctcccactgcaaatactttttttcttctagacttctgcaattttcgtgtctacttttctgatggcatctagcctattacgttctatactttgatattactctgtgttttgttcatttattgggtttttttaaaaattcttttattctgtttctatatctgttgacaaaactgtgagctttttagatgtgttccacttcttatattcacagaagtgtctaggaggcttttcttgggcaataagaaacagtctatcaagagctgttgaattaaattgaattgttgggccacacttttagatacaagtatcaaactgaacctttcatgaaactggacaagtttaaagaataaatttattccaatgttgttagtgttttgaaaaagagtctttatgtgtgactggaagagaagaatcaagctgtttaaccaataatgctatcgagtttggatagcatgcttggctagaaatcagcaagcagatatcagagacattgggagtcacgaagtgttgttctacaaagttaaatacttgattaaagttttttacatacaggacacacatttaaagcttacggtttaccaaacataaaaggagtgcactagaatttgggcaggttttaaaaacggaaaaggtaaatcctgcatgcttgaaataaaacctgtattatgaagtttccttgggcatttgtttagggaaaacaataacatttgaacaaatattttcaaggaatgctgtttagaaagaaatcaatcttgaacaaatattttcaggtagtaccatactcagctttggggtttttttattattatcacatgaagggatcttttctgagttataacatttcctagcatttggaatctgatgaaggccacatctatacaaagaaatagaggtattaccatgaacagtcagagataggcttcctgagcctttaaaatttctgtccatgtatttacatttccctggcctacttgattcatgtgctctgtattttcttcttagattattaaaacgagaagaaagtttcacattcattccgcggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgagaacaagcagcaaaatttctgtattatgtcaggcaataatcctactaaaaggtggaggtgaccgctgtcaataaaaagccggaggatgagggaaataagatgtgtccattcatatgagtggttttggtcatatatatacacatatattttaattacaagtgtgggtcccctttcagaactaaccaataaatagattccatgttttcttgtttatcacacatacaagtatctttccctatatatttgtaccacttttgagagccagttttgattatatattcctacatttagtgagttggtgggtgaggaatattttctaagtttctttttctgaacagacatttcatacatgtatcatggcagtgtggtaaacttcccaactggaagaattgtaactcggcaaaatattttagggatattacctatttttatacatatctcttctagataactacatttcgcacaacattattagattttcagaatctgcttctgtattgttagtatattatatataatgctaacctattaatctaatatagtttcccttatttagagagatcagtgcttcgactgagaatacatataaccaaggatttcagataccaagaaagcattatatgtctgcttagtaaatatatcttttagatttaactaatgtagcatggaatccagaggaaatggaatttcctaacaccagatgtatctgtaaccaagattaaagaaaggtctttttgccaccttctaacaaatatcagttaaaatgaaatgctttgctacactggatccttttcaacttagcacttacaaatataggtagcttttgcaacactaaactgcattctaataaacagcattcagctaaatgacatgttagttacccccttcctcttccccagttgatgcctcctaagagccgactgctattcttgagaacaaattcctggatactggcattagtgacaaagaagtgtcaggacagtttgccaagaatgttgtttcttcttgtacaacacaaagcaaggaaacctctgtattttatggctttgaggttttaaaaaatgttctgcagtttgattgatatggcttttaaattcagtgaatcactttcatgaatactgaagtaggtataatcttcagaactagtaatcattatagttacagataggattccatcgcatgtcctgctcaaatgaagacctgttctcattaatcaatactgcatgaaaatattactggctcacactaaaattaggagcatcaggtgtccagagttttcctgtttgggttcagatataaaatctaagtttctattgaggttaataagctggaagcatttgtttcctttaagccttggagaggtcattttcttactcattgatagcttatgtctactgaatgcaatattcttttctgttcagggattttggctgcattatgatttggttatgacataactcagttaaggaatatatttactaatttccaatgtagtctatgaggttcatttaatgtttttaaattttctatgtgtgtggctagaaggcatttgtagatatgcaaatatttgttataatcctgatcccttttataatttgagttattttcttgccctgggggtttacaaggacacgagtgcaacactctttatatggagaagacaggaaatagaccttgagctctaaacctttgcctgaccccctcttctgtgggcctgtgtttctggacaatggggaggtttacagccagtatgagcagagcagactgggagcacctcaatcctcatgcttatattagaaaatgccttagcaatgttgatgggctccttgtagcactggagcatggggagggaacaagctcactgatgtcatttatgcctattgtcttcagtaacttagaacttattatggtatattaaatcaataaaatgttggtgatgaacaatgtgttttgtaaccataaggctgaaagggacttccaggaatatccaatctatttctctcactttttataaagatttgtctaagcaactactctaaacacatatttattatctccatacttaagaatatctacgggaagcatatttgaaaagcatcattggaaatccacctcaatactagtgataggcctggagagaagtattgtatttatatatctcaatttatcagaagaatcacaaattctgtattagtttatatgattttacttagagaataagtatccatttacattgccataaatgtcacgatgaagaacgtgcc

SEQ ID NO: 16601 - DNA, 90724 bp, Human
actgagtgtaagataaataatacctaactgtccaggcttcttggaacagattttttttctttctacgatctttaaaactgatttatgagtgaaattgaggtcagcattcccctttgtgtttcatctgctgatgttacagggtcacagtgacattttgaattgtaaaagggctgccagagttccagtacagcaaattttcccctcctagacttactctgtttgagaaaaagcaccagagggggggatgtgaaagtgacatttttcagtcaagcttctcttttaagtcaagtatacagggtctaacagatgctgttgtcagctggcaaactggacaggtaatcactaaagaggtcctcccaagccaggtgtcgtggggcacacctgaagtcccagctactggggaggatctcttgagcccaggagtttgagagcagcctgggcaacaccgtgagacctcatctctaaaaagaaaagataaaaggtcaagaaataaagagctcctcccagtttcagggctgtaggcctccctggaagcccggctatactgctcaggagtgctgggcctctcagtacatctctctgccaatcccaaacctctgtttgcatttagacattcaggtaacacttttcaaaatgtctctactgttttcacagttgccaagattcttcccactcttacagagatgtgttggagtctccagcatgcggtaggacttagtcccttcactgtaatccaggcctagggggttaggaatggggagctctatttgcaggatttgggcttactgtcattttggtctgttttagttggataagattgaccacaatgcacacagactggacatttggccagtcccccactactactttgttgttttgtctaggagtgcttattcttttccttcaaacctgaaaaatcttaggctctcatataagcaagtcaggaaaaattagagaatttcatagccgttttctttttctcctaggataagttagatacctttccctgggctccaaatctcagtttactgtctttccttgcaaaagacgtgtcctccctacccatgtccctctcagtggaggccagtgccagtgaccaaacagctgccgagctctttaactctaattagtactccacaccctcacatagaccttgcaggaggcctcaacccacccactccctccaacgagttgtgacgcagaccatctcaaacttcacatccacacgtgtcacatcaacgcacgtgacacaagtggccgaaatggtttcctccttataatttttggtgagtgacttggccgtggttcattccaagcggaagtgatggctggtggatatgacttgaggggaattcctgagggcaaggaaaaggaagaaaggggccccagagaagacgaggcacagctggagaaccctagggctgtgaacactgcgactgccgcgcggggcagctgcgccgtgtttgctggaagcctccggtagctgctgaaaccttcgctccggaggtcgcctcggtaaaccttgcggatgattccaccacggcggaaagacgaaaaggaggcttctaggcacccgggaccgcccgtgtcccgcccttttccccgatgaagtctgacgcggcaggtccctcggcagggttaatgggacggcctggtggggcattgccggtctttcccagccacagacaagcttcgcgcctcgatcccccagcgcccccagacgctggatgccgaggcctggtcctttacagccgccgacgcctcatgagcgaagccagccagatgccagcaccgccttcggccccgccccgagccagcccctcccacatccccgcccggggcacgccctcggcccgcccccatctccgccccgaacacgcccctagattggccccgccccgtccccgcccgcaactccgccccgaccggaagaagccgcggcacccagcgcttatagggccgggaatgggggtgccgccgctgcctagtcagttctgcgtccgctgaggctcggtcaccgcctcgctgtcgtcgcggcgcccccgccccgtcctctgtccgtaccgcccccggagccagggccgagtcctcgccatgccggcccggcggctgctgctgctgctgacgctgctgctgcccggcctcggggtgagtgaccggggagcgtggggtggaggacagctcgcgacggccgggtcggggccggggcagcgtcgcggcgccggggctggagtccgagctgggagcgcgacggcggcggccagatgccccgtgagcccagccgtgggaggctcgggccgggcgtaggaggcggcaccgggccgggagagcttccctgacgggagtcgcggccccaccgaggcgtcggccgcccgaagagcctcccaagccagcgcggctgtcacgggcagcggctccccggaccccgcgggctcgggcgcaacttcgtggcgtcctgcacggcacttgggggtcccagaaggccccggcctgaggaggccgcccacctgcgggaccctcctcctcgcgggcgggcgccggcgctgcctggcgggggccgcggaggagccgaaagggcgttgggatccaggggaagggtctgtcctgcgcttcgaatccttgtttgaactttttaaaaattcgaaaactttggggaacgaatgcaacagggagtaaggactctcacccgagagctggcttctgccacttgccctgccggtttcttggtactgggaggctgcaggcttccttctgtgcaccgagacttccttgagcaagtggagctgtgggaattgcactcttggaagatcccgcatgggttcgaggtgaggccgcttcagaacctcaaataaagactgtctcctcgtgggagagcacctggggccatcagaaatgtcttttcatctttttctggaggagacgaatgatagggcctggtttacattcatttaactctttatgaccttcactcagctgtggatttgggggcactttgtgggagacttggcttttttttttcttctggttggaagaacctaaattagcgaatgtttttcacaaaaatgtattgttcaggatgtgagcgtggcaaatttgtccgtgttctgtttaatgacctctttaaaggtactgtgtactctttaatagggatatcatgtaccaggtgtcccagtagagcactgacatgtgtgtgcctgagtgccagccaccgtgtgaactctttggaggttttgcattttaggtaaataactgtctgtactcttggagtaacaagaatttggaaacaggagaagtaaataaataaggttgcctttttcaaattcagggtttttttttttaaataaaggaaaatttgtagactctttataatagaacttgtggaagttaagtttttctttcaaataaaaaccccacttttacaactaaggtcaggttttgaacttgagcacctcaccttggattggtaactactgcctggcatctgttcacaaacgaaggtataagcagaatgaccaaatgtttgacatgaattcgatcatttcataacgtcaagggataggtgtataatggtttcctttgccacatctttccttttgctactttgtcactggattctagtgtttggttattgaataacttaggctaaagagccaaaaataacgatttagctgtagttggaactatagtttcagttcgtgtaaatatttccaatttgtatttagaaatccaaacttctcagagttcatgataaaatattccagacccttatcaaaaggttatagtttagcgtaactatatttaggtgaaaggtcaggccgggcccggtggctcatgcctgtaatcccagcactttgggaggctgaggtgggtggatcacttgaggtcaggagtttgagaccagcctggccaacatggtgaaaccttgtctctactaaacatacaaaaaaaaaaaaaaaaaaaaattagccgggcgtggtagcgcaggcctgtaatcccagctactggggaggctgaggcaggagaatcacccgaacctgggaggcagaggttgcagagatggagtcactgtgctccagcctgggtgacagagcaagactctgtctcaaaaaaaaaaaagaaaggtcagaatttcactcctagaattttctcccaagggtttttacccccaaacatagtaagaattattattttaaaattgtaaatgaaactcatagcaaagtttgcagttaaaccaggcaacagtgatgtgcagaacgcagtgggtataaaatcagacaaacctgagttctaactggtcacttgctagctgtgccctaggcatattcttttactactactactactacttctttttttttttttttttgatatggagtttcttcgctcttgttgcccaggctggagtgcaatggtgtggtctcagctcactgcaacctccgcctcccgggttcaagcgattctcctgcctcagcctcccgagtagctgggattacaggagcccaccactacacccggctaatttttgtatttttagtagagacgtggtttcaccatgttggccaggttggtctcgaactcctgacctcaagtgatccacccaccttggccttccaaaatgctgggattacaggcatgagccaccgcacccggccatgattttacttcttagagactccttcctgataggtgaaatggggacagctaacatgtgaaagaaggcaccaccttcacacgtgcttaatagataataaatgtaaattctctttatgctccaaagatgctttttactctaagccatcattttttgaatgttatactatgcctctgcaagaaatagtttttgatatttctttttgattgatgtagtaactattgcattggaggcaatactgtgattttctttcagtgtgtgtcttattgagccagacattgactcattatgagttgagactttaggctaccagatccaaaacgcaataacattggtattattaagcacttgaggctgtcttttgttaatccagaatgtgcttatttagtcagtgagtttttcctttcttcctagacctatatcttgctcctagagttggttagggttacatcatcactgtcagcagtcctcattttatggttatttaggtgccacatctctcaattaccaaagagatcagtacaatgtgaggcaaagtacctttttttttaaaagctataagatatcagatttctttcatttagccaatattttggttttagagggaggtttttaaaaagtcaccgagaactgaggatcatgtgtgtatagaaacactgtaatctgatagatgagtcttaactagcaatgtctttgcttatcatttattctgacagtgatcacctgcattaattatcctaataggcgatatcaagtgtttatactgaggccataagtagaatgttcattgagtttgttatcagggctgctgatcatgaaattaaactgtagttgtgcacatgtgtattgtttcattaacttgcctgcctattcagccttctgcagtaatgtagcttctcagagcacaggagaaaaatgtatctgagagttattcgagagagagttcaacaatagcccatatttccgaacataaatctagtgagccgcattaaagtttcttcatgtctggatggaatagtgtcacttgcataggtctgagggtttcattatttgcctgccccagatttggactccgtttttcaggtgaaagaatccttggataactgtttcattttcataggaaacctctttggtttcgggatccaaagtaatatgtaggttcaatattttgtaggttttataatcaaatgtctccctaaagagatgacatagggaagaaaagcctaatgtatcatcttaatggattcagtttttattatgcacaaataactgggcttgtaacctaggaatatgattagagcgtgatgctggcttaaaaaataggactggtgaatcacagtttgtgaataataaactactggttggaaatatttcccagaagcagttttttttttcctttctatctttacctatatcccatgtttggtttcaaacttccctgccttagagcaacacagctggttttagacagtctttctatcaatatcttataatctttgctcatgtacaaacatacagcaaatacaacggtataaaaatacgatgttatctatttttgttcactttttccccacagaacatcttctgtaacccggtagaaaatgttctgagtacaccatcacatttgtcactttagtagcaccttagtaaaccatcatccatgtaaaaaaacattgagcttctcagccgggcttggtggtttgcgcctgtaatcccagcactttaggaggccaaggcgggtgaatcacttgaggtcaggcgttcgagagcagcctggccaacatggcaaaactccgtctgtactaaaaatacaaaaattagctgggcaaggtggcatgcacctgtaatcccagctactcgggaggccgaggcaggagaatcgcttgaacctgggaggtagaggttgcagtgagctgagatcacaccactgcactgcagccttggcaacagagcgagactctgtctcaaaaagaaaaacaaaaaacaaaaaacattgagcttctgtgcccagccgtgggttggggactggggttataactgatcagggttgatgtggtaataagccgagctttgcctgccagtcatcttgctgtggccatagggatcataaagaaaggggtattttcattttttcaattattttatgtttggtgctttctgtatgataacaggggaagatatttttttttgaggcattatctcaaagtaatcatattcattgtagaaaagttagaaaggatagataagcctaaattaaaaaataaaaaacaagccttctattatcttattttccaaacattacctctatgaagattttaaacaattttattgagatataattcacctatcatcacaattcacccatttaaagtgtacaattcggtgggttttagtatattgacagaattctgcagtcatcaccacagtccattttagaacattttcatcatcccagaaataaacttcatacctattagctgttacacaccgtttccccccaaacctcctagtccttggcaaccacaaatctactttctgtctataaatttgcctattctggacctcttatataaatggaatcatacattatgtggtcttttgtaactggcctctttaacttagcatcatgttctcaaggttcatccatgttgtataataacatgtgtcagtactttgttcctttttattgctgaataatattccattatatgaatataccacattttatttatccattgtattagtccattttcatgctgctgataaagacatacccgagactgggcaatttacaaaagaagtaggtttaatggacttacagttccacgtggctggggaggcctcacaatcatgaaaaaaggtaaggaggagcaagtcacatcttacgttgatggcagcagggaaagagagagcttgtgcagggagcttcccatttttaataccatcaaatctcgtgagacttattcactatcacaagaacagcacgggaaagacccatccccatgattcagttgtctcccacggggtccctccaacagcacatgggaatagtgggagctacaagatgagatttgggtggggacacagagccaaaccatatcatccatccattgagggacatttggattgtttctgctttgggactattaataattctgccatgaacatttgtgtacaaatttttgcgtggacatttattttcactcttcttgggcatatatctaggaaagagattgttgggtcatatggtaactctttgtttaacctttcaaggaactgtctgactgttttccaaggcagctgcactattttacattcccacctgcaatgtaggaaggagggttacagtgtctcttataccctcactgatactcgttattacctatctttttaatcttagccatcctggtggatgtggagtggtaactcattatagctttgatttgcatttctctaataactaatctaatatcttgacatatgttctttcagatgctttttctgtgcacatatttacaggtaatacttttcttccccacactggaacatatagatctatgtcaatcagcttaattctgcaacattattcttaattggctgcgtagtatttctctgaatggaatggatgtaccataatttgaccactcaatcatttagatattgaggctgtttttatttttttttattttttcactacacagatatgtttttattttcattataaaaattataacaatgtaatgaactttcttgttgctaaactcttgaatgagttttaagtgcttagttatttcctggagatagattcctagaattgaaatttgctgattgtatgtagtattttacagccctctcccccagccctaagcaatgttgagtgttttaaaaacaaaactaaccttaaattgtttttatgataggcggtttaaagtatgctattttcttttatcagtggccactttcttttaggagcgtagactttaaaagttggatgaaaatagaatgtttacattttgtttatattttgaagatgtaaataaaccaaggcagtctctggatgataccctttgtacctaaaagctattgagaaaatgttttatttggatttgttaaatgactcatttgtggggtcctttagtttgcagtggtttcagatcaactttctaggagatgtggcacccatgagcaccctgaaatacctcgggataattctctggttttgagggtggcccgcctcctacagataagattctttgtatggtcggttgtgaggccatttaaaacttttgccttaagacttcataaatcagagttgatacattgattgtcccttttggaggctgcagttcttaaaacatgtggctgtttttcctaggaatatttaagtaccacttgataataaagtactaccttttgctgggattatctacctggaaaaaaaaagggaacaaaaaattaaaaataaaatgtaatatctgtggtgttttattttttgttttgttttgcttttcctgcaaatttattcttccaaaaaaaatgtccctttcaaaataatcaccctttggcgtgaatttacgggttattgaaatcagtcttaaaaaaatttccagttaaatttaacaacttatctaacccatttaataattcaactttaaaacaaaaacgaacctttgaaaacaaatatttactcttaagccagttatccttatacaagttaaaacattctccaattccttccagtctttgcttaataggacttttacatgattcacactacacttttgatcaaaattgttattacccagtttgatcacacaatttattgaggacacttggatttggttttcagctatttattaaaatgaaatccatcctaaagtgaacaggatttttaccatttaggggattcaaaagtatattctttgaagggaatttccaaagaattccagaaatattttgagccctagaagcatgtatgaatagatgtgtagcctcccaagataactggaatcagagtgcattagactgcttgatgggctctcggccatgtagtccaatgagtctcaattttttccccttccagctgcacataagaaatatggcgcacatccctcagtaacagtatgagcacatcagaacctaggagggtggtgtttggggcaccctctctcaggcattaccctcctctcccaagctgagaaaaattactaccctgctctgtcttccagagcagacagatgggaaaaggcaaccagcaagggctggtaacctgtccagggtcatgtgtgagtggcagaaccaaaccttaaacttgatcctcctacctccctttgaagagaagcccctgcagtgcttatgttctggtgcgtatgttgggacaaaccagtctggctaccctcagtcataccctgaggagctgaccaaactatgtggccatgagagaaggatctagagaaggtctaggccagtaggctttcttgtaagcttcaggaaaatacccagataatgttatttttcctccgttaagaatcatggccttctaccctttgttgcagttgtgcgaagatgccattttgagatgggaatgctgccttcacctgagagtctccatcaaggaaattggccattttcaactgtagagtcaaatccagcaatcatggagagagtagggattaaaagcctgctcggctgggcacagtggctcacgcctgtaattccagcacttcaggaagctgaggcgggcggatcataaggtcaggagttcaagaccagcctggccaacatggtgaaaccccatctctacaaaaatacaaaaattagccaggcatggtggcgggcacctgtaatcccagctactcatgaggctgaggcagaagaatcgcttgaacctgggaggcggaggttgcagtgagctgagatcctgccattgcactccagcctgggcaacagagactccgtctcaacaacaacaacaaaaaattgcctgctaagcctaattcacagtttaagctaatttctttgcttggagtctaataatatccaagcaggtgcatgttttcagtaacatctcgcctagtcatatgtctgaaagaacaaaactgaaagttctttccttagaggcctttaacccaagccgctcttctctagctcagtcacagccttcaccaagaagtcctgaaaagatagaactcttgcattaccgtgctggttctgggtgtttgcctttgcagaggcgccacctgccaagcagttctggcaccagggagcaggtctgtgatgacaggagagagacagtggctgtgactctggctcttaaaccacaatggagggattcaagttagcttaggtagctctcagaggagactaatgagggaaggaaggagcaaggggggaaggaaggtgcccctgggagtgtgtctcacttcccttgctggttcatccgagaaggcagggaccctggcttgctgatggttgcatcctctgtggcatttaacgtggcatgctggttatacccactgtagggggcactcagcaaatatttattgaattcttctttgagactcattaagaccaataaaggggctgtattatatcatcaagcaagtgggttgtggatgggggtgggaggtattgcttcagctatattttatattctttaatgggattgcaccagttgtgtgtctttctacagaactagaggagctttcaggatatttgcttgggtggacgtgacccatagtgtgtagtgttcttttggtgggctcttcttatcagtaatgagattaatttttccattgccaaactccatgaggtaaacagtttgtgattatttcatgtcagtttcatttttcactcagcatgatgtttcactgttaaaaaaatgaaccttggcccagagttgtcctctcatgtattaaacatgacttcctttgttagtagactaatttataattataattcaaaaccatcccattctccagtggattatttcccccctctctgtcagatgaaggaataattgtttgtctgggctgcaggagtgtctgtcatggaaaccgaatttttctgtacattctctgaacaaacagtgctgtcacatccctagaacctgacattgtcattgatctccagttgagtcagagaagtttgttgaccaaggtaaatcagatctctcttctcttaaagcaaatggcccatgactcctgaggggccactaggagtgagagaatcacctgtacagggggccacaactgtggctaggaatgtgttacttgaggcggtgcttcccagccatgactcagtcacctggggagctttttaaaaacgctgtgctggggccccatcctatgtgaatgaaattggaatctctgggagtgggggccggcatcttttcttttttaaaaaaaaaatgtttaaggccaggctcagtggcttacacctgtaatcccagcactttgggaggccaagacaagaggatcacttgaagtcaggagtttgagaccagactgggcaacaatgaaagaccccatctctaccaaataaaccagcaaaaaatgttttaaggcccaagtgactctgatgtgcagccaggatgaggccttcaagtaatttttgtaccttaatcctggaaagaacaaatgcatctccaaattcccagtcacgtcacagagcacgggaccagactagacacagcatttggctcattttacagagaggttaggattgatagagtccgctagttagtgttagaactagaaataaagttctaactttatttctagttctaggcgtggtggctcatgcctgtaatcccagcactttgggaggctgagacgggcggatcatctgaggtcaggagttggagatcagcctggccaacatggtgaaaccccgtctctactaaaaaaatgacaaaaattagccaggcgtggtggcgcgtgcctgtaatcccagctgcttgggaggctgaggcaggagaattgcttgaacccaggaggcagaggttgcagtgagccaagatcccaccactgcactccagcctggggaacaagagtgaaactcaatctcaaaaaaaaaaaaaaaaaaaaaaaaaaaaacctagaaaaaaaggaacctaatattacattttctctactgtactatatcattcaacttttaaagagcaggtaatttaatggattttttcctttgaatacaaactgttgaaattgcttttatcagctttaactaataggccttatattaaaacatatttagttactgaattgtaagatgtttaaatgtttatttaaagttacccgacttatgcttgtttatttatttatatatttgtttattgccttttccatatattaagaggcttaagaaatcaaaacaatgttgttttccaggctccttcacagtatcctgatgggtaaaatcatcttcatggttttaaaagaaccttccataacaaaaatgaaatagccattgcgagtgaggagaagggatttgtagaaggagtgagttagttaaagcacaagaagaagcttgtgaaccaacaggaactttcctatcagggtgggaacatatgttttggaagcaaatggtgggagggtgcaggctgtgacactcccttccccttttcatgtgagagctggctattagcctcattgcctgagtcaggcagagttccctcgaagggtttttatagcaggtgccgagctgacaagcccaactgtagaacacaggagaggaccagtcagttgtctcagctcccggacccatctcagttgtttctcagaggatctttattagctggtttagaaacaggaggacacttgctttcaagcatcacattgagtgggctggaccaaatccaaaactctgctggaaccaagttgacaaatgtcagtagaattgggagcccgctctttgaatacaaccttggaatggggcttggcacctggcctgaaagcgctgtgtggactccagcaccagggctgtttcctaatttaacttaatgcttaaaggaaatcccaagtggcagaccagttctgcactccttgagcagataggcatttagctgtttttaaatgtaaaatcattttagctgtttttaaatgtaatcatagggccagtatcttgtttctatatgtgtgtttgccccatatgatgaaattgtatgcattctttcagcaagtgagagtccggaggttctgtactagctagctgtgcaactttgggcaaatgagttatttccccctctgcttcctcatctgtaaaacaaagcaacggaaccagaaaatctctttggtgggcctgtttccaaatgtcttcccaaattaggatcaccatttaggtgaaagcgactagtcccccagccgcctctttttctggtgcagcctcatacggggaggtagaagatgggagggctgctttgctttgagcctcccagcttcctagctcttgaatgtagtgaatttcatctgttcatccatttatttatcaactttttgagtacatattttatgccaagcactgtttgagatgcttgggaaacatgaacaaaacaaagacccccgccctcatggaacttctacctagttggttgggatagacaacagcatggtaaatacattatatagaatgtgataaggtgataaaattctgcaggggttgcaggggagaaacatagagcagagcaagggagatggaggcctcgtaagttgccacacaccgtggtgtggtttcatcggctctcgctcacctgtcttgtatagggcctagggccttccctgaccactgtactctcgtagactagatcccttcctgcactccaaatagcaccacgtcacttagtgttggggtaatgtacaggttggtgctcctgtttgtttcttgtctaatcttctggaggactggtgttgatagtcctcaggtatgtctgaaaatcctgagcaaatatgagggactgagcgtgaacattgttgatttttctttactttctatttcttttttcttttctttttctttttctttctttttttttgagatagagtctcactgtgtcgcccacactggagtgcagtggcgtgattttggcttactgcaacctccgcctcccgggttcaagtgattttcgtgcttcagcctcccgagtagctgggattacagccatgtgccaatacgcccagctaatttttgtatttttagtagagacggggtttcgccatgttgcccaggtgagtctcaaactcctggcctcaagtgatccacctgctttggcctcccaaagtgctggggttacaggcatgagccactgcgcctggccacattgttgatttttttaaaaatttttattatttatttattttttgagatggaatctcactctgtcgttgaggctggagtgagggcagtggcatgatctctgctcactgcaagctccgcctcccgggttcacaccattctcctgcctcagcctcccaagtagctgggaatacaggcacacgccacaacacctggctttttttttttttttttgtatttttagtaaagacagggtttcaccgtgttagccaggatggtctcaatctccggaccttgtgatccgcccacctcggcctcccaaagtgctgggattacaggcatgagccaccgctcccggccacgttgttgatttttaaggataacatgataagacattaaatcctgtcagggaaacctcagaaaacccccacaactcagaggggtcagaaccagccattctttgatttttgtgatggctgtgcacccaaatacacaaatgggtgtgtttgtgtgtgtgtgtgtgtgtgttattttttttttacattaaataagattacattttttttccattgtaggagtatttgtaacatctcccgataaattgaaatgcggtaagaaagttctaagaacaaatttggggaatctctgacctttaaaggtactacctcattatgagcaatccagtgaccttattctagaattctgttagggttcgttttccacttgccatgagctggttttgcaaagaagaaaacggtttcctttatatgtggagattaagaacaagtttatctgtagttttggtgctcgactaactgggaaccaagccacagttgcttgtaaaacggaccctaagttatcttgatcttgatggttcagtgcttggaaatctctggggctttcggtgcctggtaaaagttcaatcacttatctgatttgtggttggcagaagaaaaggtatcaccctttcagtttaggagatggttgcttttagagtctatagtaggtaggtgtgcctgggaatcagccacctggtcccatgtaacattagttgattttcatggtatttcttttccccatcctgaaccttaaagtgagtcagattattactaatttctaatgttgcaatattttgagataagcggagacacttagatgttgcaagaccaggattggaaatgactatgttcaaaggcattaggacttctaaactctgtcaaattgttatgcggattttgggcatgttttgattggttggggctagaagaagctgcagcaaagcctgaggagagatgagggtctggtaagtcatggatcatcatgcttcagagctgcagccaccatccacctcaggcttcttactttcttggaaacccatgcctggaaaaatctaatgacttgcccagagctcaaaccagaccatgcatctgtgtgcccacctcatcttctgtcagcttcattcaccccaaaagcatctatatgttccagactcatgaggatacctgaggaactttggttttgtttttaaaccaaagagttttgagaggataaaataacaggttttgaagctatatggacacaggctagggcaaggagtgagaagacagctgagcagggtagggtgggaccagactcttggaactgctctgggcaggacctggatatgctgccaagtcagctttcgggaagttcggccatggaacttgccgtctttttttctgcattacacgactctcctgctagacggcaaaccccttgaagccaggagttttacaggccttggggcggcattgccttgtgtgtaacaggacccttctttctgcatatatgtaggataagagtccagcttaggggcagggttggagtaagtgaactagcacacaggagttgaaatagaagagtcagccaacaggaagaagtatgaggcagggagtgcctggaagagattggcaaatcctgaagtccttgccagcctacttgagtaatgtgagaccatgagccaatgacttaccttgtcctgtaagtttagtatccccaagatttctgcctcttgtaatgaaaatagtcctggcactgactgcaggtactgtggagatggggcgcctggaagattaaaaagacgggaaggtgcaggtttaactcctcaacccttcagagggagctttctgattccatgcatgatggctagtcagagaaatggctccccctcaaatgaggagtcttaggaagcaagaaaacctgccttggggtttgttctgaaggccacatttcatcacaaaaacagccatatttactacgctctcctacgaagttctgatgtgttctgctaatattcagctgtaaaccagctaggcaacatcagtcgaatgttagtataaattaaaacactggaggagactcaccgagagtgtgaacagattgtggttggtgtattacacgcctcaccttagggagagtgcttttttttcttccaggtggctttacaacgatgtgaacagcaaccttcctgttctttccttcagctgcatagataacaaataagacacgtaaaaaaaagattctgactcttgtggcccacgccattctgggacttctcccccaacctcaccgtgtcccatatcccctctgccttctctgtccagctacactggtccaccgggtcctcaaacacaacaaattctctgcagtctcagaattttgcataggctattccctctgcccaggaaattcttctttccttctccctttcctatagatcttaactcaaacatcatttttaacactgtgcttcccccaccatcacaagaccagatgctcttcttctgttatgctgtcgcagtttccagtatgtccctttcatggcacttactacaatttgtcattttatgtttgtgtcattattgattactggggtctcctattggactgtaagctccatgaaagcaggaaaccagatctcatttgttgtgattagatcctagtgtctcatacagttcttaatgaataatagtaactgacacttacatgatgcttactgtatattaggcccgttcaagagctttacttatgttgactcaacactccttgcaaaagcttttttttttttttttttagcatttaccttcttattacagtctttgaaagcccatggaattattctagggacacagaggactttgtggcatagatttaggtaaaggtcaccgggcacggtggttcacgccggtaatcccagcactttgggaggccgaggtgggtggatcacaaggtcaggagttcaagaccagcctggccaagatggtgaaacccccatctctactgaaaatacaaaaattagccgggcatggtggtgggcgcctgtaatcccagctactcgggaggctgaggcagagaattgcttgaacccaggaggtgaaggttgcagtgggccgagatcacgccactgcactccagcctgggcgacagagtgagactctgtctccaaaacaaaacaaaacaaaaaaattgcctggcggcatggtgactcgtgcctataatcccagctactccagaggctgaggcgggaaaattgctggaacctgggaggcagaggttgcagtgagccgggatcacgccactgcactccagcctgggtgacagagcgagactctgtctcaaaaaaaaaaaaagatttacgtaaagggcaaaatgctctggaaaaataaagtgttagataccagggagatttggccatagctggaaatgtttaactctgcgaatacttggagccactaattatgtatacttgttttattcataatttgtaatggtctaggatagcaaaagtaatgtgaatcatggttgaatttaataaaatgtttttaacctcatcctaaaatatccactgatccatctcattcaatggcaatatgcagtggttaagggaacataaaaacaaacatccacacagctgcacagttctcatgaaagtctatctcattattggtgggggtagcacatttaacagcttaaacatataggtcactgcatgatgccgcactggtaactagatagccagggaaccaactaaccagtaactgttaaaatatttaaaatacagcttttgtttagatcatcctttggatcaccttcttgggaaaaaagcctgctagtcacagtggaaatatattaaggcccgatcttctgatatccattcccagaggtttctttcagctagattaagcctccacctccagagcacacccaagtttgtgatctccagcattgatgatctcttgtctaccagagcagacagtgtgagcctcacaccaggcctcagagtctgtgtgtagcccactccaattagactagagttggtgacttttgcatttactggtttatgataaaggatacagatgaagagacgcatagggcaaggcatgcgggaaggggcatggagatctcatgcccttggggtatgccccacccatcaggaatctccatgtgttcagctgtgcagaagcttttcccaacaactttttaaagttaattagcattatccccattttatggatgagaaactgaaggcacagagaggtaagtgattgcctgaggtggtctggctccacaatctacctttttaacaaccacattatactgctcaggaactacactgaacttaacaagtatctattgaatcgtttagccgcagcatcataggtgagtttccaaatgatggaaatacaatcccataacttaaaatatagtaatgtttactgacaacctcctcagcagttatactctgcttccttcttcttcttctttttttttttttttgagacagagtctcggtctgtcgcccaagctggagtgcaatggtgcaatctcagctcactgcgctgtccacctcctgggttcaagtgattctcctgcctcacccactcgaggagctgggattacaagcatgtgccaccgtgtccggctaatttttgagtatttaatagagatggggttttaccacgttggctaggctggtcttgaactcctgacctcaagtgatctgcccaccttggcatcccaaagtgctgggattacaggcatgagccactgctcccggccactgcttccttcttgaacaccacgagccaaacatattttaactcttccttaattattcctgattgtctcctagcaccagttgttacattattgctgtctgcccatgagggtaagagatgaggagcaatggaggtaagagatgaggagcagtggattatcaggtttttgagtttggtttacttcctgatgatttctttggctgccaccaatttttttttaaattaaatagtctcccttaatatttgtataactcttacttttgaaattctcaatatttgttttgctttcttagtgtttagagagatgttgctattcttcagtttttaaaagaaaaaacaaatgtggaagcttagccaccttgccccacaatccagatgcccaggtccacttctgggacctagagaagatggcaataagattggatgacctggccgggcgcgatggctcatgcctgtaatcccagcactttgggaggctgaggtggatggatcacctaaagtcaggagtttgagaccagcctggctaacatggtgaaacctcgtttctactaaaaatacaaaaaattagctgggcatggtggcatgtgcctgtaatcccagctactcgggaggctgaggcaggagaatcgcttgaacccaggaggtggaggttgccgtgagccgagattgcgccattgcactccagcttagacaacaagagtcaaactctgtctcaaaaaaaaaaaaaaacattggatgacctccaggctaggcggaagcctgaccagggtagtgactttagaaagagagattcctgggaaaactgagaatgacagcagagaatatcctttataggatcattatagccattccacaatgtgtacatatatcagaacatcatgttgtataccataagtatatataaattttatatgtcaatgtaaaaaataaaaacaaacttttaaaaaatattttataatatggtcccttgtccattcctgcctgggacagccatttttcccttttcacgagggagttcttcctttgatgtctggaaaggcctcctctttgagcccataggtttgctatcttctggctggtaattctttcctgcttctgtttcctgccgaccacttgataagctggagaaagcaacgttgttcgctcttggccggttcctcatgctttgcccctttttctgagtcctgttttcgagcctcaactcggaaggtttggttgtgccagcacagtcttcccagcagtttcttgtgctttccaatctctattcaaacgtgtgaggctgcataaagatcgcttctcagagaagcctagataatagaaaacctatgctgaaattacagaaatctgatgtaatattgacatgaaaaagtcagtatcagaataggctttcttttgtgtgagcatcttattgctaccaagtgaagcagccatagcttactgtgtggggcccatcagtttatgcttggtcattaaaatgggccttacagttcaaaggagttgtcctgtgctgatcagtaatgcgcgtttccttggcactgacattaaaagaatgttggcttcatcaaaggaattggcagtggctacattatcatcgtcttcatcaaaggacattttttaaaaccattagaactgggctgttcaggagatctattatataacatggtgactatagttaataacaacatattatatacttgaaaatggctaagagagtagatttgaaatgttctcaccacaaaaaaatgataagtatgtaaggtaatggatatgttaattagcttgatgtagccattccacaatgtatacatacgtcagaacatcatgttgtacaccgtaagtatatataatttttatatgtcagtgtaaaaaataaaaacaaactttttttaaaaagactggtttgggtaagtgtgtattgtaggaatttttttatggtggttaaagctgagacctttgaccttttgttgtgttattcccattcccacccacttagatgtacagtgagatctcaggaattttcatgctgaacattttttaaagacccctccctgtataatttgcagtgccatttggtatattgggtttctatagagactctaaaaattacattttggtctcatccaaaagatccaaccctcatatcaaagtggagtgctgatcttcatctaccccagcaggattcaaagggggagcttcaggcctgaagtaatttaggctttggctctcagtgaaccgtgatttaaagtagtgaaattatagtgtggcatagtgggcaaaagggctagacggggaggcggagaccttggttccagtcctgtgtctatggttaactgtctgtggtgccctgggcaagtcacttcacctctctgagccttgatttcttttcctgtgaaatgagagggttgggtaaggtaatctcttcggtccttttcatctcaaaaattacacatcccagaagcagtaaacagtccctactggttgatctgcattgtgtggaaccgcatggacttaaaggattatccagctaattggagagaggaaggtggtatggtggcctgggccggtagagaagtgtgtgatcctcaaatcaacttcaaacaatgggggtcctggctggcagaagtcagtcaagccagatatctcaactcggggtgtatttcatagtacttcttttctagcctaaagtttggcaacatctggccagtgtaggtagcaattatgtcataaatacagttgtttgtaggtaattttaatttaactagagtatttttccactttctacttgactctcctgtctactcctctactgtcccctgcaagaaattcctaactaaatatgaagagcaaaattgacagtttcagattagttgctgttaccaggactgaaaaacttggtatgtaattaaatttttttcccttggggtttctacgtgaggacttcttttttttttctattttttttgagatggagtttccctcttgtcacccaggctggagtgcaatggtgcgatctcagctcactgcaacctctgcctcctgggttcaagtgattcttctgcctcagcctcccaagtaattgggattacaggtgcccgccaccacgcccagctaattttttgtgtttttagtagagacggggtttccccatgttgaccaggctggtcgcgaactcctgacctcaggtgatccacctgcgttggcctcccaaagtgctgggattacaggcatgagctactgcacccggccaggacttcttaatagtaggtttaactgcatatgagtagacatactcaaatggataaaatttgactttttgtaaggccaatggtgcacatacaaatttatagtctgtcaggcctgtattagtttagtttgtttaggatgtttctccattaaagtaaattagcctgatacgtttcttggttgttactagatatcagttgatgctgtttccctttagcaaagacaacaaaatagagtagtgacacctgcattctaaagctcagccactaaatgagcatgtaaccttgggtttcagttttcctaaagtgtgggatttggcttagctccccaggtatcctgagggaccttagggatttgataccaccctaagaaaaagggcttgttttcctaaccacgtcagggaaaacgatttcatgtagcaccattcatgtccagatatgtttcttcttccaatgatggcaatgtaagttgatggcagagcaaccatgaacataaacagaactgcaaatggttgaactcagacactcagcccaggccccaaaaccagtttggggggaactgtattcacctattatgaaattagcatacctttgcattcaggaatacagtggatttatgaggtacttttttttttttttaatcagatctattaaaggaggacagtagcctaaactgaagaagagtcctaactgtcttgggtggtggttaattacaccatacggcagacttgccacaaacactgaaagtttaactctctcagctgcttagtttggaaaccacacagtgctgttcagttaggccttggccttttctgcatcccagctagacacttgactcccatccaaagcaaatgtcatggttgcctttattgacttaatatcaggaaacataacagccgatagactggttagaaggaactgtatggttgatggattattgctgacctacacacaggtaaacgaagtataacagaatttggaatgatttactggtggactgaaatctttaaaacagtaagacttttgtttgtgtctatggctgatgttttaattcagttctgaatgttcttccacagacaggagactaaaagtagtgaaatatttgttactcactgttcaggtggctgtatagaaatctccatatttgggtataagtactttgctgcagtatgtgtaaatgagatgagggtcagggaacagggtttgatttgaataaaaatctgttttgtaggccagccgctcaagcctgtaatcccagcactttgagaggtgaggcgggaagattgcttgagcccaggagttcaacaccagcctgggcaacatagtaggaccccatctctacaaaaaatgaaataaaaagccaggcatagtggtgcatgcttgtagtcgcagctactcgggaggctgaggtgggagaatcgcttgagcccaggaggtcgaggctgcagtgagccatgatttgtgctgctgtactccagcctgggtgacagagcaagaccctgtctcaaagaaacaaaacaaaacaaattttttttgtatctgtcttaattaagtctttacttaacataacttcaaagatagtcctttgtgagcggagagttgagcccctcctgatcattgtgaggcttttactctgagggcttgctttaatcattgagagagttttatgtcatggacctttgcacttactgggcactgatttcagtgttctactgctttggtgaatttttgatgtctttttggccatgatcggacagtctcctactatgtgatgaaatggtattagaaagcggtactctgctggctgcctttataaagcagagaatcacaaatgcccaggctttgagtttatagtctgagacagataatattgctgcaagtagaagaattgtagacacagatgtccttgttttgaatatcctttagtgcctttcaagggtctgtgttatagaataccattttgaggtacttcttcctgttgttttgatgttactgcacaggttgagtgagagagagcttgtgtgtgtgtataagaaaccctgtaggactggtgtcctatgagagaaagagacagcgagcttgtgtgtgtgtgtgtgtgtgtgtgtgtgtgtgtgtgtgtgtgtgtgtgtgtgtgtgtgtaagaaaccctgtaggactggtgtcctgttatggcatgccagaaagtgtcttactggtatttcttaaaatcagctgatccatcctgtggctttcagccggttatagccagcagaataatccagtctatttgccattactcattattaacccctactttcttatccatctagacagcacccctcaccacatccacatgtgtggtggatcagccttatcttgctttttttgataggtgctttggcataggcacattcccctgtgtggcatgcccttcccacctccaagcatgattgccaaggttaataattataagctctaattccttagcacattctaatccacttgaaatcattattctacatttagcaacatgcacttttaattgttctcaagatttcatatgtcctaactgggcagtaaaacaaaatatcttggaaatctttcttatataatccttctctcacttgcataacttgtttcaagtcttacctttaatactgtaatatgtattcagtagccaactaaaaggaacccttaacgccaatttattgctttacctctgtgccaaccatccagtagatttgagtcctggcaaggaaccctgcactgcaaaaggcagcctggctgttgttggcaggttgcgggttccaggaactgaggtacacatggtattgtatgatattctattgtccttgctcaaattatgtaagtatttttagtttggaggaatggttttctttcttttttttttttttgagttggagttttgctcttgtcgcctaggctggactggagtgcaacggcaccatctcggctcactgcaacctccgcctcccaggttcaatcgattctcctgcctcagcttcccaagtagctgggattacaccatgcctggctaatttttgtatttttagtagagacagggtttcaccacgttggccaggctggtctcgaactcctgatctcaggtgatctgcccaccttggcctcccaaaatgctgggattacaggcgtgagccactgtgcccggctgttttcttaaccttaaataaataaaactaaagttgggattatgcaatataacagtaatccaatgaacacagaggactattagcaaaacaaacaaaaacacacacacacagagaaaaaaccagcctctgaacaaattctagacattggtgtgatattcctaaaacaaatttttattattagccagatgattatataaacttctggtctgttggagtggaggtgtgatgggaagaagattcatagaaaagatttttatttgaagtcttttttttattattattatttttaagcttatgcctgtaatctcagcaactcaggaggctgaggtggaaggattgcatgaggccaggagttcaagaccagactggtcaatgtagtgaaactcccgactctacaaaaaatttaaaaattggccaggctggtgtcacacacctgtagtcccagctacttggaagactgaggggagaggattgcttgagcctcaaggctgcagtgagctctgatcgctcaactgcactcccacctgggtgacaaagacctcatctcaggaaaaaagaagaaaaaagagagagggatgtacagttgggttggacttgatccatttacatgccacctgagaagtgtgtgactctcttgttcacaatcgtaggttttctgtgtgtgtgtgtgtgtacacgcctttttttttgcagggataagatgctccagttttgtaaatggagcagagattataaacctcgttaagtatagatcactggaaaactgtgggtatggaacacgtgtgcatgacactgtatcttgccattgacttagaggtgaaaagtctgtgccattttaatgatcttatttctgaccctttttttttgagatggagtctctctctgtcacccaggctggagtgcagtggtgcgatcttggctcactgcaaccccttcctcctggattcaagcgattctcctgactcagtctcctgggtggctgggattacaggtgtgcaccaccacgcctggctaatttttgtatttttagtagagacagggtttcactatgttgaccaggctgttctcgaactcctgacctcaggtgatccacctgcctgggcctcccaaagtgctgggattacaggcattagccaccacacctggccctgacccttgttatcaggtagtcaacctgggaatcagttcttgaaatgtatgtctgaaattgacaagctgcatttttttttttggcaaaagcaacatttctgaaacccctgataaggaacattcagctttcacacgttctgaatctcagaggagcttgcagggtcttccctgctgtacttaccattgcagggggcaacaaggcagtggtaagtggaaacaaaccaaaacttcagtgataaggctgctgaaatcaagccctgtgttttttgtttgtttatttgtttgttttattttgagacagagtctggctctgttgctcaggttagagtgcagtagcactgtcttggctcactgcaacctttgcttcccaggctcaagcaatcctccctccttggcttcctgagtagctgggactacatacataaaccacaacacctggcaaattaatttttttttttttgtcaagatggggtctccctatattgcacaggctggcctgaaactcctgggttcaagcaatcctcctgcctgggcctcccaaagtattggaattacaggcgtgagtcaccatgcccaggaagctgtggtttttttgctggttgttctctagccactgatgagcttgcctccctgcctgaccagtcagtcccaaatgcaagtttagaaactggtggttttttgttagaggccatttcatttgtttttgtgctgtttgaacacctgtctgcccctgtgtccataattctctttactgaaaactttttctaaatgaagttatttcagaaggcatttaagaaaatatttttttcttacctgaaatatatataagtagttaattaatggaagagccctaacaattagctgaattcacaatattagggaatgattaaattgttggtgatgtacctttcaatcatctctgcataagcagttgatagccacttctgtatctttgtagtaaatgcagagtgaatggtggattttatgaatggggaagctgctggattttgtgtaacattgcttttttttttttttttttgagatggagtcttactctgttgcccagcctggagtgcagtggcgtgatctcggctcactgcagcctccgcctcctgggttcaagcgattctcctgcctcagcctcccaagtagctgggattacaggtgactgccaccacatccagctaatttttgtgtttttagtagagacagggtttcaccatgttggccaggctggtcttgaattcctgacctcaagtgatccgcccacctcggcctcccaaaggtgctgggattacaggtgtgagtcaccacgtccagccgtaacattgctttatgatcagaacattgaacatcaggatccagtgctggtcttgtgttggctttcataggagggagacttgctgcagtccagctgagtagggctgcagtgaggacccttatactgctgaagcccactgagtgacacatgctggacagagtctgatgtctgtggggaccaattagctaatggatgtttagttttaggctagactagatgcctgccactacccttcccaccctccacagttactgttggttacttcctacaagtcaccatcaaagccaggagtatatattccactttttttttttaacctcccaactactagttttaaaactgaatcaaatttcaaatggttgttaacttgaaacagatctgcagactcgacattttctttccattttcaggctctctggaaaccagtgtgtgtgccgtagggtatgttgcttgtagagaaaagtgagcactgaggactgaaatggctgggcaaagacaaggcacaagttcatctttgtgaagcagcgtttttcagtgttcaggtacaaatagttctcagctgtgctcagtatcacacaaggcatctggaaacatgtttaattcatgttagctatagcaactacatttgaactcaggcatgttcatgcttttaaaaatgccagaggggaaaaagccagaaaatttgtcatttttgtttgccttatgagagaataacactgttccgagtggctcccaggagtttcgatttggtacagttgagagccttgagaagaacctgccagttgtaatagtttgtggcatttctgtagacattgtgattgacagaattctcagttgccaaattcagcttctctctaaactttgtatttttgagatttttccaagactaaattagtcatgtgattagtgttgttgttgtttttgtttttgagacagagtcttgctctgttgcctaggctggagtgcaatggtatgatcttagctcactgcaacctctgcctcccgggttcaagcaattctcctgcttcagcctcccaagtagctgggattgcaggtgtctgccaccaggcctggctgattttttagtatttttttttagtacagacggggtttcaccatgttgactaggctggtctcaaacttctgacctcaggtgatccacccacctcggcctcccaaagtgctgagattacaggcatgagccaccggtcccggccatgattagtgttttattttgatccataaaccaattgtagaatgttgctcttccagtggcttccaagatgctcagacaaggcaggtggcttttgtttccactagtgcttccactagtagcaaaggagcactgatatgttttggtgaatattaaccctttttaatattaatactgtgataagatatacttgggggcacttagttcattatggttgtactgtaggctttaataacagcaaactcttcttattcttggatgcatacattcttattgggagacccctgtgtttctaaactctggtcccttgtttggtggagattaatgatcaaaggtggttgacttgcctactatcctgaggtggaaagtgcttcatgtggaacttaggcacttgctgaagctccttcgaattcaagcttctctcctacctgctagcttgtccatctcctttctactttgtgaaaacttctactttgtgaaaaatttgctaatctacagattagcaaatcatattattggaagtttaaaaaatgagaaaagaagaaatattgctataattttgcagtattgttttccctttcttttttttttggagacagagcctcgctctatcccccaggctggcgtacagtggcgtgatctcagctcactgcaacctccacctcctgggttcaagtgatttcttctgcctcagcgtctctagtagctgggattacaggcacccaccaccacgcccggctaatttttgtatttttagtagagacgaggtttcgccatgttggccaggctggtctcgaacatctgacctcaagtgatctgcctgcctcggcctcccaaagtgctgggattacatgtagtcatgagtcaccacgcctggccctttttttccctttttctatctgcatttttcctcattgggtgtgtggtggggactgtttgggctgcaagtgacagaaacctaattctaacaggcttaagcaaagaggggaatttattgtaaggactggagggtctctgagcccaagggcaagaacttagctgggcctgaggagctgtggaagccagggtgggctctcccagtcctttcagtcatgtttcttctcaggctgctttctgtttctgtgtctttctcattcagctttttccatgtggcagaaaacacattcacagagctctctgaagttttatttccattttatttatttatttatttatttattgagacagagtctcactctgtcacccaggctagagtgcagtggtgtgaccttggctcagtgtaacctccctgcaaactctacctcccaggttcaagcaattctcctgcctcagccttctgaatagctgggaatacaggcacatgccaccatgcctggctaatttttgtgtgtttagtagagatgggttttcaccatgttggccaggctggtctcgaactcctgacctcaagtgatccgcctgccttggcctcccaaaatgttgggattacaggtgtgagccaccacgcctggccttatttccactttagccacccagagtttaactcactttcttgtgtggcctcccaagacctgttgtacagagtggttattcctgtggtaactttggggggtggaggagggctcagcagggatttccacttcttggccccaggtatgcataatttgccctttcatttattcatcctccaaactgtcacacctaacataatccagccatcccacaccaagctgcacacccattccccctcctcagtggcagacagccccaattcacttagcccctgtttactcatgaactcccagtggccttgtcatagggccacagttctccaggcccaggtacctgtggttcaggtggcttgtcaccatctggaccctctgggctgaaataattctaaccactcccaaacagtgacctttgcatccccggctagggcagataccacccttgaggcttatgttttcctggccgatttatactctgatattaatttcctagttccagaggtagaattaaaagcactcttcttcctcagacttcaggctttgcacagagtagactcggtaggtggcaacacagcttactgtcctttctcccattccagggagtgggcccaggccctggccctgggcaaagcgaagaggtgggatgtgcaaagttctagcagctgtttcactccctccgttggtgggtctccaccacagaaaaggaatacgggaccccagagtatttgtcctgccacctcaggctgccccagagagagcctgtggggccttccctttgaaggattaactaggcatcctggctcttaccgagagtagccgggccttctgggatcaggctcccatgcacaaataaccccaatccttttacatttaatgctccatacttctgtatttcaaaaatagcatttgtgccagaattcaaactgttgcagtataagcaagttgcattggcatttttttttttaattgaagacctggggaaaaagctatttgtaggatagtatgtgacaaaagaagagaaaatctcattacaagggtggggttgctgaagggacccctacctcaaaagggaaatcttatccaggaaaccttaccagctgtcacctgcatatgcgtccgtgtgtacatgtgcgcacacacctgctcccatggaaaccctgtggaatgagggtacaattcctagcaaagccagaagacaggcagacaaaaaaaaaaatctgtccagtataattgtaaccacagtggatatcaaatcttggattctatatttaattgataatgtatataagcatttttctatattgtagatttttccaagtgttattttaatgataattatttcactgaacatatgtctttatttatcttagccatttagatattattggaagtttggttctttccagtttttgtgtttataaatgggacgtcatgagtatcattgtgcacagaactttttccatttctggagttatttctttagagtatagaagtggaattacaggatcaaaaactaagagcacttttatattttccagaaagatgatactagtaattttcagtgctactagcaatggatgggaaatgtcacagcctttggttatttcttttaaaattttttttgttttgttttaagtttgttgagaaaaaaggtacattttaatttaaattttatttttattctaagtgaggaccagtttggggttatgctttttattcatttacttttataacatatctttactggaatcttagtgttttattttataaattctttgtataatgaaagctgtttttcctattttgctttaagcattttcccctaattctttgctttttaaaatttcatgaatgtgtgtatgcgtgggtattggcattcttttttatcataacgtcttatgagatgcccaggttttagagaatagaataggcccaagagaaggaagtcagaaagctgagcatactttgcccctctgtttcagtggaggttgcccatggattatttcagaattcttgtccttgtaatgttaggtcatgagcctgcctgtctgcaggcaggatcactgcttagagtgaggtgacctgggttctagtcctgactgagtgggaatttaggctctccaccttccatttcttcatctgtaaaatggagggttttagtaggataaccttgggagtggggggggtctgtgattgtacatgcccaaggtgaagaatcatatcaacattaagagtcttctacatctcgttgcagatttttggaagtaccagcacagtgacgcttcctgaaaccttgttgtttgtgtcaacgctggatggaagtttgcatgctgtcagcaagaggacaggctcaatcaaatggactttaaaagaaggtaatttggatttggtccttgggcgacatggacatttgcttaactggttccacagaaacatattctggagaaagagaaaacattactcattatctaataaaataaataagaaataaagaagaatgggatcaagagaggaaaaggcattctgctcaaaggacgtttatagctttgctgtggttatccactaagtgcatcagttaaagaagcacgttttatcttcttttttgcttctgtttagacttcatgttaaaatggctctaggcttttctattaatagctctagctagttggtctttatgaagacatgctgcactaaatttgttctcatgattagaatcttgtaatcataattacaagaaggtatcttctcaacacctcaaattactcatttgtttttatagaggctgaaataatagagggctgtaagatttgacattcatccaagttaaccactttattgggttgttatggtgaggggaataaagactgagcttctttcttacttaacataccatgcgtccatgttatgatctgatcttcctggtggtaactagcagagtcaagccctacagctgggaaattgtatttgatttccaaagtaatctttccagataaagccatgcaaatcccaggatttgggactttcagagtcatctatattatttaatctgtctagtaataaatctcatttggcccgaggttcgggtctgaacagcatcgttctctttcgtcactactctgtgactcattactttcacgagcacagccaatgtttttccttccttaataaagtgttccaaaacagtatgctagatggaaaaatattggcatatgtcagaaggtcacacattgtcttgtgaattcagcagcaaacctcgttaccatccatagatgatggcagctgggttaccacaagccatcctgccccacctgcatgggccctgcttggatcagcaggaactttaagcagcccaaagaccagctctctcaggagtgtgtggccacaggaagactgtagagtgttttattacaggttccaagaacatcatctgtactgtatctccatcacatttaagccttttaatgtttttaaaatgaaacagagtccttcaaacttcaggatttcctattttgtccagagatgaaaatcaacaaatcacacaagaattgagagaaacactttggctgtggaatgttagggcatgtctttcagtttcattgttcccaggcagggcatcttcaccctgagccacttcattctgctttgcttttccctgcacataatgctttaagttggttttttccaagtcttcatttctgcaagtaatgtcatctgtatgcaacaaaactgtgtcctctccgttacttagtcaaacataagaattaacctgttttctcttctaacttagagctgaaagaatttgcctctttttaactcaattgaatgtgtatttagagaacctagaatgtgagagatactgtatagcagcagtgcccaaccttttttgcatcagggaccagtttcgtggaagtttttccatggaccgggggagcaggggcagggaatgttttgggatgactcaagtgcattacatttattgtgcactttatttctataattattactacattgtaatgtagaatgaaataattatacaactcaccataatgtagaatcagtaggagccctgagcttcttttcctgcaactagacagtcccatctgggcgtgatgggaaacagtgacagatcatcaggcattagattctcataagaaacatgccacactacacttgcatgcgtagtacacaatagggttcacactcctatgaaaatctaatgctgccactgatctgacaggaggtggagcttaggcagtaatgccagtgacaaggagcggctgtaaatacagatgaagctttgcttgctcactcactgctcacctcttgctgtgtggcccagttcctaacaggccacagacccatccacagaccagtatgggtccacaacctgggggttggggacccctgttctgtaggaccccaaaatgaaaaaggcagaccttgtcctcaagaagcccatgatctaaacccatggtgaaaatatgagaacacaggacttcaacacagccgagtcctgtaaccactcatgagagggactagtaatgtgctgtgagcccacatccatttggagggcaggaggctctgtgaagtggggtgtcagaggtaaaccctggtgaatgaattgagttcagtcaggagtgaggcctggagaagagcgaaggaggcagcaggtctagggtgcaggagcttatcccgtttagcaggagcttagcgtttccaggtagagggagggaggattacaaggggatgttgagccttactggatggagcacttaggcatttgtatctgactgaacaggaaattgggagctgttaatgtgattgaacaggtgagtgactcaacaggtgctcgcttttcgatgactctagcagctgtgtgtgggatgactagaaacaggaagcagacctggaaagggaggagggatgggaagggtgagaggcaagccagaaatagaatcagtagaatctagtgactgactagggaggaggagttacaagacacttaaagaagaattagataaatccaattaaggtctaataatttcttttcttttcttttctttttttgagacagagtttccctctgttgcccaggctggagtgcaatggtgcgatcttggctcactgaaacctttgcctcttaggttgaagtgattctcatgcctcagcctcttgagtagcttggattacaggcatgcgccactatgcctggctaatttttgtattttcagtagagatggagtttcaccatgttggccagggtggtctcaaactcctggcctcaagtgatctgcctctcaaagtgctgggattaaagatgtgagccactgtgcccagcctaataatttccagtagtattcatgatgatctgtttttctaagaataaactggcatgttttagttcagccctggataccagtggccttgacttatatttctatacaaagattaaagatggtaatgtgcagataccctgagttttcagtttaatcttgtggttataactgaagatttcaacatttttctaaattgttaaatatagataaatgataaaggtatccagatgctactctaggtcctgaggatacagcaagtgaacaaaacaggcaaacccttttatcataaagctttcattctagtgggaaaacaggaaatcagttacttagtagtgacgagaggtttgaagaaaaaatgaagtggggacatggaatgggcagtaccaggttggggtgggagtctgcagttttaaacagggagggctccacggagaaggtgtcatttgagcaagagctcaaggaggcaagggagtcttgtagacagccggcatagcgggtcaaaggtggagtgtccttaaaaaaaaaaaaaaaaagaaaggatgggagtgtccctggcacggtagaggaggagcacagagttgatgtggcgggaggagatcagctcagagagagatgggccagtcatacagggcaggagggacccagcgcttcctttacttcacatgtactataaagttgcttactgaaacaaaatttatagtcagtaaactacgtatacacagtttcaaaaagaaataaacatattaccgaactggtaatctaaaacaaataataggaaagtatttttttaatcacatagatatagcatgtaaatgctcggacacacgctgacactccccccaggaacaaatgctgtgcctgttgatgcagatggagacaagtgcaggatagtttaccaccatagccacggcaactggatttccaggacggtgaactgttcttggtagtgtttcaaacaaaagaagtacagccttacctgccttacacagtagttacgttccaagaaaattctgtatattatgaaaaagtacatttgtgcttatgtgtaaaacaggctatagcctcggataattagtaaagggttttggcccatgagaatgtctggcaggacatcagagtggcatgcagatgcagggcaatccttggttgtacaggaccgctagcatccctggtcccccacacttagtgcctgtaaagtccgctagtctctgtgaccaccagaaaataccttcatcgatttctcaagcattccctggggagctgtgctctccctacggataccactggtgtagggcctagtggctggtgtgaggacattggcttttcctcagccgttggaggaacctgaggcaaggagcaacatgccctgttgttctggactgaatatttgtgtcatccttccactgccattcataagctgaagccctggccctcagtgtgatggtactttgagatggggcctttgggagataatcatgaagatggggcccttaggatggatgagtgtccttatgagaagggagagaccagagctcgctcattctctctccaccatgtgaggacatggtgagaaggtggccgtctgcaagccaagaagagagccctcaccagaaaccaatctcagacttccagcttccagaaccataagaaataaatttctgttgttcaagccctctagtctatggtattttgttatagtagtctgagcagagtaaggcacatggcctccactttacaagatcaacaagtgctgtgttgaaactgaacagatggggccaggaagaaactgggaggccaggcaggggtgtactgcactagtccagacaagagaggatacaagcttgggtctgagtctcaaagagggattcagagctgaatggaataaacttgctgatgcaaacacatacctttaactcaccaaactggggttcttcagaatagaggcctgcaactccattcggctgtttacttttttcaggagccaatgaactggacatttttatgtatttatttactttttttttttgctttctgtggtggtttggcaggtgcttttgttcctcagccaaacgtgttgtagttcccagaaatggtggtttcttacaccatagtggcaaattatacgtaatagagaaaatgcgttttgttttctggaactcatttgggttgtgacattttactttaggggccatccttctaagcactgattttgtagctgtagtctgtctttctctaaaacctcaccagtgaatagagttgaatatatttcatctctgtacttttagacgaaatgcaaactgagaatgttgccatcatgttttgttttagattagcttgctttggcctgatggagttgagaggactttctttagtatttccagggctggtgtagggcttcttgagctcaccttaaaatactagttaatgctgatatttaacactcaaatccccatcaaattacaggttattctatagcaaccctgctctattcttttctgtctcctttccaataatagtaggcatgaagagctgggtcaaattagaaccattctttactaatcatgaaaatctgctaaatatgcaatatgactactctcctagccagctgggcccagactccggagatgtcccttgagtggacatttagataaatgataaagctatccagatactactccaggttctgagtatacagcaggtgaacaaaacaggacataatactggagatttcttaggagggaagagtcagaacaaagttatttgaaatttgaagacaattttattctcacgtgagtgtctctttctaaacatgtgcctcttgccacagttcctccctgtgctgacagaatcacggccaagcagtatagaaactagagaaaatagaatgatgctgtgctacttcccccttgatgcccagtggtcaccaagccctgtcatgcagactgggaaggaccctgcaaacctgactcctctctggccccattgctggtgccttagccaggctcttggcacttatttcctaggtgaatgcagcagcctcctgaccaccatccatgccccccgcaccttagccctctcgttcactcatcacactgccctcagatacacccccaaaaagaccaattggacctagctgtacccctgcctgctgaaatgctcttggtgttgtctatagtggtggcgttgtgcctgcatcagtgtgtgtggtgtgttacctgtgaatgatgaggaaaggataaatagggagcgtgagcatcatccatgatgggttggccgtttcaacaactggcccttcaccactgctagtttgagaagtgctgctccacagggtcaagtctaagctccttagtgcatgtgcaaggccattcgtggtctctcaccgccgcccccccgccccaactccctgggctccctcccctgcccagcaggtgccctacttgcagccatgtaactccttaccaggccttggagacctctggcctttgctcatgctccctctctaccagcagcctgcaatgttagacaagctcctgttcatctgtgaagaccccatttacctccctggcttctcaagcagggtgagcccattttttctctgggttctggaggtgcttttctgaaccctctgttgtggcacttctggcttgtgttgtaaatttttgttctcatttgcttcctagtggatttctacctccttactggggctctgggcagccaggatgctcagtaaatgtccaaggcacttgatgctgactcgggtcccagaactcttctgcctggacgtcttttgggagtcctgagaaacaaatgggacttgactgccttctcaggatgaatcatttgttgcttgtatcatagtcatgacagtttccggttctggtttctgatcttgagttttgcatggcctttggcagttggtttttctgtcctgctttaggcagtgtgtgggactctggaagagttggagatctgtcttcagaagtgcaatggaaacatgagaaggggaaattgtgaaaagtgatgatgttttgttaatagatctaacctgttttctctcaaggacttttctaggcttacaatatgcatcatctacctttttaccctcactgcttaagtataagaaaggtgtttatttcctcttcattgttgtgaaggattgaaaattaagttttatgaaaggggctgtgagagaaacctgtttttacttttgagcatcttggaaatgtgttggttctttctttttttgtattttacttttaaacatagacggtttaaaacatatccaaatgtagaagtattatgtaaagaacccccatgtactcatcactcagcttcaacagggactggtttgtatctagccttgttcacctgcacccccactcactttcttcccttatttttgggacttgcttcaaagtaatgcatttctcatttcggatggctcctcttagcagctgccacacacgtagtagcgtggatctcagctccgatgggtcgtctttgcagcattggttggtgtgtgttggaatatggttgtgattgttgaagtacatggataaagtgccttattttgtctgtgacttagttacctgtccctttgttcacttttgagtgtctggtttgatggcactccatcactcaggaatgaattctgtgaagttatgacatcctgagaggcatttggacacaggctgtagtgttgaattgtcttcagtgccttcatgattgattataacgttcagtgtgttttttggcctgagttacttctgccaaagtagagataaatgagaacgcagtagacttcagctgcttttagtatgggcagttttccggattacttggtcatttctatgtgatcgtctttgccaagtgtgacacttcgtgacttatggaggttacctccaaagaaaacttattacatccttttccagttctgctgagattagaaattgaggagcttttgattagatgtctttaaaaaaaaatgctttcctcatgaaagctgaactgtaaagaatgtttgagactttctgtcttaaaatttggacctaacagctttaatgggagtttatggcttaggttaatgaagtgctttttctctggagggaaggaatgagctgccactggggagaagtactccctaattgggccactcgaatgtatgaaacatatttgggagactgaaggtttgagttaaggaagggtgaatggctttgtttctgccagtaatttttttttttaataagaaaacagtattagaaccttaagcacattcttgagaaaatagcagttgtttacctcattcagactatgcctttctagtttcactgttacctgtcagccagggttaaaatctccatgtcacctttaaatcgttcctttctcccactgcatttatctagacagggctcagttttgctgacactcttttccctcctgtctgtttctgactcccctccaccccggctcgggtctatctgttgcagcacctttgtgattccttctccctttttcccttcattttgtgcctcaatgcccgcctgtctaacttgccttcagaggacttgtacaggttgaatatcccttacccgaaatgcttgggacctgaagtgtttctgattttggatttttttaggtttggaatatttgcattatatttaccagttgaacatctcaaatctgaaaatctgaaacccaaaatgttccagtgagcatttcctttgcacatcacgttggcgctcaggcttcagattttggaacatttcagattttggattttcggatttgggatgctcaccctgtgtcacgttcctctttttttttttttttttttttttttttgagatggattctcactcttttgcccaggctggggtgcagtggcacgatctcggctcactgcaagctctgcctcccaggttcacgccattctcctgcctcagcctcctgagtagctgggactacacgtgcctgccaccatgcccggctaattttttgtatttttagtagagagaaggtttcaccatgttagccaggatggtttcgatctcctgacctcatgatccacccaccttggcctcccaaagtgctgggattacaggcgtgagccactgcgcccggcccacattcctctttttctcagaggcttccagttggactctagtgaccaacattccacatcacaaagttttcaaggctttcttccccatggtgtcactgcctgcagtccagcttcatttgtgttgttcctcaggaggaacatgtcacacttactgagcctgcgtcctctgtcccgtgaacacagtgacattttttcactcatgttgtcttgtcatccctgtgcttggggccggctgcctttatgagggttttctgctccgagtattccggtccccacctaggaaagcctgtggtgcatgccccatgttctagcagttcgttatgtgtggttcatgtgtattagcttcgtaactcaaaccataagctcccttctttatcctgcatggcacttaacagagaacccagctgaagcagatatctgacagttgtttctgagatgtgtttggcgcatctcaacagaaagttactagtagcagggttgtcagtcctcttcctcctcggcggggaatgggggtgcatgtgtgtagaggattacacagactataaagcatttgagacttcatctctgctctttgggtccttaaatacctttcaaaaggtattttgaataccaacccagaacatttaaaatcactgctagggttacacttagaagggactggtttggggactttctaactgtgtggtaatatcttagttgtgcagaagagagagctgatttccattgctgcgttatgggggtcagaagggtggtcagatggggtcagaaagaacaaggtggaggagggcagtaaagccagaggtcatctagagtccaacggaaaagcaaaagcagggtgttccagaaatatccgtgctcatctgggaaagataagagaaggatcttgcaaggctccttgagctccagttaagtgagcaacctgttcttgtggcttctgtaatcaaagggatcttacttcttcctacatggaaggaagtctgcccagagctacctccagagagaggccgtcaatctcgaagtctggtttgaaacaattatttaaattttggttgattgcatcaaagacatttttctgttcagctgacttatcaccccatgttttccccaggccctcacgaattttgccagccctgcatttagggaagcctgggatggtcctgacagggtccttcatgctcttaacttgggtttcccttcagtctctctgtgccctgtgcaactggaagagcaggctcttcagaattatgccacaggtgagagcaggaggaacaggccattctctccaacctattgcagatgtttgccttaaatagcttctgtttttagctttttttttaacttttcattttataaaaactttatacataccccaaagtaagaagagtagtatcatgaaaccatgtacccagcacccagcttcaataattatcaatgcggggtaatccctgtccctctcccttaaatacttttcaaaagggccaacccaaaacatttacagtcactgctagaggtacacttaaaagggactggtttggggacttcctgagtttctaggttgtgtgactgggtggaagtgggacccactagccaatctggggaatgtgaactgaggagcaggtcctgggggtatggccttgggctgagacacccatagcagttgcaagtgggactgggtcaggagtccaagggagaacatcctcagatgccatgcggaggatttgcaagtgttggttttgatcacgggaacttgacagtggcagttctgatcttattctgagggtaggggccggagggcagtgagtggaggaaggtaagaaggcaggaaggtggaacagaggattcggagcagtgtagtttccccacatggctcaatcacccagcttgggttataaaggcaaattccttgtctctacctacaaagccagcttcctgggggaagaacctaggaatcaacattctaaaaattccataggaatctctaatacattgctggtggaaatataaaacagtactaccagttttgcaaactgtttgtcaattttttgtcagaggtaaacaatatgatgcagccagtccccctccttgttttaagaaatgaaaataggctgggcacacacctataatcccagcactttgggaggccacggcgggtgaatcacgaggtcaggaattcaagaccagcctgaccaataggtgaaaccccatctctactacaaatacaaaaattagctgggtgtggtggcacacgcctgtagtcccagctactcggtaggctgaggcaggagagtcacttgaactcaggaggtggaggttgcaggttgctgagattgtgccactgcactccagcctgggcgacagagcgagactccatctcaaaaaaaaaaaaaaaaaaaaaaaaaaaggaaagaaaagaaaaaaaaagaaatgaaaataggtccaaataaacactcgtacacaaatgttcacagaagctttattcacaccagccaagaaaataaaaacaactcaaatgtccctcagcaggtaaataggtaaacagattgtggtaaattcttatagtagaatactatttggtaataaaaaagagcgaactatgatacatacaacaatatggatgaatttccaagacattatgtgagataaagaggccaggcacaaatgagtatctatgacgtggtcatttgtgaaattttagaacaaacaaaatgaactggtacttatctggagcaagatttggaaatactgaatccaaagggatgtgaaaaaatgttttagggtgatggaaatgttctgtatcttgatggtgaagatagttacatgggtgtgtgtttttcaagattgattgaactgtaaacttaaaatggttgcactttggaggaaaaggagagtgtgcagaagagcaggcagagccaagaggtttttgtgtttataggcaaaggaggagttgaagatccttggagacaggatctagatgtgagtgtgaaaaatctatgagtgtgaagacaaaagcattgtccctttatagagatgtgaagggaagggtggagctgggcaaatgtagaagacaaagggtaggaagtttcagcaagctcactcagtctcccttaatatcccctatgacacagaaggcagagtcatttgtggagagacagggaccttgaggcaaggagtagtttgaaatatcagctacaggggtgagaacagaagccagccaggatctcctagtggcaggggcctagctggccacaccatggagataccacgtatcatggtatctccactaatgatcgcagtgttttctacagctgtgctcagaaggctgggtggaggaacagggactgctatgcagatcctgggttcagggtgagtagagcttatctgctggattattaaaagtgatcaacaatggatttccaggctggccaagagtggaagtaggaaagaaactgcgctagtttgaatatttgaccctccaaacctcatgttgaaatttgattcccagtgatggaggtggagcctaatgggaagtgtttgggtcttgggggtggatccctcatgaatggcttggcgctgtcctcattgtagtgagtgaatcctcaccctattaattcctgtgagagatggttcttaaaaagagcctggcaccttctcccctctcgctgcttctctcgccctgtgagctctgtacactccggttcccctttgccttctgccactagtggaagcagccagaagccctcatcagaggcaaatgctaatgccatgcttcttgtacagcctgcagaaacgtgagccaaataaacctcttttctttataaattacccagcctcaggtattcctttataggaacacaaacagactaagacaggaaatgacacttaattactccattcagcaaatacgttggttaccacctgtgtgtcaggtattgttttagatccttgggaagatgcagacaacaaaaaataaatcccaaccctccgtggccagagttgggcattaagtaagcaataaaatatacagaactacagaggtggtaagtgacatggagaaaaattaagcagggaagaagggttggaaatcctgggcagtaggaggtgatcatggaagaccgctctgaggtggcaacagttgatcaaagacctaggcagaggaacagccagtgcaaaggtcctgaggcatgggcaggcctggcagtgcttgttgaatacttggaggccggcatggctggaatggagtgtgtgggaaatagtgggagattgttaaagggtgacaggttgaaagggagggactgcttgggatttatgaaccactgtgtaaacactggccttcactgagtgagatggggaaccaccaaaggattttgagtcacagagaagcttaatctgatttatgcctttaaaaggatcactcttctcagtgtcaaggcattgacttatagtcttgacaaacatttaatccacatagagatgccccatgaggttgatgttatctctattttttttttccttactgatgaggaaattgaggctccacgagcttaagtaactttgccaaggtcactcagctggtgattggcagagccaggatttatgccttggtttgtctgattccaaagtccacacagattaagagaggagggaaggcttgagagacaaagggttcctatggtgttgaagggaatgggaacaggacacagaattatggttggcatcgaaacagaccacagagtttggcaactgatagcatgtgttagggagaaatagacatcaacagtgtcgtttgagtcatggctttcttctaggagaatggtggtactgttaataaaatacggtagtcaggagtagaagccagtctcaggcaaaagacagagggcgtgacttgggcaagcagaggctgaggcgttggtgggaagtagtgggcgtgtccagttgatccagagagaggacccgggagaggggagcctagaaccccactgtggttagggtggaagttatagagaggcatgtgctctctgagtgagaagaaaggctgaagggagaagctggcaatgttcctccctgtgtggaggagggagtggggacaaaaattcactgcttttggggacagaaatgtttaaaactttacccttatgaacttggacaaaggaaagatgtggacgtctgttttgttatttgagcttaaagaagtgatttagattagcctagcaatgagcatcttgtgacctcacccaggatgtcagttcctgcaggtgtaaaacttgtgccattccaggcctcagctggacacacgatgggggccggggagtggagttgaggccagtggctgctcccaggggatcagtgagcaggtttgtttctttcccgtgttaatcctgggagaccaaaccttgatttcagctatattttccctctacctttaccagataaccttacctttaccttacataacagccactttttatatttgtgaagtaactcccccacaactttttttttctgaaagtaaaacaacttggtgacattggcttttattcttatcgggccccatatagatagtggcttattttacagcagtatttgtttacatccctacaggtaggacagtgtttcttttcacatggctgaaaacttttttttttaaagcaagaatcttacctgatatcagttctcattattaaatcaaaaccactttttcatgttactcttttagtgcacattttcagataatgctctttttatttttgctgactttccaaagataattttctctttaaccttttttaatatgaaaaaatttaaccatatgtacagagagtagtaaaataacactccagtgttcccgtgtctcatctttaactgttatcaacagcctgccacttcttgttttatctgtcctccccgccccccgtataattattttctgtagtattttaaagcaaatcttgaattcagatgattcttaaagaaaaacatttacagaattaggtcattgttacatttcagaagccaagcagcagtgtgtctgcctctgtcagaactgtcttaataattgtgtctttacctgggctgcagctttgaagaggcttattccaggtgcttattttactgagtggatgggaaatgctaagataaccataaggccctcctactggagtttatcttctcctaagcctagaaaaaaaaaatcacagttcttaaacaccaatgtagttgtcccgggaatcttcccctgtctcctgccaatgtcctgaatcttaactggaaccttcctgatacagggcatatcttgggacctgaggcctcagtgtcaggtgaccagtggataagctatagaaaaccaggaaaatctgcatctgaagacgagtctgtgtgactgagcaaacactgtacagcaaagatcaggttatgaacaggaatttaaatcatgttggtctgcatgtcttgtttctggtgaattcctggaatttggccatgtcctcttaatctgtgtttatctgtgatacctttaagtggctgaaacaaacaaaaaagatgccattttactgctgtgttttcttcggaatatgatattcttgctcttcttggcttgcatgccttcaggccggtgttaaaataactgggttattgcaccttgactagcttgtttcagtaggatgagtgtggtgtgcctttatttcctgtctcttgcatcagtctgtttgtgagagtgtaccgagaggtgattaatgggaaagataaacatgtgcttactgactgaaagttcttcctgtttcctagagtgtttttggtttagtgagttgtttgtttgctgcccacagaccgcatatggtgtgtgtacacctctgttgttgtgaacaccatatgcctttgtataggagctgggcttttaagcaaagtcaacatatgataaggcttaaaagattttccttcatccaataattggatggattggacagccgtctgtcaccataagcagagcctacagagtctggaattctgcatacaaaatcatgtaagaatacttgctgttcttgccccccagagattaagttgtgtatagcatggctgtggggttttggttgctggaaatacctcatcgctgtgagtctcctgcctgcggacttttggatctgtcactacacagtgctgctgtgccagtgttcatgctctctcactgccaccaccatctgcccctggaatcaggagcttcctcttgctttgtgcccaggaaaatctagggagggaagaattctgccattaattgctgcaaatgtaaaattgacttagagaaaaaaacgtgttctcaatttaaaaagtaatgcctgctcttgcagaaattttaagatatagaaaaggttggggggagttgcatttccaacaaggataacttacaattagcatttttgatctttccatctaattaggtacattgaagcctttccccatagttgcattaatactctatgtacaatgttatcttttctcctgaacataatagcataggtttgtatatgtcttaaaattttattagccctcttagaagccttaattttttgccaagtggacattctataacttaaccatattattgggtaggtcatttgtaatgctgctacgtacacatctttgtacaaaaaccattttctatagtttatattgtctttaaattagattttatagaaatgcaatgggggggccaaagggaatgaacacttggaggctctagaattgccgctccaaagaggtgtgtccatttactggccaatcaaagtcagttcttaaacccattttacttttcctaatgggaatatgtagagctactccaggcatcggacaaggtaatgattaaggttttagaagtctttgaggtgtcagatagtgatgctctgaccccttgtccacggtgtgtggtgactggttcttcgttctgcatccatcccccaagttatatgcaagtttcttgaaagcagttctgttctggtctcagttctctatccagcctcagtaactatccaagagcttacatttgcatcattgtggatatgttttctaaaagatatgcacggtgatacaaaagtgcatataaccttcacgtacactagcccatgtaggttaacgggagggagaaagttattaccggtacaacttggcctggtcctgggaagcctctgggaatcttgacattttgggatgtttctgatgatggctttgttgttcttttgcacagatccagtcctgcaggtcccaacacatgtggaagagtaagttttctgattcgctcagtacttccctttaattcagtcttcttcattcaatcagtgtttatgaggccagttgctgggagtgcatatatgtgtaagtttgaggaataacagtgagtgacgtataaagtcttacaggtgctatgatgaaagcttgtgttgaggaggaggtggtcagtttcctgagggagaagggtagtggttttaaaaaggcttatttgagatgaaactcaagttgagctttgaacttaaacttccaaagtcctcagggggactggacctcttcctctttgctgtgtcatatcatggagaaaaaaggtgaatgtgacctgctactacagagtgtgtgttggggtaaaagctggatagcaccggtaagagccttaaatgatggcacaacctaaggaacgattcagccaagggtttctgagggactgtagttatagtttagtctttagcagattaacttgacaaaagaccacttcacatctgcttcaagggaagctactgacggagggaccttgatctgtccccttggcgggttctctctgatgtcaagctgttagagtctgcttttattgcctccagttaaacaaaaaatatctcttgaaaactaaaagcagatttgttctacctgtttatgtaccatgccatcctatcaaatattaatggctggagttctatatacaattgatgtagaaattgaaaagtggacttactgggtccttttcacatattttgccttcatccagagtgctttgaccaaatgataatttgtcttctatggttttgtatgatttttcctttcaggccgcttttctccactcgaggatagtgtataccaccataggggtattttatttatctgtggttgaagtgagagagagtagtgggtggaattgtcttatatactcacttatacacctacacacaaccaccctccactctctattcctccatcatgggtttgcgtggctttggtatgttgttccatgccctgggctgtaatttatctttgatatttattatttaatctctaggcctgcctttctcccagatcctaatgatggcagcctgtatacgcttggaagcaagaataatgaaggcctgacggtgagtatatttagctgctttttgtactccaggggttctagaccagcggtccttaagtgtgtctgcacagtgtcttactgtgtctcccgcctggagcttttaaaaacaacccctggggattctgattcaggtggtctagagaggagcctgggcatcagtcttttcagagagcttcctaaatgagcttttaaatgtggtgccagagttcagaaacacggatgcagaccagcaggttctcatggcccagcccatacactggaggatataatgttaagaacagggtttgctctaactggtgaccctcaccttaggagggagggatatagtttgaaatgctgtctccacctgccccaccttccgatgactccttaagggagtcatgtgatattctaccctcatttccatttgagaatctaaaccagtggttttcagccttaattatacattgtaataacctggaattcgaaaaaacagcattaggacctagaacatagggcccaatcccagaaggtcccgatttaattgatctaagtcatcaggactttttaaaagctccccagataagagaatttagaaacaggcccacacatatggtcatctgatatgtgacaaaggtgacactgcagtgtcctgtcttgtcttttctcttttcttttgagacagggtctcactttgtcacccaggttggaatgcagtggcacaatcttggctcactacaacctccgtctcacaggctcaagccagcctcccacctcagcctcctgagtagctgggaccacaggtgtacatctccacgcccagctaattttttgtatttttggtagaaatggggtttcatcatattgcctaggctggtctccaacttctgggctcaagcgatccacccacctcagcctcccaaagtgctgggattacagacgtgagccaccaccacccagcttacagtgtttttgcaataagtggtgtaggtcaattgggatatccatataggaataaaagtcttgactcctacccccctacaacacatataaaatcagttccagatagatcacacatctaaatgtgaaatgcaaaataataaagctttaagaaaaaaagtaatggaaccatcttcatgatcttagagtaagtagagatttattaagtaggatattaaagaacactataaatttaggaaaaaatcaatatattgattatattaaaattaagaacttttcctcattaagaggccacaaagtatttgtagtatacacatccaacaaaagttcatattcagaatatatgaagaaatcctatggtacgttaaaaaaagacagcccaatggaagaataacagaagagaatatccaaatggtcataaacataggaaaagatgttccattttattagtcatttggaaatgcaaattaaagccacagtgccatactgctactcaccagaatggccaaaacaaggaaagtagaaaaagaaaacatgttggtgatgtggagcaaccaggactctcacctactgctggcggaagtgcagggtggcacaagtgatttggaaaactgttggcagtaagtgctaaagtccttaggacccagtaatgccctcctaggttacagacccaacagaaatgcacatttgtggctgggtgcggtggctcatgcctgtaatcccagcactttgggaggccaaggtgggcggatcacgaggtcaggagatcgagaccatggtgaaaccccgtctctactaaaaatacaaaaaattagccaggtgcggtggcgggcgcctatagtcccagctacttgggaggctgaggcaggaaaatggcgtgaacccgggaggtggagcttgcagtgagctgagatcacgccactacactccagcctgggcaacagagcgagactccatctcaaaaaaaaaaaaaagaagaaatgcacttttgttcaccaatggacatgtgcccaaatgtacagcagcaccatttataataagcagagggtggccaaataacatccacagtggagtggaaaaataaactctggaagcggcatgcacggtgatgaggaccaacagtctatgacgacacacgccgcggatgactcacaagcgtgatgttgagcaaaacatgacagacaaaaaaggccacacgctgccattcacttatgtaaagccaaaaacaggaaaaacgagtctctgctgttttgaagttaggataatagttacccctggagagttatggctagaaaggggggcaagagaggaggggggcttctgtttcttcacctggatgccggttacgtgggtatgttcactttgtgaaacttgactgagctgtgtgatgatgagtgcttttctgtttgcgtattatgcatcagtaggaagtttttaaagcttccaagtaattctcatgggcaaccaaggatgagaaccactgatctaggctgtaagtggattgtggactttaacttgggtgttttaaaattattttgtgaatgcctgtgaccaaaacagaggggaggagggcaagcttgtatagagctgtgtgtatttcaccttcaacactgctctccgttggtttctctccacagctctgtagtccccatttcttaagcaatttgtttgccagaaactggggtgagtgagttgtataagttatctcattggaatctctcagcagccctgtgggtgatatccccgttttagaggtgtggaaacagcctggagaagtgaaggaatatgtccagggctgagtcttctagtgttggagttggttcttaaagaggatgcccagccgggcctgtaatcccagcactttgggaggccgaggcgggcggatcacaaggtcaggagatcgagaccatcctggctaacacggtgaaaccccgtctctactaaaaaatacaaaaaattagccaggcgcagtggcgggcgcctgtagtcccagctacttgggaggctgaggcaggagaatggcatcaacccgggaggcggagcttgcagtgagccgagatcacgccactgcacttcagcctgggtgagagtgagactccgtctcaaaaaaaaaaaaaagaggatgcccttcatcactcccttgtgctcctttctgggttgtggtttagcagctccagaaacaatgtttcccaagcttgggccttgaatcagggcaccagtggcagtgctcagcagagaccacaggactccagaagactagaagatctgcagtgcctttctgattctcagaaacacatggcaaaacccagtcattgcagcctctctgaagcatttttcctcctctgaggcttggtttgaatgttgggatgatgggaaaatccaagttatttagtatgcaaagctctgcttattaaagctagagagaaatcttttctttcttggagaaaaaggtgaccatgcagtagaggcatttctataaaagcaggtatctatagaacaatttcaaaaacacagaatgttctaaaaataaagtatactgaaacaagcattaaccaaaagagctcgtcagatgtcagctgtagactcagaagaatcagttttatgatgaaatgcagttgaaacatttggattcctttgagtttcttttcctggcacctatcttaacttcctctttaaaaccaaaagtctcaatttttcttgtttttcaatagtgaattatttactgaagaaaacatcaaaactcttttccacctcaaactcttgtgttgcccctgtaatggcgacttctcctttccctcgaagcttgagcttggcaccaaggttgcatcccttcagcatcaatgtcctggctccctcccatggggctctacaaagcactgtcattttactcagtctagccagctctggctctgtattccaagccaggacaattctttcttagcatttcaaagaatatataactctccatatttgtgtaaatcttttcagaaaaggtttgtgtcacccctgggaagcaccctggacaggagaccttgaggggcctctgcacatggtgtcaagtaaaggagtggatgtttacagagctcagggacctgggagcttgtcaaaatagatgtggaaaattagctgggtgtagtggcaacatgcctgtaatcccagctacttgggaggctgaggtgagagaatcacttgaacccaggaggcagaggttgcagtgagccaagatggtgccactgcactccagcctgggcgacagaatgagaccctgtctcaaaaaaatgaaaataaaaacacagtagatgtggaagcatagggtgcccccttctcctttgtattcagttaggaaaactctcatctgcaaagtgcttctctctttttagcagaattaggtaatagaaacaaactgcctggtaaaattgtaataattgcacaagacttggttaacttttttttttctttttttttttttttttaaagaaacttccttttaccatcccagaattggtgcaggcatccccatgccgaagttcagatggaatcctctacatgggtaagagttcctgtctccagaaacttgtgtctctttgatgtaagtcccggaatctgggaaagtggcatgcggagagagagggcgcagtcaccgccttgccaaccctttctttcctgggttgtgcttcaggtgctgttctccccaggatcagctgaccaattaagaaagggctcccccaacttgggagaagaattgacatcattaatatggttactcatttaacaagcttttagttgctgtgttgacttagtcctgagattccaagattgcaacatacccagtggcaaatggatgaaatttaaagtgagtacaatcatctaagccaaggaaggaaagccaggctctgcctgttaattatagcgctttcttagtatttcctgctatcagaatgtttgatagaacagcacttaatagcttgcctagataaactgccttcatacctatggggtcacagctttcaaagcatcagatcacctgcttttcttttactatgttgctgccaaaatgtcaataaaaaagcatttgcaacacaaaggagagctgtatttatcttgaaatcatagtagcaataatagcccgtatttatacagcagctttctttttgaggaactgaaagtgcttattgcctattcatgcctcgaggagctttatgtgtatttctgggtctcaagtgcaggccagacttttaaggttttgctcaggacactgagactcttgcttccttccacaccttcagaatgaggaactcccagcctaggaatttggaggaaacgatcggcacagatttttctctctgtgggccgtgacctgggaacatctgataatcttctgaccatccatgtcactgtgtcctatctggtcttccagcttttgccagcaattcatcacttatagtctgcttaggatattgtcttcttatcatctttgtgctgtggcctcttaggcgagttcattaaacatatttaagagcatggtagttgcccaatctacccattaaagtaataactgagttatgtaaactctagtggttcttgaagtaaccagctatgtcatgctagatggaaaaggttcgtggtcctagctctgttctcctctaccttcagatcatattcatattatgattttgtcagtgagaacagagttgcgatccatgggtaagttgcacacatgtggagcaggcatgtatgcaacatctgttagaactttagaggtatagcattagcaaattacaggccaggtgcagtggctcacaactgtaatcccagtaccttgggagggtgaggcaggaggtttgcttgaggccaggagtttgaaactagcctggtcaacatagtgagaccccgtctctacagaagaaacatttttaaaaaatcagccaggtgtaggccaggtgcagtggctcacgcctgtaatcccaacactttgggaggctgaggcgggcagatcacgaggtcaggagatcgagaccatcctggctaacacagtgaaaccccatctctactaaaaatacaaaaaataagccaagcgtggtagcacatgcttgtagtcccagctactcaggaggctgaggcagcagtatcgcttgaaccctggaggcggaggttgcagtgagctgagattgcaccactgcactccagcctgggcgacagagcgagactccgtctcaaaaaaaataaaaaataaataaaaattagccaggtggccgggcatggtggctcacacctgtaatcccagcactttgggaggccgagttgggtggatcacgaagtcaggagatggagaccatcctgactaacacggtgaaaccctgtctctactaaaaaaaaaaaaaaaaaaaaaaaattgctgggtgtggtggcacgcacctgtagtcccagctactcaggaggctgaggcaggagaatcgcttgaacctgggaggtggaggttgcagtgagccgagatcactccactgcactccagcctgggcggcagagcgagactccatcccaaaaaaaataaaaaaagagccaggcatagtggcacatgcctgtagtctcaactatggggaggctgaggcaaaaggatgacttgagtccaggagtttgaggctgcagtgagccgtgaccacacctctgtactcctccttgggcgacagagcaagactctgtctcaaaaaaaaaaaaaaaaaatttcaaaggctctgtgaccttctccagcatctcaatattcttcttctaagagtctccaaaacaggagacttttccaataagttaggaagataaaaatgaccaccagagatcatgctttacaaaatggaaatacacgcatcacagtgactgtgttgaccttcacattggaggcccttgctacagactctccattcctaggatgctgttgggtatataccattgatacatatgctttgggttttcttaatatatagtgttatttactgtgctgtctgcctgtcataatcagctgaccaagattagggggtatggcccgaggccagggaattacttactggctgggaacagaggccgagacaactttgacatccttagcatcaggttgcaaccaactccactgaccagtcccaggtactagttaattatagtcataaacagtaactgtggatccttctcacatggtggctggttattagggaggttgagaaatgtgaatgatggttattagggagatgaacccctgggcacatttctgtatttctatagatcccagtccacgggaaaaggattgcccttcacaggcaagacttttcatatttaaagccactcatcaaagcaataaaatctaacttgaaagtttggggaactttttgaaactataattatgttattgggtttggaggaatttgtataccatgtttaggttattaaattattataagacctatggacctaagaagttttattatctctgcattaccatttatatcatcaccttagaaatgacatcctaagaaattcaggtctatctctctcaatacagagcatcttggctgctagtttggcagcgatacttttttccatatggtgtaaacgacgatgtgtttttgtgtcctttcaggtaaaaagcaggacatctggtatgttattgacctcctgaccggagagaagcagcagactttgtcatcggcctttgcagatagtctctgcccatcaacctctcttctgtatcttgggcgaacaggtaagaaatgaacctttgtcttctacaacctgcctgtttccagaagatcggaagaagctccccagcctccttccctagaaggtggccagagctgcttttttccaaacacaggtcccatcatgtcattttcctttataagacccttcagtgtccccccagtgtgcaagggatacagtccaaactgcaccacggcccagaaaaacccctgtgacgccgctgccacctttctcgcctcatttctctcatttcaaagttgcctggccgggcgtggtggctcacgcctgtaattccagtactttgggaggccgaggcaggtggatcacctgaggtcaggagttcgagaccagcctgaccaacatggcgaaaccccatctgtactaaaaaaatacaaaattagtcaggtgtggtggcatgtgcctgtaatcccagctactcaggaggctgaggcaggagaattgcctgaactggggaggtggaggttgcagtgagccaagatcaagccactgcactccagcctgggcaacaagagtaaaactccatcccccctgcccaaaaaaaaaaaagtttcccaattaggatgaactacctgcagctcccagaatagcagtgttgtttttaaagacttgtagtggtgtggtcctctccaccaggtatgcctgtttttgcctatctggcaaatatcctctctcacaactgtactcaaaagtcaccttctctgtgaagcctcttctgcagcctcacagcctgcaccctgctcaggaacacccggctctcccattctaggggcacacgtagcagttaacaggcctgtagtggcagccatctcacccctcgtcattgtcccttgacaggcatggcttgcaccctcttcaccgcaccattttgtgtttcctcccttttcagcctctttcttcttaacacttggcactgcatatttataaattcaatgtgcctacttcctgcctccctcactagaatatcagttccctgagggtacgactttgttttgctcagctgctgtctctctacatcaggcatattgcctgatgtgtagcaggggctcaatgtttgaatgtatgaatgggtgggtcccattattgcagagacctgccttacttattaccatatgtgcagcacctcacacatgtcggggatgccatgaaaattgttgaacgatacttaaagctaaaaggagaaacaaaaaacatttagaaggaagaaattataccaaaaacctaggatgaattcattacaattgagcactacatttaggtctaaactttcaggcagccaaggatttgaaaaaagagaaccgtcctgaaagtgttggggaaagcactgcatttctaaaactcagtgagactaatcttgggccctgcagaagctggccgggctctcctggaaatgggtggaaggtcttagactgtagaaatcatgtattccagcttctaactgtagtgactgcttaggatttatgtgtttaccttttccattaagtaaattcttacagtggccccagcttcatccagatataaaaattgcgtcattctcaggtgaaattgtggtgttcgaaggagctgggatatgcatgaggtggaatgtgtgtgcataggtgtgtaaatccattgcctccattatctattgctgcatgacaaaccaccccaacttagcattttattgttaatgattctgtagggaattcaggaaggactcaacaagaacccatcatctttattccacatgcttggttggcctcactcatgtatctgagacttcagttcagttccgtgtgacctttctccatacagatagcctggactcttgatatggcagcgggctccctcttgagtaaaaatgggtgttacagtgcctcctaaggtctgggctcaaaagttccagaaccttccttccactgcagtctgttggtcaaagcaagtctcaaggccagctgagaatcaagggtagagatatagactcggcttcttgatgggaagagtaacatgcattacaggaatgggaagaattggtggtagtgacctttagagatgttctactgcagtcctccctcaggctgcagtagtttacaaccctcccactccctccaaagacccccaaagtccaatcccagcatcagtcccaaaatctcacgtctcattatctgcatgaggtctggaggtagatgatgctcctcaagtgtggcacctcttgatcggagacctgtgaattaaagagacagggtctttctccccttcccatcccccacccaacatgcagtggtgagacagagacaggatagctgcagtaaacatgttcactcaaaaaagggcaggaaagagagacacatatcacacattgggccttagtaattctgaaatccagccaggcacatgttttcaggttcccctcctccaggggtagggaatattccttcattagggcccagttttgccctctgggattggttccctaatatagtgctctcagtggctcttggttctgccctctgagaagtcctttcttttccataacaaatggccagttttgtatctttctcagtccgttccttgtccattgaaatttggggatctagaagcccttttttttcaatttgactgtctctgttccttttagtctatgctgataccactcctttaaaaactatgtgggcttcccatgtgtcaaattataatttattccattagataaaagccatacccacaagtttctagactttggaatgtgagtgcaatgggacaacacatggtttttagaactcccttgatgggggcagagggtctatgagggaccaccttaaaatctttcagaggtctcaaagaaggatcttacagcttcaactttgatttggttgatctttaccctgagcccattttttgttgctggcagtaccctggatttgatcttttccctaaagttattttttatattgagaatcttttccagcgatattcagtcctggaccctttatagttcctctgtattctgctgaatgatttcttcctcagctcatttgtctcacaatatatcatagacagctaagagaaaccattcaacattttctgccttctgtctggaaatctccttagttggatccctgagttgattaggtactttttctgtcttccaagttactgcaagcaatagtcatgctcatcatggcaccctccacaagctgggtcaccccttttccattttcaatagcagtgccccctctgcactagcaagtctccaccaacctttttatcagcctcccagcctccacctgccagctggtcctaaagtcaatgccacatgttttaggtgtttgttatggcgccatcctgcttcaaggtgccaatttttaattgtcagcaatccattgctatgtaataaggcaccccgaagcttaatggctaacaacaacattctattgcttacacttctgtgagccatgagtccaagggcatagcgagggtgggtcgtctctgcttccacatgctgtcagccagtttcactcatgtgtctgggccttcagttctcctcacattgcctttctctatcgacatggatagtctggactttttggcctacagtttagggaggatttgtttgttacaattagataaggaccacacctcagtaggtactatggcccctccgtggtaatgggccggctggtctgtgttctttagaatacaccatcaccatgtacgacaccaaaacccgagagctccggtggaatgccacctactttgactatgcggcctcactgcctgaggacgacgtggactacagtaagtgctctctgctggatttcacaagcttgggccagtacttttgacctatgtggaaacagtggctccagaaagtaggattttcttttaagatactctttgtcaccaggttctttctttccatggacttttcatgggcttatcataaatacttcccacagtcaatgtgcaggggccttggtgaagtctgaagggaaaccgaagtaaaatggtgacaagcttagccagagaggaaggaggacatccctcgttgagtctttctatgtcacagaaggaatttactgcaagcccatggaaagtagaagtaaaatcagcataggacattaacaaccctgtcaagaaggccactctgcaaatgtgactcatccctagttatttctgcagttaacattcacccaactcaaatgaaaactaaaaaccaatttgccaccttaacattggtatcaaagttggactctgctttttcttgtcaaggacctagaatattttcgtttttctctgaggactcctttgtgaatctgatgggacagtgtcagtggttcaggtctgactttcagggtgtttttttgttgttttttttttttgaggcaagttctccctctgttccccaggatgtgtgcaggagtgcagtcagggctcactgcagcctgaaactcctaggctcaagcgatcttcccacctcagcctactgagtagctgggaccacaggcacgtaccgccactcccccacctacctggctaattttttttttttttttttttgtagagacgggggtctcactatgttgcccaggctggtcttgaagtcctggactcaagtgatcttcctacctcagcctcccaaattcttgggcttatagacatgagccaccacagctgtccctgactttcagtttgatcgatgggtttcaagtgactgctatgaaatgccagattaataggcatctccactggctccttcctcctcagtatttactctcacttattgaatagagtggtaaagaacatcaccaaataaattgcctttgggagagtgatcctggcttgtgtttatacgccagccagctctcagtgtcttgatattacagagactaagcgagttcattggaaacaagtgaaattgctcagaggagatctgagaatattccagaagtcttgtttcctctaactgagtgactagagcctgccacaagagtagaggatgtggttgcaagatggggtgagactcagcatgctttgtttatttgatctgtacagagatgtcccactttgtgtccaatggtgatgggctggtggtgactgtggacagtgaatctggggacgtcctgtggatccaaaactacgcctcccctgtggtggccttttatgtctggcagcgggagggtctgaggaaggtgatgcacatcaatgtcgctgtggagaccctgcgctatctgaccttcatgtctggggaggtggggcgcatcacaaagtggaagtacccgttccccaaggagacagaggccaagagcaagctgacgtgagttgggagctcggggaaggagagggcggccgtggccttcgtgttctggtgctgttgcagtgtagcaggccctgcacgggaggccaaagacagggcagtctctgaagccatgaggaatattcagagccaagactgcttcatttggaaacctcagaatacaagagctgaggggcacccattaacacttcagagttcttaaatattacataaaaatcatggatgggaggtgtcgggcaccatggcatacacctgtaattccagctacttgagaggctgaggtgggaggattgtttgagcacaggagtttgaggccaacctgggcaacatggcaagaccctccccctgccaccacacacacacaaataaaggtataggaaagagactgccagtgtaagtatagtttggatctatcttaggtggtagggatgcaagagatttatttttttaactttctatattttctaagtttttaggttatattcattttaaaaatcagaaaaaatagttacagtgtgtgtgtgtgtccaagactcagcaggcttctgttctccatccccctcttcatagcctatcaccgagtcacttaaactccccaagcctcagtttcctactttatatatagagttgtgtggaagatcaaacaagataatatgccggcaagtgtttagattgtaaaacagcattcaaatgtaaggtattcgttgagagaggtttagataatgtagtggatgaccgatcccaggtgggctcttgacagtaagcagaagggccaggaggtgtagctctcaccattttctgtctccctgatgtcccacatggggacagactacacagctggggaaccagaagtctcaccaagtctggaatttcttatgcatcccttttgctctcagcatccagagtagagcagctgaccatttctcaggagttctgtaaaacctccaggatccttagaaagcacaaggcagaatgggggtagttctggtggtcgctggagtgatcgctggagtgaaagtgtgttgtagagagtcatctgaggggcctcggcggtggtagtaagcactcagtctcctctatggccactgggcgtagtcctttctgcaggcatcatgggcatcgtctagtccagccctgcgattttgctgaggcttgccattaggtggcttgtccatgtttctgcagtgagtgacagctgggatgaagtcctgtggtcctgttcccagggcagtgcccctagcttcacacccctactgcgttcctccatgtctggggggttaatgtggtcatccctgcgggtggtatttggggtgatgattactcccttctgtgggatctggaaattcaatgactctggaatgcatgtatctgtttttctcctaggcccactctgtatgttgggaaatactctaccagcctctatgcctctccctcaatggtacacgagggggttgctgtcgtggtaagtccactacggagggctcgcagctgcctaaccacttctgttccattttagcaaagaatgactttgctatgcatgagcatcctgcaggttaagaatgaaaaacacaaatcttaagttctcaaaaacagtttctgcacatgccacattctactttgaaagaaagatacatgacaaaaacagcttcttaaagccgaggaatccctgattattcccttttgcttttgtggtcaaatctaaactccccaggctggtgttcatggccctgcttcatccagtcccacgatgcccttcctccaccctgttagtttctctatgtgagttgcgtggcccaaccatgtgcaccttctccctgacttctacaagccccatgttcatctttccccggggcctttgttcaggctgctcctcacctcacacttcaaatgccctttcttcttccttttccctactcaaaccctttgcatgcttttgcaatctcgccgagcctccttgggcctcacaagcctgcctcaagcattctgtctctgaaagtccaaggcgtcataatcctagctgtttgtcctgatccctacaatgcttgggctgtgtggttggctctcttgtcttcccagtgatttgggcggctgcttctgtgaatagacagcgcctgcctctgtcatagttccagcagcacctgagccagcactgggcgtgtggctggactttattccgccccattggttgcgtagattgtgactaacagagatatccattcattctccttcacttatgtctgcttctcataatagcttcttggagttctacacacacacttcttgttccccagtacccagacataagaatctaaaaagacgtccataaagacatcagtgcagcttgtcacatcctgagggagaagcttctttgcccagactttgggcctttgtgtcttgctctgtcctggactagccctgcactagaaattgctcacctttcaggacagtggctgggatggtgtgccgtgggacccgctctccctccagggctcctgaccctcactgcaccctctccacagccccgcggcagcacacttcctttgctggaagggccccagactgatggcgtcaccattggggacaagggggagtgtgtgatcacgcccagcacggacgtcaagtttgatcccggactcaaaagcaagaacaagctcaactacttgaggaattactggcttctgataggtaagagcaggtctcccacagtagcctgaggtgacagcgtgctgcctcctggtgggcgaccgccggccctggtagttacaccgtactgagctcggaaggccttgtgctcagagcccttcccggctggcccctgagaccttgggacatttttacccccaaggaaaatcaacaaggtagctgtgtttctgagtcagtttttgaaaactgtttaatgttccaaaactcaggtactaaattaatgtaaaccttgtgtgagtatccgacattaagccctttagaatgcatttcctcactcctcacagcaaccctgtgtgaggtaggtacccttgtcatttccattttatagttaagaaaactgagactgtttctatggaagaattaacttggagtccacgtgggcatgagggtgaggggttggagaggcgagggctgaggacccgggagggattaaatcccaggatggattgagagcagcagagtcaggggctggttgtggttctagggcagtgtcatcccaggtgtgtgggaaggtcccttttttcctctttctcttgtttttgctgccatcactaatggccagggattgaactagaggccctgtcccaagagagataagttgagatgacacttcttgagttggcagtgagtgtgacaaacgaaggcggaagtgagaagagctgtgttcctggcaagtgtgccaagtcattagagcaggagggagttttcttgaaccccatctgcccttcctgtgccccatccctcactgttctgccacctcccagccccagtaggggcagagcagggcaggaggtcagtcgggtgctggagcacccaggggccggtgcagtttcttctctctgttctcttcctgtcgtgcttgctggtgacaggtactaggggagaaagaggtcagggctggggctctggaaaagagatgtggggcagctgggagcatgtggggaccaggaaacagcaggatctgccaggcagtgcggtgtaggtggggatgtgtgtaaccaggtattatggggggaaaccaggtatccttgagccctgctcgcttcctttatagattgtcaaggtccatttcttttttcatcctgtttccttgtagccatttttattttatttttaccaaataacgggtaaaggagatgacaaaataataatacgtttttattaacagaagtagttgaaggagcatgtatgaataggcccatggtgagaaaaaaatagctaatgagaagaggtcattgcaattacaaggctgctcagcattatgtgccagttaaggggctcacagactgcccaccagtgattaagaagtggaattaaggaaatgtgtatatatgagaatacagaaaatatgggggcagggagtcttcatggttaacttgtaaaatgagatccctttaaaatggaaaggttgtccaagtaaggaaactgcgaaaacagcaaagtataaggaatctattaagtgtaaggatcccacaattcgaaagcctcttctgaggacctccaaagctcgtcatcttaaaatatggcactgagactatggcagtgtctcctgttgacgagggccacaagtaaaaggatatgccctactatgtccagatatgtcctttcattttctctttgtggaaagcattaaagatattccaggttgtcattaatcgtgaaaatacaaggatccaattagcttgagaggcatggtctgtgggttgccccaaagccatggccctgaccttgggtgctttcggcatcagagcttagttaactaggcatatataagcccgggagagcctgattcagtaggtctggggcagggcctagccatctgctttttgctctggaatctggacctaagagataatgatagatgaatacatcaaggagaccaggtaatatttgtacaaaatatttagtggtctcatgagtaaggttgtacagtggttggtccagtgtgtacagcgtgatatcagtgaaggcccagctccaggagaagcctgtttacaagaaggttgacagaagaactagggggattcaggctaatgccttccatagcagtctcttggcaggtgtcctaccagacaggtaggaccctgagcactgagtgggtgttgtgggaagggcaggacactgctgcacagcgtggcatgtggaagaacacctcacttttcttagaccgtaggtctcttgttagtgagcctcagagttacccgcacatactcacattcggattcctgggccctaccagcaagtctgattcagtggtctgaagtgggcagaccacaagtggagaaatcctgctcccaagcaaagcatgtctcagagctccttggtacacaagagaaactagtggtggctcaaaacaaaagtaggtttcccttaaagaatgatattatgttgtagatagagaactgacctaaagatgggaactcaaagaggaattttccagatcaagaaatgtacacagcttagactagttcctgtttgttgtcatcttggcatgtatgtcatgaaatctttgataggtttaggggaacaatggaaagatcataaggtgaaagagacgtgagtcagagtgagatctgctcatagccagagaacagaaaggaaagtcagccaggctactggcagcctaatctgaaacagtgacctggctctttggggtagtatgtggactcatttttagagctgaatggattatcaagccctatcaaatcccagttccctattctagtcagctttgtatctcttacagcaatttgcacacaatagatgctcaataaatgtgtaatgaatgctcagtagccatgcgatagttgtgtagtgaacagcaaatgaacgtggagcgagctatggccccatccatctagcaggtgtgtcctactgctttctcgcaagtaatgtaccactttccccgatggaagctcacatttagataatagtaggactggaactccacctgagcaatttaaataccaagatgggaattcggcggccatagaagagtgatgttacaggaaaaagcattgaaaggagaactccttgaacttttaatgaagcctcatcatacttcacctgtggatcgggcccatgcagccccacgagccttgcgtctggtgcctcccaaatgtcctgatccctgtcatgcaaggatacttcttcactcctcagtaggagacttggaatactgtattctgccatgaagtaataagggtcctgctttgatggaattttctggtaactgccactcattttctctaactcacagtcctgctgagagtttgcattgtggacccctcagtgggtagcacctgttgcctaagtttagcattgagtgccaccacagctcgggaaattgttctcactaaaggttttgtttcctgtcataggacaccatgaaaccccactgtctgcgtctaccaagatgctggagagatttcccaacaatctacccaaacatcgggaaaatgtgattcctgctgattcagagaaaaagagctttgaggaagtgagtgaggaagcgaccagtcgggggttgttggtgttaggtgttgggagggtgaggcattagactttgactctgccttctgagcttgcagcctagtctgggagggaagaggaatgcaccagaatccaaagcaaaaaacataaatggttaagggctagtggagaggaataggaagcaacttgtgaaagaaggtgcaggaaaggcagcaggaccaagctaggcctggacctggatgaatgggtaggatttggccaggtggagggagcaagagggcacaggagggaatggaacagcaagggcaaaagcctggagtgggaagaatgctggtgtgcccagctcacaggctgtggggagaaaggcctggccagacccgaggctactaagtagggggtagtaggaaatgggctcacatgggtaaaaaggaaccatgttacagggcctgaaacaagccctgtggaggagtttaagagttgttgaaggctgggttgggtgtctcacacctgtaatcccagtgctttgggagaccaaggcaggaggatcgcttgagcccaggagtttgagaccagcctgggcaacatagcaagaccctattgctaaaaaaaaaaaaaaaaaaaaaattgttgaagaagtgatgagatctgaagttttatgaagcagacagagagtggcctgggactatttgcacagagttccaggggctctcttagcacaccttggcctaaagccagaggagagggagtagaaaggactctagaccgggagctgaaagcatcagttgaggaattcagcagccccacagaagtcaacctctttctcttacctctctctctcatctgctggtgtcccctgttagctttacccagtcaaaaaccccagggggttggggaagccattgctttggcccatacaggtcagccttctggggcacagagccggtggaggaggtggaagggtggctctgcaggagggaacccaacatggccagggaaggggaagaggggacgtctgaggcttagtgaccgattcaggcctggcagcttcagcagccctgccatggagggcccagggacagagatgcacctgggctacatgagtagggtcagaagaagaagagaatggctgactgatgccgagaccaaaagcacaacaaactcagttgagagatttagattttatccagagacaaaggaaattgtagactttcaagattccagggcacagtatctgtttaccatcatctacggaagtagccaggttggagaaatacattgattcctaaaacagcaatcttaaacagcattgtcctataatcttattaaagtcctgcatattcattattgaacacttagaaaataaacacatacagaagaaaataagacagtgcccttaatttaacacccagaggtagccacgtgtcaaatctttgtatttaaccatctggtcttggataacggtctttgaaaaagtatgttttaaaatactctcaggtgcatctgtatggtgatgagacatacagatgtccctggccacatgcccagatgcttcctatatactctgcaggctacaaacccccaaaaatgtgggaggcactgtgggagaggcatgaataagaggggtacacctggaggggagagaagaacattctaggcagccatctggggggaggggtgaaatggcgtgagcgtgtgggaggtttagcatgtgggaaattcagcatgtgccagggaggctgtgttagttttgttgggcaaatgataacggcatacctagaatactagatatttgaaagtgagtcaatgcatttttctaaatgcctgttccgtgaagtcttagagattctgaggaactctagggaagctccatttttatctgatttaattttgggcttctaaattttctttaacaaacgcttctgatgcttcttaaaaactttgaagaaatagtggactactggaataaattataattttgggattgcactgacagtttacaggcaacacgagaaaactgctttattgctttctagccatgtgcctctgtatacgtgcggatttccttttaatgtgaaatggtattattaaatcaaataccaatttttcaccagactttgttacagatgacttcagtgttttcctggatactgaacctaccatcaaaggaggaagtgtttgcctttttgaggatttttgaaaaaaatatgtagggtctgaagacacctgccaaaagtattgctccaaaaactatttttgaataatgataacctcactgcaaagatgcatggcctctcaaagcaattgctttgaaagaggcaacagttatctggctacatgatctttggtgagcttaaaacaaataaaaccccctgcagtacagtcatatccttgtaaacagtgattgcttctcttgattgctggcctcatctgtatctggctagaaattttgcagtgatgtcgcaactctctcccatgcaaggttatcaacctggttgaccagacttcagaaaacgcacctaccaccgtgtctcgggatgtggaggagaagcccgcccatgcccctgcccggcccgaggcccccgtggactccatgcttaaggacatggctaccatcatcctgagcaccttcctgctgattggctgggtggccttcatcatcacctatcccctggtaaagctcaacaattcccctttgccatccacctatttctggggcttctctgcctgtcgcctcatgtcagtgagatccagacaaaaacaaccagcacatttctttccccatttaaaagtcagtgtttgttggccgggcgggcacagtggctcacgcctgtaatcccagcactttgggaggccgaggcgggtggatcacaaggtcaggagatcaagaccatcctggctaacacagtgaaaccctgtctctactaaaaatacaaaaaattagccgggcatggtggcaggggcctgtagtcccagccactctggaggctgaggcaggagaatggcgtgaacccgtgaggcggagcttatagtgagctgagatcacaccactgcactccagcctgggcgacagagcaagactccatctcaaaaagaaaaaaaaaagtcagtgtttgtttatcttcaaaaacataattaaagagacactagcctcccagaaaaggacaattttgttcctaaatcttagtgtttttcagctaagagctgatttataagccttgctcaaagatgattttgaatagttatctgtatttttaaagaataaggataatagatgaagacctttcctcccttaaaaactgccattagaacttctgctggggagaagaaccaaaaaaagaaaaaagaagctgcctgtgagatcagcttgtgtgaaaaaggcagtgtggccatccctttacttcctagttggaaatgagcaagttctgtagcagaacaggccatgggtgggatgaaatatgtgaggggcatggtccttcagcaggttgctcagagcatcgagatgctgttacctgagagctcaggaagctaatgacccgcccaggaatgggaatgacagactctttatggcactccccactggcacgtctgcacctgatagtttcacttttcacctcactcagtcctatgaggtcattattattgatcccttgtccacaaaagaaggaagtagaccctgagaagctaagtaactttccccacgggtacccagctagtagacggcatttctaggactccaccccatggtggagagaagaagagatgactccctggtgggttggtggctcacagaagtcccttcagtccacctcctgcacatgggtagggatgatcacagatcgctgctacttcagataatgacagaatgaatccttcagagtatttgagaggcatgtggcctcggggaaggcagtgggatgaaaggcggaagcaggacctcagccaggctcaccatgtgtcagccccactgccacctcctggctatgtgtatgcagatgtactctgcatacctagaatactagagcttcctcacctgcccctctggattactgagtgtctgtgcgctagcctctagccaacacacagacacggtgggtggcgaacctggggcttgctctcacccaccactggctcagccatgctacctgtgcttcctgtttggtttcacctttgcaacaactctcagactttcatgaaaatcacagaattttagaactgaatgaaactggcacagccctcaacctagggcacagtccctcccctggtggccatccagcccctcctagggttggggagtgggctgtatgagcaaggatctaactagtcggtggaaagacgtccagtcatcgaagcaattctgcttccaggtgccttctcactggtctctttgtgccctgttgggtcacataaagtacacatgctccctccgccactgggacctgtcccttcccagctgcttgtttccctgtgggaacagctgcccttgtctggatgtgggtttctcttcccagagcatgcatcagcagcagcagctccagcaccagcagttccagaaggaactggagaagatccagctcctgcagcagcagcagcagcagctgcccttccacccacctggagacacggctcaggacggcgagctcctggacacgtctggcccgtactcagagagctcgggcaccagcagccccagcacgtcccccagggcctccaaccactcgctctgctccggcagctctgcctccaaggctggcagcagcccctccctggaacaagacgatggaggtaaagccagttgccatcttggtgctattttatgttttattcgagcacctcctgagaagtccaaggagtctccataagattgtaaactaccattctcaggggttcactgtgttctcctctaacttccactctgggggtctctgtgggaaggcttctgccccatcccttggcatctccccttcagagggccttctgggaaccaccctggccatcctcctgtctttctccacaagggctgggcgtcgcggctgaccagaggtgagctgcccattgggctgaagagagttcccagggccagccggtggccaagtgtggaagtgtcacagttggtctgctttcctctgtggaagttggcttaagccagttgtcagagccccaattctgagggaactggcacagagctggtgcagggaactcagagccctctgtcccaaggagtctcctcgttttacatgtccattgccgccacctgaatgcttcagtgcggatctttacagtggactttgtggtggttgttaactattaaaccattctaactatatcacaatgaatatgtataagtgtgtgaaacgctatggagaatccctgccttccagaaggttttaagatatgcaatcgcacaataaggtaaaggcggagacagaatgcaggggcagggggaagaggcagtcctgggtgtacatggggagtgggcctggcaggctcttgctgagcagcagtctgggatgcagtgcctcttaaatcccatcttttaatctgaggtcaggaagcttgtcactatgttaacctcaaggttctttaggtgatatctgtttgaaacaatctctttttcctattttgtcccagatgaggaaaccagcgtggtgatagttgggaaaatttccttctgtcccaaggatgtcctgggccatggagctgagggcacaattgtgtaccggtgagtggattagccagccccctgccctcaccgcctggtgtctaagtgcctgtcaggttgcgagcctggtgccaggctcagagcacagcagggtcaaagcagtgacctagacgcatggagtccggcctccagggagcttgcacactgagacaagcgatgattccggggccaccaggcagtcaggcggggctctctaggctgggaggcagtaggtgaatgctgtggacccaggttctcacctcatttacacagcctgactcgtgcttcccagacacaactcccactcctcatcccgcaggggcatgtttgacaaccgcgacgtggccgtgaagaggatcctccccgagtgttttagcttcgcagaccgtgaggtccagctgttgcgagaatcggatgagcacccgaacgtgatccgctacttctgcacggagaaggaccggcaattccagtacattgccatcgagctgtgtgcagccaccctgcaagaggtggatttattttttttattttgttaactttattaaagtcatagcactttgggaggccaaagtgagcagatcacgtgagctcaggagtttgagaccagcctggacaacatggtgaaaccccatctctacaaagaaaccaaaaattagccaggcctagcgatgtgctcctgtagccccagctacttgggaggctgaggtgggaagattgcttgagcctgggagatcaaggctgcagtaagcagtgattgtgccactgcactccagcctggacaacagagtgagaccccgtcaaattaaaataaagttacagtgaattgtactaattttaaatgtaatagcttgatgaattttgacaaatgtctatacccatttaaccacatacacagtcaaaatgtggagcatttttatccctctggttgtaacagggtggtccccccagcatgcctgggcagtctgcttgcagttggcatgtctctccctctttgcctccaggaaacctggacagttgttctttccctcttcagtcatggctggtgtgggcttggaggatgccagttggtaactccaggctttaagatcatccagcaagctccttttgctcattttccaggctcactttgaaaccatatcagtatcatttggattcctttgtaggtttacttatatgaggcagtgaacttgagtttcttgccttcttatctttctcattgtaaattagtagatttggaggtttgctccttgctggaaaacatggatttagacagaatgttgtcagtaaaacttgccatttctttcttaaaatggtatcaaagaaagtgagccgaggggccaagtcctgaggactgtgtgccgtgaccttgctgtcatgtcttttgcagtatgtggagcagaaggactttgcgcatctcggcctggagcccatcaccttgctgcagcagaccacctcgggcctggcccacctccactccctcaacatcggtgagaggctgcactttaccaggccagcggcccgggtggggagaatcagtggcccaggtggggctaaccagtagctcgggtgggccttgcttctgttcaagctcttggctatatcaccagtagcaaagatgagtggtgtaagaatttgaggaggaatccgacatagttgaaaatcagaacatttggaggtggcggcaggcatattgggagtctgacgaggacacattccccattggaggaggaggcctggggttgctcctggtaagcattggactaatctggagttctctgttagttcacagagacctaaagccacacaacatcctcatatccatgcccaatgcacacggcaagatcaaggccatgatctccgactttggcctctgcaagaagctggcagtgggcagacacagtttcagccgccgatctggggtgcctggcacagaaggctggatcgctccagagatgctgagcgaagactgtaaggagaaccctgtgagtaataggctatggccctttgaaaactacagaaccagcccattgtatcttcaggagtagaacctttaaattccaggtttgggggctggtgcccgtgtagctggagaatggcattcctttcaccaagagcttctgtgtgaacattctgtgtcatctcatgttcagctgattaaaggggcaaatgtgggcaattatctattttttttccctattcttccaatcacttgtttttttttttgtttggttggttggctgtttttttgttttttttgtgtgacagagtcttactgtcacccaggctggagtgtagtggcatgatctcagctcactgcaatctccacctcccaggttcaagcgattctcctgcttcagcctcctgagtagctaggattacaggtacctgccaccacacccagctaaatcaatcactttttaacccctttttaattttggtaaactgggaagtcagggcttgcttagcgtgagcaaacttcaagttttcattatttttaaaattttgtttttgttttctcaacttattttgataatttttagacatagagaaaattaaaagaaaaaaattttttagaagtgcaatctcgctattttgcccaggctggtcttgaactcctgggctcaggcttagcctcccaaagtgctgggattgcagacatgagccacagcatctggctgaaagaatgttaacatgaatacctgtgtatctccacctagattcaacatttgttaatacttttgccacatttgctttatctttacctattactgaaccatttgaatataagtagcaggcatcctggcccttcatccctgaagacctcagcacgtgtctcctaaggaatacattgtgtttccaaccacaataccattatcccacctcaacagttaatactgtttctatccatcatctcatattcaatccatattcaaatttccccaattagtccccaaatgtcttttatagagttggtattttgctacctactgggttttgatacctactgggttttatataccaggatggaatcaggtgtcttgcgttacatttgattctgtctcttggaatttacaaatctttccacctatattttgttccatgttgaagttccattttgaagagtccaggcagtgggttataggatgccccattctggtttgtttgcttttttcctcatgacagcgttgaacatttctctgtattccttgtatttcctggaaaccagaagttaggtggagaggcttgattaggttcaagttaaatgtttttggcacgaatgtttttggcaggtctctacatcagaaagcatgtgatggcagattgtatctgtaagattattatcacctcctcttagtgatgctacagctgatctctctaccataagggttcatttcctcctctcttgttagtatttggggtgatacttcagcacaatgtgaatatcctgtttactgacagtcactcacccagtggtttagcatgtgttgatcacccttgcctgaagtactcagttgagtagaaattcttctacattgttagctgacatttttctgtaaagcagagctttcttttcactttcttctctctctctttttttttttttcttaatcgctatgggctcaaggattttgaaactaatgttataatccattttagtcctttttttgttatttacttcttttgatacacaaattgttccaaatttggccaacctggaaaccccttcaagctggcttctgcatccatttgctgggagcgcactcacacttgagcaccttattctagcacaagtcgccgaggctcaccttggacactccccgatggagacctgggtgggtcagtcatcttgagtggattagatatggctgcctcttatccagctcactggggaccagcagctggtcagatcatcaaagaagtcagttacagcgaagaatcataaaaacacgcacgcacgccataacacttaattttaacttaaagcaagtaatattagcccttaagtcatagaaatcttgtgctgtaggctaaggtcttttcagatttgggtctgactgactggagtcctcattttcccccttgcattaagcacacttctgtaccacttctgtgacttctgcatggaggcttggacacttcaaacacttcctaagcgatttgagagcagaagcctggtttttaacgcttcatgacccagtcccttacggttgaatccaccacaccaaatgccgcagcagctcttgtaaccattccctttcctttatcgagtctttctaaagattcagcttacctcagacttcgtggcactcatgtttaacagcttatggaatatccaaattacaaggacaagtggcaataataagtttgggaaagaacataattggggccgggcaggtaggaaagatgcctcttcaccttagtgttgtctgtgctggggacagcaggctgcagagagtgtggggggcgtgaaagacccagagagctctgggagtcaggggcgagctccagctgtggtggccatgttcctcctgtcccgaatccagcaccttcctaagggaaaatccagtgaggtagaataaagcatggtaggtttggagattggaagacctgagtctcatcctggtttatcacatccagcagtgaccctgagcttgtcatgcaacctttctgtccacgttctcatctggggatgaaagcatttgctctgctcgcctcacaaggttgttgtgaggctgaatgagagtgctgtgttgttcaaggtgtgtctcctccagcatgggaggtgatgagcccctgcttcctcacactagaccctcacttcacctggtggagaatctcagaggcagggcctactaacagggacccaagctgtgctcaggaaccaccttggtattacaccccaggtagcatgagctaaaaaacacaaacgtacatttccctcgaaggaagctattctgtagacacagaatggtttcatgggataagtgagaggctttctcggattaacatcaaacatgacctccttggtaacttgtcagatagtttctttctagggctgtttttgaatcataagctgttttattcacttattagcaattttgatacctactgtgtgcaggcaccattctgggccctgagggtacagcagggaagcaacgacacagagaccctgtctgtgagcactttcgtgttgggggtaaggaatatataacagccaggagggcttttgatgggccaagcactgtcgtaagcaaccatttttgcatattaatgcatctcttttgacaacagccccatgctgtcagtgtcctcatctcacatgagagggaaccaggggcttccaggtggctccaagcccaggttctccactgggacctctgacacccatgcagtgctgcaggttagccctcgctgctctgtgcagctcacatatgtcagctgattctcccaggacaccttctaggtggcagaagcagcagcaatgctcctccctccctgactgtgagtgaggatgaaaactctgctcccagacctctcacgcctcatgtctcttttcagacctacacggtggacatcttttctgcaggctgcgtcttttactacgtaatctctgagggcagccacccttttggcaagtccctgcagcggcaggccaacatcctcctgggtgcctgcagccttgactgcttgcacccagagaagcacggtgagcggtccaggggttggggttgggagcagctcctcagctgcctcaggtggccctgcagagctgggctggtgccacctttgcactcacagaggccgtggtgccccagctgctcaccccgcaggcctcaggacctccagacttgtgccaaatctggtagagggttggtagggttatctctggggcgccaccttctaaagctgagatgctccaaggttcctccaggtcaccaactacttgttggtgacctaggcaaagccccctttggagaccttctttttctacctggtgacatgagggttgaataatcagaggtcccttcctgcactggcatttgggaagacaaattgtcttctctcttgggatggcgagtggtcagtaggtgcagtctgtgctgggctggggacagacaagctttatcctcaccctcctggtctcctggtatgggtgcaacaagtctttcttccagacttcaggttttcctgggtggtaattggcccatgacactccagtgctgccttttgaaaaaattacaactaaattattgttttgtttatgcttaatttttcttattatagaaaacacagattagcataaaggcccatatattcccattatacagggatgaatgatggctattgatacctttgcatatacgttattccagtcatttatctagacgtgattgcatattttataaaaatacagttaaatcctgcatactgttttgcagcatgcacgtttttcagcgtcaccttgaatctctctccacgtcaatccatatttagtcacagccgcactttaacagctcatggcccagcgtagggaggcaccgtagtgtatccacttgggcctctgatactggatgtttacagtcacttccttcacaaaccatgcagtgaggactcacctcattggctgaggttttgtgtctgttcctaattattttattggaataaattcctgtaaatagaatcataaatgagagggtgtgcagctttttaaagtttttggtatttcactgtggctttggactggtagtcatgagttgcttattttcctcctttatagaagacgtcattgcacgtgaattgatagagaagatgattgcgatggatcctcagaaacgcccctcagcgaagcacgtgctcaaacacccgttcttctggagcctagagaagcagctccagttcttccaggtagagacgtctgttctctttatccagagtcttcatttaatgtttttcagattttgaaaatacagaaaaggacaaagaataaaataaattgcccattaccctaaaactggaagataatcatggctgatgttttaatgttttcttcatatataaaagtataattgggatctaaccgtatatacagtttcagaatccctttttttaactgtacatgatattctaagtttctttcatgttaaagttctaaaattccaatgaccatagtattctatcatatggatgtgccataatggttaagctttatattatggaatttccaaatatataatacataaatgtttaaatgctataatgagcactcctttattcatccctcaggttcaataaatattaaccttcaccctctccccaccccaggttatttcgaagtaaatctcaggcatcatataatttcattcaagtgtcataagcttatttatttatttttattttttttgagacagcgtttcactccgttacccaggctggagtacagtggtgcaatcttggctcactgcaacctctgcctcccgggttcaagtgattctcctgcctcagcttcctgagtagctgggattacagatatgcaccaccatgcctgcctaagtttttttgtatttttagtagagatggggtttcaccatgttggccaggctggtcttgaactccggacctcaggtgatctgcccgcctcagcctcccaaagtgctgggattacaggcatgagccaccaggcccagcccaagtgtcataaatttcagtgctttcttatattgtatttgtttctatcatcttttacacagtcttggcccagatctccttttgcttaaaataggttctgcaaagttagaactcctttggtgatttgactgttttaaagctttgtgacaatgtcaggtgacttttgaagaggtaatgtgtttttcaaagtcttccatgtatgaattgaacataactcacccgaacgcctcctgcccagcacgtggctctgaaagcaggcttgtggggcagtgcttttccccttgggtccaggcagagtgcagcttggtgggcaccgtactgagaagtgaccatcatgctctcctggggtctgactggggccttggccagagggaagcccccagaatgtaagctcctcgaggacaggagtgcttgactgctgcattcactactgtgtccctgcctcctagggaggacgctgcctggcccaaccattcagatggatcgggttgggaagagtttaatgctgtcttccatgttgtagcatatggattggtcactgtgtccatggacataatgtgaaaattctcaagtccatatgtcttccagggacttgtgaaaactaaccaggtcattttgatcgcaaaatatagaacaggaataaaacccacacaaagggaccttcacccaccaagggacaggatttaaatgcttagtatctccaggtcatatgtctctcgaacacacctggcttccactcaggtcatttagccgtaacagctttgcagctcagacacgtgtgttcccagtgtacccaagttgacaatctaacctctccacagcttctctctgacaattgtaaattaggagttcagccagtctggcttcatcttcatcatagaaaaggctgctctgagaaaagggtctcctaaggctacttaacattgatgtagacagggctcaccactccctgtgtcctcagctgtcgacctgtcttactggtgggacttcaagaggccatacttgggtgcttcctgaccctctccttattaccaaagtcaaatgcagagcaaggtttgaatcccaacaggagcctctggagcccatactcttgccaccaagtttcctctttgagaaaaaggcccagcttcacaggtcttttctactggtggagggaagagtggcgaccctccaccagttatgggcttgagcataccctgtttcagtgagtagacaaagcacgggatgcacatcaaatctgagctttccttttctttttggttttggttcattggatatagattgcacttgcggctccgtacacatggcgtgtgtgtgcacatgtgaaattcagggtatgcgttcgtggtctatatgcaggtgtactctgtgacacctctctgacatgggagaagctctctgtgggcctgtgcttcatgaggaacagagcagctcacagggaaagtcatggatgagggagggagggggcagggtgcctgctgcccagctctggggcaggcttatgtgtcagtgatgatctgttactgagtcccagtcgcacagctctcagcatctccagcactgaccatcatctgctgcccttgtttctctcacaggacgtgagcgacagaatagaaaaggaatccctggatggcccgatcgtgaagcagttagagagaggcgggagagccgtggtgaagatggactggcgggagaacatcactgtccccctccagacaggtgatcatgctgcagcgtgtgagagggcaggttgcaaaagttgctgccgcctttccaaaaagtaaacgtggaaatggccgctccaggctgttcaggccccacatcccacctgtcaggtttgagactttcttgggtgtgtcctctgtggtttggttacactgatgtgtgtttcatttttgttccctagagtgacaggtgagtgatggtgtcgtgctctaggtggtcatttctgacctgggtgtgatcaccaggtggggttcagggggacaccacccttgggttggatgggaggatctgctcccatgcctaggtgtggagtgacctcacctttcagtccaactccctaatcccaggaccccatgaattgttttcttttaaaatgtattagttttaaatttgattacccattgcttccctcaatgtttttctagacctgcgtaaattcaggacctataaaggtggttctgtcagagatctcctccgagccatgagaaataaggtaagcagtttgtaaatgctggggaggagacccagtggccatgacatggacaccttcctcctttcatccattctctataaatcttttatctgtactggcattctcatctctcaggagctaggcggcttcagctggacttggcaaactgcaggctgttgcctctcttacgctgattttcccttcagggacgtaggtgcaggtgaagctccgggaagcagtgctctgcggcccatgtccctcatggtctctggtcgctgacttttgtagggccctctccctgtctgatgcagccactgtgtgtaaacatgtataaacatacctcaaatgcggggaccccgctgggacggacactccaatctcaggcgactttactcctcctgaggtggccaggagtgtctccaggtcctgactgtcacagaaggcctgagcaccccctggactggctgggccttgctcacttcaaggcctcctcctgagtgagggtagcaggcgagatgacggggctggattcttggatacataagccttttttctttttctttaccaaaaaccaacactcacattctgtctcttccttgcatgatgaaagggtgttttgccaacatttcccgagctttctaacccctttctaatctcccgagctttctaactctttgcagaagcaccactaccgggagctgcctgcagaggtgcgggagacgctggggtccctccccgacgacttcgtgtgctacttcacgtctcgcttcccccacctcctcgcacacacctaccgggccatggagctgtgcagccacgagagactcttccagccctactacttccacgagcccccagagccccagcccccagtgactccagacgccctctgagcgagggcggcccctctgttctggtggccccagctgtgactgagggcctggtcaccacaattagagcttgatgcctcccggctttgcagggagaccaggcttcccaaaccaagtgccttgagctgcctgctctgcagcccacagaggacagtgctgaccccaggaagtgggagaagtggcccctcgtgacctacagggaactgggaagatgctggccccaaaagccttacggtcatgatgtctgcaaaggagggcctcagagacagcgcgagtagcacccccagccatctactggataaacttgcttcagactttttaaattcctgcttaatgtcagtctacaggcctttcaggaagggagaggagggaatcgtacattttgcttgcgtgctgggacagctaggctgagatgcaccaagtacagccttcactggagaccggaattgagaggtgggggatgctgaggagggggaggacggagttcagagggtgtcgtcctgcagtatgagatttctcattgatcacagatgtgcccagagtagcccaggtcactgttaactagtgtttctgcagaggcagcaggagccatgagcatgaggcgtggcattagggaccggtcagctatgcatgctggcaggtggggttgtgtctgcaggtctcagaaatgaagaggctgctctgttctggaggcagccgtggcccagtgccagtggccagaacagtggcctttggtgggtgtgtcccgggccatctcggggtggtgctcaggagcgcctggggcaagaggtaaagagttccctggccttcaaggagagcagcgaagacccagacaggggccagccttcaggaccagagggaggccgccgaatgggaccctcctggtcaccaggagaaagccctgggccagcgagtaggcagtcaaactccttcgtccccaaggccggtggaacaagaggctcgtggtgagtcagggccagggtgggtggccaaggccagggtcaccgtgagcttcatgggccagcttttttgtttttcttggcaaattttaataactatattttgattatactgtagaatgctatgtcagcataagtaagctaaacttgaagctttcttgtgaagaataaatgcaagatagaatacatcttctattttttgtggtaccaaaaatcaccatcccctcaagagtgttcatgtatagaacattctctaatgctgaagagtaaaacattatagcaacactatgtaaatgtattgaacagtatcaaagaaatagtctctaaattgtttgtaccatattttcttttctaaacttaacataatttttagctttagtttcagtcaaaactttgtcttttctctcccgagagccttagaggttaaaatgcaatcagcctaccgtgtaaggagatgttgtccatgtactttctccagccagttgggggatcattgcagctcaggcctggtgaactcagagattccattcaatattaagaatgggattgttgaattttactcacagagaaatcactgtttcttcatgttgtaagatgttttctgtttgtgtatttgtatcatggttactcatcaaaagctctcattctgcctttgtagaattcagttcccttcctttcatcatagctaaagtgacttttttccctactattaacgtgatcctacatccttaaatctcatcgattacctcacttaggccttggaaccttggcccttggtcggtgtccttggtgtcttctaagcaaggctgtgcgttgttcagaaacgtggccagaccacatttcctgctgctcccatgccgcatgccaggtggcctgagacagagctccccatacggctgcaaggtgctttacctgtgggctttggcagtaacccaagagaggatcagaaggtggagaaggtgccacgagtgatttaacaggcctgccacagggagtgccccccgcccagctcgttctcagcacaggttttctctttgggagtacccaggtgatttctagtgacccaattttgtgtcatctccctgttttagccccacttgcctagagacaactgtttccgatgccttttctgcttatcatactagtttctaaccacgcagatttctcaaaatcatttattcaatgtattttatttgagcacttagtgtattgagctaggcaggatatagggtgccggagatacagcgatgaacaagacaggcaaaacttctgctttcctaaaacttgtgatgagagagaacaataaaaaagtgttgctgccacaaagaaaccaaagtgtgtggggaagggcgcgtgtttgcggtttacatctcttctgtcccagaatcacagggatctggtccggtcacctctggtctttcctcttagtcgcctttaggagccctggttcccgtccatcctctggggggtttgtttgaagagatctcgtgtgggtacttgtcatgaaaacaccttgggcatcatctggtgtatccagttctagtctcgagaattctggtttcccactgtgctcagcaagtggaaagttcttttcaggccagaacagctctgcaccatcacatatcgtgttgc

SEQ ID NO: 16602 - DNA, 55841 bp, Human
gttgaggaagtatttccatatatggctctttttgttgttgctatttttcaaaaattatataatttaaaatcttcaaaaattgtaaaatgtttaacattaaaaagtaaaaaaaaaaaaaaaaaattgtcaggcatagtggctcatggctgtaatcccagcgctttggatggctgaggcaggaggttcgcttaaacttaggagtcggagatcagccgggggaacatggcaaaaccctgtctcttcaaaaaaacacacaaaatttagccagatgtgctggttgcatgcctatagtcctaactactccagaggctgaggtgggaggatggcttgagcctgagaggcaaaggttgcagtgagcccagatcacaccactgtgctccagtctggtgacagagtgagatcctgtctcaaaaaaaaataacaaacaaaactaatctatagtattagaagttaagatttattgttatctctttgaggcaggtgttttgattagaagaggacataaagggggcttcaggtaaacttgaactagtctatggtttaacctcaatgttgattacatgagtttgttcactaaaaatttgacaagctgtatacctgtaacttgccaatttcttgcatttatattacacatcaataaaataagtttaaaattatgttgtgatttgcatcatttacatgcttaagtaaattctaagaatcaaatagtatcattgtaagtttttaaaaattcatgtttttaattattctgcagaaagtttgcaccagttttgacttccacaaacgacatataaaaatgcaatttatttgcattctctttagaacttgctattataattttcctaatttttaatgattttatgtaagaaaaattaagtgtatacttttctctccaactttttatttgaaaaatttcaaacttacagaaaagctgaaagaataatgtaatggataccaatatatcccttactagattcaccaagtctttaagtttttgccacacttgctatctctctgtttctatttacacacacatatatatatgtgtgtatatatgtatatatgtgtatatatgtatatatgtgtgtgtatatatgtgtatatatgtatatatgtatatatatgtgtatatatgtatatatatgtatatacacatacacacacatctatttatctgtctgcatttctgagctatttttaaagaagttttagacatcatgacaatttatcccttaatgtatcacttaagagtaagaattttttttacataaccacatttatcattacacttctatattgtcaagtaatatctagtccacatttatagttccacaatactgtcttttctagctgattaaaaaacaggattcaataaagttcattcacatgttgcatttaaatgttttatctcttcagtttcttttttacctaaaagagtccctgccccggaccgtctccccacctcctcccctcccagcttttcatattaaaatttttcaagtctaggtcacttgaaaacctcctgtttgtcttcagatatgtatgacaatggttgattttacaagctcatattgcaaaattattacaggtttttagaagcaaatgtatccacaactgtaacagattttcatttttggatattggcttgtcagagcaagacgctggatctccagccaggcaccagatgtttttattgtggggaaaaaaagagcattaagagcttttaaatcttatattattactttgatcatataagaaataattgtgacatttcatgcctggaaatgtatcacgggggctttcgttcatattgacactatatattactgaatggatcagttaatatataaccagtttaaaggacctgaaaatgtagtgacagccaagaaggatattttgaagtttgaaatgatccctatataaatagaacggatcagcataactttgggataaaattagccgacagtttgtggactctccagcatgcgcctgtttgctcggtgctgttctctcgataaatcacaacaaagcttccagagggagaggaaggatggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggtaaaaacatataggtgttattgtagaactgttagaaaatgatttaaaaaaatgcacagtgtcagttatccactctaaacagtagtttttattgtttctttaagtattcatttaaaaaatatttctaaattgatattttctttctttttaaactaaaacacattgtgggctgatatatatgtataagtcgtgtctctccttttcttttcccacccttgggcctaggacttgaaatcccagacaatcatttttagcaatgcactctctctgtttttaacttttcttctgactatgatgatatagaaggaagaaaacatttttagattatggctaagcagattgttgaaaccctatcttagacaatgtacctggtttaagaacacgctgctaattctccattaacagctacttaaagatatatcctctctatgtccatgtggatgaaaaagaggaatctccccaacatttggagggttaataaatggataaagcggtgccacaggcaccttcatggtcttcttcattttaatgagttttcagttcaggcacaaaagctgaattcagcaaaaccaaaaagttaacttttttcctggactacaataattgttcaaaattgtagatgtgtttaatacagaatatctgtcttataacgacctaaggaaaacaaaaattagaccaatttttttttaccaaggaattttctggaacccatgcttaataaatcagaaatgaattagagttccactgattctgatttcccaaatcaactggttaattgggggaacgtgagtagttagatcatctggcgagcatactgcaaacatgctgctcaacatcactaatgtttaatacaatatagatgctaaggtcttgtgtatagcatttagagacagtcattattttaatgtttaaaaatgatttctggccatctataaatcatcagtataatacatttccagatacaaatgctaatggtacagtatatatttcttcattaatttactgtcctccgattgtcagttctgagggacatatagaagagctcaggctagttactatgtttatgatttttactcaagggctttataatattttggcattaatggcattaatattttgatgggaagacaaagaagggatctattttttaaaaagtttatggggtctgttagaaaatttgtatactatataatcagattgctttcatcttataattttgttcagtgatagaatgtctgaatgctaaactaatttttaagatgtttttaaaaagcttatatttgtgcctagggtgaaataactcaggttcaagtcagtgggtaagttatttgaccctgagttgcaaagactgtcttctctcatctgagcaggccaagttgcacagattgtgggaagtttctgaggatataagaaaccaagttttaggtgcaggctctagggaagtggaggggagaggtggggttggttctcctacttccaccggtgtcatcttccttgaaggaaaagaaaatacattttaaattcttcttgtcaatatgagctgactcctatggtcctcatagagctaaattttcattcccacgaattgaggtgttttcatagtgttaggactgtgggatgtggctttcaattagggagatagcaaattacaccctctggaaaaggaaaagaacagttccattcttatgtatgccaagtggatgcttgcacagaactagtaaaatttgtggtcttacttttagggtttatgcaggaaatttgtgtctgcactcatgtgtagaaagaaacacacttgaaacacacttctccactactctgtttaatacgcacatgggcacaaggacctgtctctttagtcttaaacccaggttaaaacttcatctttcttaaaagtttcttcaggccgggagtggtggctcacgcctgtaatcccagcactttgagaggccgaggtgggctgatcacgaggtcaggagatagagaccatcctgcctaacacggtgaaaccccatttctactaaaaatacaaaaaattagccaggcgcggtggcggccgcctgtagtcccagctactcccgaggctgagacaggagaatggtgtgaacccgggaggcggagcttgcagtgagcccagatggcgccactgcactccagcctgggtgacacagggagactccgtctcaaaaagaaaaaaaaaaagaagtttcttccaatttttttcacatgcttccaaccttatcatcgatccttttaaacttaggaatggaaagttaggaatggaaatgacaaatagaatcctagctgctagtagatctaagtggttatatcaatttcttaagtcataaagtcattgtcaggcaacagcgtggagctgagcagtctacagtggttagttagttcttttctaaatagttcaaaggaataggacccatttctgtgtggccttaaaaggtatgtggctggattaaagtttgtgagactttattaaatcaaaggagaagttttggaccttggacgctgttgaactgctacacactgctctttgatttttttaaagcacttttgaaaagctctccgcaaaagtgcataaataagtgtgcagcttgattacttttcacaaaataacaaacctatgtaaccagcatccagatgaggaaacagagcattcctgtttacttttaaagtgtgggaatcttcaggtttcagttatttttggcttaataagaaagacaatgcacaaaacctataacgaatctcatgctactcttaaatttccttgtgtaatcaatactaaaattctatattcaacatttgatagtcctatagaaagtgaaaagtagtacaatcaattctaaaccattcttatttatttagaacatacagcatttttataggatttaagaagtaactaaattttatccctaaatatagtccatctaagcctatatgaaagtcagtgtataatttttgaaaagggaactcagaactctgctggcaaataaatcacctaaaatctaaatagtgcttcccaaatttacaatctactgggcacaccagtaatcaaaagtttagctcataagcaaatatgaaatgtgtattttgtgaggaagacagaataaagctattggattacaaataagtctggaagctcatttctgctttcctctgtagcactgggcccatctcattgaatagcttctcttaccaatttggcagagaacagatttagaagccagcctccagagttcatgttcaaactgtggatcctgtctttctccagcacctaatcatgattcttaaagttagagagctctcactttacttttctaagttattttaagcttcataataaaatctgcagatgaaatcatgttttattaatttaaagaaacttttctcacattttgtaaagcaaacatttaaaatgtgctggttggcatttgagagacctccctgggaatggcggagataatgggtcttaaaagcaaaaacaagtaagccaaaattgcgtttaccagatgatcactttaaaataaaaacgatataaagaaaacataaagaatgactttctaactgccaaatgcaataagtcattgaaagtcaagggatgtcagtgatataacattaattatgagccaaccactgagtatttagagtgaagtcaagcacagaagaaatctttaaagaaaacacaaatgtcccttctattggttttcactggttacttccatactggaaacacgaaggactgtccataaaactgtttccaaaggctttaccaacttgatcttccttcagatgtatgagcttttgctcataaatgatacaggcagaatttcatacttatctctttggtatgaaattccctagtcagcaaggttaatcagagtccttttattaatcagggtaatgcactttaagtacttcgtttatggcccatagccactgattccttggttggtagtcatatttttaattaaaataaccaatgaatgatttcacttaaaaaactttctggcaggtactctgtttcctttactaagtagcaacttatatcccaatattgtgaaagctcttatttccactctctgaatgaataatttctttatcacctaattttcctctttgccagaaattcactctcctgctttcccatttccatcctagggttcttttcctttcttcgatgttcaaacttttttcttttacattttacacttcaaacttgcttttatccccccttcccaggggaactttgagttatctggaaaatattagctattaaaaaatagccaagaattgtgcttcagtctgtaatccttcaggactgtgtaaatacatggacacaggcagagcaaatgtctgctaatccagccacgagcagtgtgtgtaacctttggctgtaataacagaggcttctcatgtgtggggttcttttgactcagataacattatagttgataactgttgcagagcccaggcttagctgaaggtttaccagaaatgtgtacatcctctccaaacgctggagcagaaccaatcccctcttccaaaagaaggcccaaacactttgctccttgctatatttctaggcagctttctacccagctattggggcatatctctttggtttcagatttaaattaaacacacacgcgcacgcgtgcacacacacacgattagtctgcatattttcttttcagggataaaacttctcaaattcctttagaacttttagctacaagtgatatcagtttggaggtaaactgcatgtagccttcggatcatagacggctatttaaagatttgggggcaatggagtttgagagttagagttgattctgtgggtacttgttatatgaacatggacactttatactacttaacctcttccagactaattatcttcatttgtaaaatggaagctttgacaagaccctctctaagttcagattctggcatgcagataattaatcacattatgaaggtgaaactatgtaaacagattatgtatcatggtcaaagccacatgggcatggcctgtatttgggagttcctgtgggttttgtacacaggggaaataatctctatttttcttttcttcttagtggagcttcttattcaaacagaactcttctgcaaggagctgtcactgcacacagactctagacatggggtagcgtgtgagtggtttacattagagggaggcagccgctgcttcacctcccacccctagctcccatgggcttggttccccggttctccctcacctctgtcctttgtgaagtctaaacacatagtaaaagggcagcctgaagtctgcagaggtgagcagaggggggcttttgaaagacaaatactaggaataaatcacattctaggtttcgaagccctggaaaaattttgctgtgggaagaagggagtgtgtaaaaaatgaatctgcctcatcagttaattgtgtttctagcatgctgtggtcattggtggttatattttgggggacaaattctgatctcttgacatatcagcatcagcagaagattgtgaataggcacagcctcatctgtagtttttgaagatagctttacctggggtttggtcctccatgacagtaagtgtatttacttccacacttgctacacagtgacctgtaggcccagcctcattttaaagtgatgattgtacgctgatggcccttttgccaggggctgctcttttctctgctcaaagcagcagactttcctgatatgctcagggctgaattattcaaaaatccctagccccacattaccaccaaagttttgcaacacagcttccagatacacttcagtataccctaagctatagcctgcaaactgtcctcttgccatttctccacttcagctccccagaggcagcagctaaggtgtcttgttaccacctacctacacacattcctatcttaggagaggtgagttgtaaccacaactccattctgggagttggctgaattccaggaccttgtagtctgtgagcctgattgaccagataatgtttatgattacaggagatgcagaagaaactgactgagaggccaaggatgactgactcacataatacacgaacaggatagagtctttaggtgctacctggaagttaggaggaggaaaaaaattcaactagcaaatgcatttccatatcagagatgtgaaatattacagatgaattgaggatcttcttcctttccttgtgatttgtgaagcaggcttggaggtaattctattctgcttccacaaagacaaagacagatgaaaactgcattgcgggtattctgagtccatgagtttggattgaggcaggcaactcatggctctagcaggctgaaaaagtggcagttttctcatctggaaaatgaaaggcttggactggataatcttccctccagcgctaacattctgtgtttctttgattttacatcaaaatggtgttttcttaatcagctctctgctgcttcctttctgggatcatttttcttcccattgcagaagcaggcgcaaatttccaatcagttgtcacagagagctgcctaatttttgctgttaatcagcaggcaaaacacatcctggttttcagacctggaaccaacttcttaggcagttaggaaagactgtttttgccagttgctttttgaggaaatttgagtattaaaatgactgattaagtattgaagttaatgtgattcgttcatcatcaaaagcaagctgcatgacatacagcttaggaactctgctcggaacagagattcaatgtacataactcaatagaaatgtataaatgaatctatatgtacatacattgtgtgtgcatatcaatttgcacacacatacacacgaggcgtggagttgatgctccccagcccagactgtctatgacactacttagttctgccatggaaagtccatataatccaacaccatctcttcccagtgtctggaatctcaaagtaatatattagaatttaattctattagctgaatatagattcttctataaattcagataatcctcagagtgatcatactttaaacaatcctcagtccattagaccttaatgtgaaataactggatttctttttaaagaggagatttggataaagggaaaggtgggagagagagaaagcaagatggctctagaattctgaatggagtaaaaaagagatgaaagtgtgtgtgtgtgtgtgtgtgtgtgtgtgtatgtgtgtgtgtgtgtatagctaggttggaggatacattacagaaagacagacaaactttgggttgagttcattcattcctgtgggattaatcactgtgcacaaccttgtaaatagcttctttaaattaaattattttttcccctctggacagagagacaatagcttattttgattttatttatttttgttaaaaagcaatacatgcacaggatactaaatttagaagttgccaaggaggtaacttggtatgttacctccttgtaacaagaacaagtgcatttctgtcctgatcccccaaccccccagttcttcttggaggccaccactataaccagtttcgtgttctcagtgtttacaaatgtatttgcatatgatagcatagtttgtatactgtttggctccctgcttctctcattcagtaatatatcttgagatctttccatttcagtctatatagaactgcccctttttttaatggttgtatagtatttgattgacggatgtatcataatttatttaagcaatctcctatcaattaacatggaggttgtttaaccattcgaacaatgctgtagtgtagtgcatgttcttgtatgtagaccaggttgtcaagattcctaagtccaggagcacatttcacagagtacaatgcaaatgttgttttttgtggagttgtgcaatacagtggtcctttaggacatttcacatgggtgtttatgcttataggataaatacccaggagtggcatgtctctagtgtttttcacttaaatgagagaaatttaatacctgatcaccaggcccacttttaatgtggtcatcatcctcagagcaccctctagtagttcatcatttcttgtaaggggcaatgcccagcagtcatcgtaatattctagatttcttatgaccttatctaatcagtgaagaatacaatgtttacttctcttgttctggacactacacttttattaatgtagtttcagattgtattagttttttggcagtaccatcccactgttggcttattttgagattacagctcaaatccctaggttgtttctcaaataaatgaccattaaatcatattctgcttactttgtacttgtaagtggaatttttataatctataagcaaacttttgatttatccatgttaaaatttattttgttgtttcagccctaaagtaacttctacgctgtgactgttgaagaactatctcttcatcttcttgccctcagtattttttctttctgtacctattttccgttctccattcataaaagcttaaatgctatggctattggcattgacatagaaagaaggtttataaagtcatcatagttatagcttgtcaaatgtggcaatagttgcagatttatagaaaaaagaccagctcagcgtatagaagtcagagatcagtgggagaaaagagagagagagaggcagagagagagaatgcacatttccaaaaaccaatgggaaaaattattgaagatctcagttctaggcacatctatgcttcccctgcccaatcatttatgtatggcttgtagacatagttaattatgcaacatatcttattttcctgtttattttggctgctaggaaattcaaaggcaaatttgcaatgccattctagtgtataggatacagtttatattttgtgtatgtatttgtcttacttttgacatttttattttcctacttttttattttgcccttattttctaaatcgtttaaaaaatctttaagtgtgtgaaagttgagagttgccttaaattcgtctttggaaagcgatattgcataaatcaacaggcaggcaaataaaatcttggagtgataatttttttaaaaagattaaatatattcatatgttggattgacaacaactataggaaaaaagattttggatagaataaaaattataagcttgcaactgacagccttggaatcattcaagacaaactctcaatgattgaaagttttttaaaaaaatatccttgaagcatctcaaataactcagcatgcaaaataaaatacaattacataaatgaagatcccaaacttaaatgccttcaagacctagaaaggtaaagtaaataaaggaacaagacacagtaataagaaacagtagagacagtgagagcttgagaaagcctgttcccctgatgaatatcagaatatgctatttaacaaaacgcttgcagacccattagctattagtttaaaacctctgtcatcccctctccaccccacttttataaatgtggccaaaataaaatacttgtaaaaatcctcacaaaacagggagaaagcctaggtcaagaagttaaactttccttttccttttttttttttttcaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggtaagcctttctgggtggccaacattgttgtctgcttgtacactcatggtttcaagactttgtgacccctacctaccccagatgatgtagtaagcataaagatgcaattatgcctagtacagaaggccctaaaaaatacatagttctgttgattcaggtaattcaatgatgatcacattaaaatcttattatctaatagcaggaagttcattcatttactcatttacttaacaaatatttatttagctcctattatgcatcaggtaatgcactaagtcaatgaaaaagagaaaatactcctgccctcaaagaaagtatattctaataagggagacaaatattaacaaaataaattcataaatatataattataaattgggacagtgttttgaaggagaaaacaggagttatgaatgaggatgtcagaagtgaattactataaaatgtataaagtcttctctaaggatattatgctaggtaggctgaaattttaagaatgaaaaggacggccaggtgctgtggctcatgcttgtggtaccagaagttttggaggctaaggtgagaggatcacttgagcccaggagttcgagaccagtctcggcaacatagggagaccccatctctacaaaaagcaaaaaaaattagccgggcatggtggcatgcacctgtggtcccagctactcaggagactgaggtaggagggtcacttgatcccaagaggtcaaggctgcagtgacttgtgattatgccactgcactccagcctgactgacagagtgagaccctgtctcaaaacaaaaaacaaagaacaaaaacaaacaaaaaacaaatgggaaggagacagccattaaaaaagaacgccgagaggaagaggggtctagctataggaaatagcttgagcaaaattgctaagagagcaataaaacttggaatattaaacagatagaagagggctactatgaccagagtatcatgggtgtggggtagggtgggaaggacaagagggtagaggggagtgttacaagatgacattggatgtgttagatcctacagggcctttgagggtcaaagtgtagggctctgaaatggagccacaaaaaagttttcagtaagacagtgacatgatttaattttcctttaaagtcattattctggagctatgcagaaaatagattggaggtagacaagaatggaagcagggagaccagtagggaagctattgtaatagtctaggtgagagaagatggtggcttgcaccaggggcaagctcagataggaagtttaggagatgggtttgcaatacattttggaagtagaattgttgggattcagagatggattggatgtgggtggggtgtgaaggaaaaaggaagtcccaagtatcattgcctggtttcaggttttagtaaataggcagatagtgatgccattttttgaggtaaagaaacttgaggaagaggcacctatgtagggataatcattaaatccattttttaaaaagtcagtttatggaggtataattttcactcagcaaaattaacagtacaatttaacattttgagaaatattgtttttgtgaaactatcatgccaatcatcttaaaaagtttcctgatgccctttgtagttagtcctctccccctctacatctacagacaaccactgatgttttctgtccctataattttgcctgttttcagaatgtcatatacattaaaatataaaatatgtaggcttctgagtctggtttctctcacttagcataatacatttgagatccatccatatggttgcatggaccaataaattagacctttttattgctgagtagtattccattgtatacacataacaaaattgatctaccccccagtagagggacatttggaatgtccttaggttttgtcagttttcaaagaaaggctgatataaacatttgcatacaggtttttatgtggactttttatttctcttatataaatacctaggagtgggatgatggctatgtggtaaatttataagaaactgcaacactgttttccaaagtagttctgtcatttcgtatttctatcagcaatgtatgagaattccagttgcttggcagaacttgataatgtgagataaaaaaaattaggctgggcacggtggctcacacctataatatcagtattttgggaggccaaggtgggagaactgcttgggtctaggagtttgagttcagcgtgggcaacatcagtttgcaatcattacaaacatattagaatagctaacatattggctaacattctaaatgtccctctactggggggtagatcattagaatgttagccattctaaatatgtttgtaatggtatctcattgttttaatttgaatttctctgatgactaaggatgttgaacatgttttcatgtattgatttgccatctgtatattatttactttggtgaaatgtctgtaacttttactcctttaaagaaatgggttgcctgtattcttattgatttgagagagttcttgatatatattccgaatactagtcatttatcagatacatagtttgcacgtatttctcttcattctgtggcttttcttttcattttcctaacagtatctttcaaagagaagaagtatttagttctgataaattcaatttaccaatttttttcctcctagcaaaaaatttgtttcatatgtttatttctagaggttttgtcatttcagattttacttttaggtgtaggattcattttgagttaatttttttatatggtataagttatgggttaggttcgtctttttttatatggatgcccagttgtttcaacaccatttgttgaaaagaatattctttcaccatcaaactgccttagtatttttgtcaaaaatcaattggcaatatatgtatgggtttatttctggactccagcctattccattgacctatatatctttttatttttttccctaatgctccactgacttgattgccacaggtttgtatcaagtcttgaaatcagatagagtgagtcctcctagatcagttttaagtatgagagttttcatatctctttgaaacttcagtgaaaatgtcaaggatgcactttatataaaagtatagatttcagaacagagccctggactaaaggtataatttcagaattgttggcctatagattgtatttgaagtcaaggaaatcaatggaatcgcctggataaagagtatatatagagaaaagtgaatctatgaaaaagccccaatgaattctaacatttcaatgttagaaggatgaggagaaaccagtaaaggagagtaagatatactgataagtaaaattggagaaaaccaagagtattttggcaacacaaggacaaagaaagaggtagtaggttccagaagcagagagtggccagctatagtgatagctacccagggttaattagatgttcattagattaggtgacagagttatcactgacaaaaatagttttggtgaaacagtgttaaaagccagatttgaatggtataaagtgcaaatgggtggtaagaaaccagagatgccacaggtaaacaattggtaaaaagaagtgaggctgcagaagtgaacataagaagagcatgattgctggagggggctggagggaggtcacaggcaagacttacctacagttggagatcaaagaaaaagcttgtgtgctaaaggaaatgattcatagaaagaaaacagctgaagatgcacgagacaggataactgaaagtccttcagaagttgagatgagattaaatccagagactacgggatacatcctcttttttttttttttttttttttttgagacggagtctcgctttgtcgcctgggctggagtgcagtggtgcgatctcggctcactgcaagctctgcctcccgggttcacgccattctcctgcctcagcctcccaagtagctgggagcatcctcatttttaagaagcgggacaaagtaaaagatggttttaaatgccagaatatttatagatttgatggtgctacgatgagggagttcggatggtttttcccctcaacaatgtgtcaaagtcaccagccaaaaaatgagaggagagcagaaagcatagacattttcataagaatggagaaggaatgggaggttcgggagaaaaaaaatgggagaagaaacttactagagaaatgtagtaggattactggacttataaaagatgccatgtggctaggagccgtggcttatgcttgtaatcccagaactttggggaggctgaggcaggaggaccttttgaggccaggagtttgagatcagactgggcaacatagtgagaccacatctttactaaaggaaaaataaattaaccaggcatggtggtgcatctgtattcctagctactcgaaaggctgaggcaggagaattgcttgagctcacgagtttgaggctggctgctgtgagctattattggaccactgcacaccagcctgtgtgacagagcaagatctgtctcaaaaaaaaaaaaaaaaaaaaaaaaaaaagccatgatcttttcaacctgcggaaatgaaggggaagaaaaaattcagcccagcatattctccttcttctttggttcacttgttaaaaatgaggctgtatcccatattctctggatttcatctcatctcaacttctgaaagactggaacctttcagttatcctgtctcatacatcttcaactgttatttctatgaatcacttactttggcacacaaggttttcctctgatctccaactgtagataatagtgacctgtgacctccctccagcaattgtgctcttcttcgcttttgcagcctcccacttaggaaggaagctacagggacaaggttaggcataatttggagcttactcacattttctatgtgtagccatcaccactcttcacatttactcattcatttatgtttagatttagtttttatctttattgatttttaaatttaattagtttaaacatgcaagctttttatttttaagagtttaaggaattttagaaattatatattaatttaatcattaactttctaattaaaacattttttgtctcacttttcgtaataatgaaatgaaaatgaaagctgcccactttactctgcatgaagcaaatcctgacagtaggaggaaaatttgttactgcaggaaagccataaaaattcaaatgtttcttagcagaatgtagcatgggggcaatgtaaagggggccatgccttttaaaagactgttccctgctactttatctgacagtgacacaagtcaaccacatgttaggaaattccctggtcaatgaagtggaacatggtaaggcaagatgtcactggccttcattttaatccgaaatagataggcctgctggacagacgctgctcttaccacctcaccgcattccatcttttcatcttaatcataaataagaacacttaagatctactttcaacaaatttccagtaaacaatgcagtgttactaactatagtcatcctgctatacattagatcttcagaacttattcatcatccggtgtaactgaaactttgttaactttttacattgtggccttttcatgtgacttcatcaaccacaaactgacagagtggccaacctttcactccctagaggtgtcacctttcccagccggtacagttattccccatctcttttgttcttgtcaacagagggagactacctagagatgagaaggaagaaagaggtagggggaagcttgggcaatgcttgtaggctgacactaatgaattaggcttataagaatcaaggagagagaatagaagtccattaaagatccacttactctttcaagccatgtcatcaaaggccgaattcacaaagaaaatagagataaattagagaaagcaaaaatgttcaacttcagaagggcaaacaccataaaattaaaaggcaatcataaaactggggaaaatatttgagactatatgacaaagggcttactatacgcagaagtttttcaattaaagtaatgaggctaacaactaaaaaaaaagagagagaaagaggtaaaaaaagaaaaagaacaaaacgaccaagaacaggaatatttaagggaaaaaaaagaaaaatcatataaacagcaaataaatatatgacataatgatagccttcattggtaatcagtaacatgtcaattaaaatgacaattagctattttgttgttgtttgttacgttaataagcatacaaaagataatacatatatgacaaacacatagggaagtgctcttacacacgcttaatagaatgtaaataggtaccagcctgggggggggggcaaattgataacacatatcaaaagcttaaaactttcttgtaacttagaaaattcgcctctaggattagggaccaattctaggcaggagaccattttacccagggctgtcatttacttagggcctcaaattcagactttagatgttatctctgaactaggttatacctaaagtcaaagagataactggggagaaagaaaaagaaagacactgatcatgtaacttagaattgtgcttggtcacatgacctgcagtacactagaaattagagactttctcctaattctgtaagagttttcagaataatgcagttagagtatattttacttattttaccttatattttcatcttagaagttttgattggttaagaaaaacatttaaaatgtaccacaattgaaaatatatagataggcacttttaatttttaaatgtatttagagtctcaaaaaattgcttgattcctatttgccctcagagagtcatttatattactgaaaaactgaaaaatgcttacatatctaatagaaaatttcatgttgttaccgccataccatgcagatatttaaaatgatgtttaaaggaatgtccattcacatgggaaggttgtaaaaagcagcttatgggacagtatggactgtatagatgtatttttctgaaaattatatgtgactatgcatatcaaaataatatttaaaatatcagagtgaaacttgatattatagctaatgtttaactgtagctaagcaatttcaaaaaggcaaatctgttattttagatccttgctgctagaataattttttttaaagtgtggcagctggcagatatataaataagaaaacaaacctgtgaatcagatcactgggtaaaatttcaacccatcttatgcatgaggagaaagtaagtgttttgcaggtaggtcttctaacctggaaactaaaagactgtgagcatcttgttttctttcctttgcatttttatgcctcagcttcttggacagcgcttggcacatagaaagtgctcaataaatagttactgagattactgacagatctgggaatggctccagaagccctgagtgcatggatggggacccactgccacctaataaatgaaaactgtgtggttcatggttaatgaaatgctgctcttcatcagttttaccctctcagtctctagaggtatagccaaaggctaaattttctctctcttagattatgtcacagatactctgggggagaactcaaatacatcactttgtagctggacagagggaattgagacaacatatagacgaggaaaatacgtcaggctaacattaagctcaggaccacagaagtccgttagaggaagaaccaatgccatggcaactgaaaaccgatgtaatttcatttgctatttaatgggctctttgtggaaaagtgctctttgtggaaaaggctaattgaggcaaaaaattgcacccaattttctcttaaaggattttcccctattttttcagtgttgcagagcctgctttgtccccatgctggattttgtctgttatttttctgtttgcctttctacttaatgcccccatctcctggcctttgttgcctttggtattagtaaaataatgttcatcagttgagaaggcttatttaccctgctgaaaaacctcctctccttgaatcctgcatttccctatgaataaagagagtcggggcaggtttaggtggctgctaagcagcatattatttctacctattccattcgtaagaggaaaatgaaagctgcccgctttactctgcatgaagcaaatcctgacagtaggaggaaaatttgttactgcaggaaagccataaaaattcaaatgttccttagcagaaagtgacatgggggcaatgtaaaggggaccatgccttttaaaagactgttccctgctactttatctgacagtgacacaagtcaaccacatgttaggaaattccctggtcaatgaagtggaacatggtaaggcaagatgtcactggccttcattttaatccgaaatagatatgcctgctggacagacgctgctcttaccacctcaccgcgttccatcttttcatcttctgcgttatacattgtaatagcataaatctgaccatgttagacatttgcaaaccaccctgaggatttttgccacatctgctgtattgtgagtaccacctgtgcaatatgaatttaatgttgtcatcaaattgatattacttatgaaattcaattttaaaggaaacttgatattactataaaaaattgaaacccaaaatcccttgacatacactgagggtaacagtaacagcaaataaaaggcaattaaattcttgacctccatctgctcagagaccctctgttctcagatggcagaaaatgactctaaaaggccgtgtcttctggtcactgctttttccagaagacttgcctccaatcattctgctctgagtgagtgaacttgaaatgagtttgcagtccctatctcacacctagtcagtcagcagttactccagtcccgtaaagcatgttccacgaaaaatcataccacacttcaggaaacacaaccttaagcagtgctttcaagttgatagtctatttagtggtgaaattgtagaagcatctctttagaatcacgaatgaaacaacttttctgctctcgtcacagtctcttcagccctgtcctggaggtcctaactggcacaaagagaagagaaaaatacataatgtacgatgattgaaaagaaggaagcaaaatggccgttatttaaaacaggatgtttgtctacatggaaaatccaagaaaatctacaattaaatggttacaactagtaactgagttcagaagaggtagtgcatttaagatcaatatacaaaaatcaattgcatttctgtataccagaaataagcagctagaaattgcaatgtaagaaaagatatatttataatatcacaagaaatttaaggggcctagaaaatatatttagcaaaagaggtggaagaaatatgaaaattgtttaaaagacattaagaagataccatattcaaggtttataatgaaaaatgtagtactagattattccttcttcagaggcaaccacttttacttccttgagctgattagtttggtatttagctccaaattactaaataaataccatttatttatccataaaagtggaaaagaataagtagcaatagaagcagctttatgagaatctattgatttattctaatggaaaatgaggatctggctccttttcctctatccgtgtccccccccccccaaatacttattcattccctgtcccttatgatgttatattataactatgaggcttgtggtcaactatgatagtttctttttttgtgcaatgtttgttatctctgtagaaaactgtcttatttcattcttttgcttaattttctacatactcattgctatttaacctcaaagcttttgccaatatttttattttattttactttattcatttttagagacagggtttcactctgtcacccaggctagaatgcagtggcatgaccatggttcactgcaggtttgacttcccaggctcaagcagtcctcccacctcagcctcccaagtagctgagactacaggcacatgggccgtgcctggctaatttttaaaaaattatttttagtagagacagggtcttgctattttgatgaggctagtctccaactcctggcctcaagtgatcctcctgcctaggcctacaaagtgctggaattataggtgtgaggcattgtacctggtcagacaatagttttaatcttttctgaaatatttaaactcagtgggtattttatcaatgttattttcttgaaaaagttccttctggagtcttcagacctgctccaatgagtttcaggttgatgtgcatctggtgaaccactgtcatcctgggattcccattccctatcatcccagggacacccttttcctctctcctgttttctggaccacaagtcttcctaaatcttggtgtgttgcctgtttgggttagatatgtcctctggtacatttctgagaaagggtgcatgagaccatacatgcaccccagtgcatgaattctacccccgacttagagtagaattctagattcataaacattttcttttagcatggtgaaggcattgccccattgccttctagtttccagtactgcagctggaaaattgaaagccatttacatcttcatttttttatgtgaatttttatcttcctctctggggaatttagattcttttttttttttttttttggtctttgatgttctaaaatttcacaatgaactgtcttggtaggtttatcttcatcctttgtactgagtccattcaattccaaactgcttgtctatcagttctgaaaaatgttcctgaattatttcctgggtgagttcttttcttctgctttctatatgctctctttcttgaattactattatttggatatcgaacctccctggactgtttctctaattatcttgtattgtctcgtctctcctattttatgttttttattctctacttgctgggagatcttttctaggttgtttttctctgtttttattgtctctgtcaactatattagaggttttcctcagatgtcttataatccttggctgtctgcctatatttaagatccgagtcactaaaagctgatttggaatctaattatctacgtagaggttttttgtttgtttgtttgtttttttgctgcagggtatctggctgcacctttcatctgaggaatctctgacatagtctcttatgaatttttttttccttgagattggtcagattctccgaaaaaaaatctaactggctttttttctagagagtcaagacctaaatgccattattccaggtgctaagttaggggaaaaggctggggatgcaaatacagcatatctgctatctagaatgctctgctcctcttctttgccgagcaaacttctactcctgtgcgaagtcttagttcagacttcacttctgaggatcagtcttccttaattcctttaaaatcaattaggtcccaatgctatgttctgtattctcatagcacattgtagctttcctctgtggcacttacattttatttgttgaattctttgattagtaactgcctccctcactaaaccataagtttcaggagaccagagactgttttgcttggcagagcccagtgcatagtacatattgggtgttgattgttaaaaatttattgaatgttcaattgacaacaagttctagcactagggaaaagagtgcagttgaaccagagcaatttcatgatcattaccagtaaaatcatgctcagttgtacacattgcttctttcccatatgaagagagtatgtcaggaaggagggagaagtcagaagtgttaaatactacggagagatccagtaagttgagagttaaacagctgctattggatttagtgacatggatggaactgaagattataccaatgagttgagcgacggatgcagaagtcagagtgggggggattgagaactaaaaaggagggtgtctgaaagtgtgaacaagccttttaaggagtatttgtgaagaggagatgagaaggtagatgaagaggaaaatgggtttgaacttattttttttttagattttagatgatagaaacctgagcatttaaaaaactgatggaaaaatccaccagtagggcagacattgaagacaaagaagacagtagggataatttttggtgtgaggattctgagaagtttgggaaatgagatccagagcaggtaaaaggattgactttggagaggagaacctctgttctatcgtagccagaggcagagaaggagagaatgagagttgatgtgtgtggtgggaaggctttaaggaagcttccctttgaagggcattttttatgtaaagtaagaagtgaagagagttgagagtgaaaagagaagaagtataaaagatctgaggaaaaaagaggtttgaaataattgttagagaggaaatattatattttctataattatagagaataattattatagggaattatagagaacaggaaagtaagtcaaacagagaaacactgggtttccgagcagtctggagggtccaattgagttttgatgtttgcctttatgatgctactagtcttgcacaggtggcacaggtggtttttgtcacacagcactcagctgcttgggtgcaggcactgagacagcagataattgggctcacgcaggtttagggtcactcataatggccccagatagatgctatgaagagatgaagggaatttaaagttccagcaaaagagttattaaaatgataaaatatggaactaagctggatagagaaggagagaagaaaggaacatttaatggacaaagagaacacagagagggatctgatggagtccaagaattgttatagtggacactgaacaagcaagatgcaaagacagaagattgtgggcagagaattggatatgtgaatcagtgatttctggagacagataaatttcagataacgactcagtccaggtatgactgtgggttggagtcatcaagtcagagtaggagaaagtcactgaagtgaatgagattcagaaacggggagaccaggagattgggtgggtcattcatgtggtattaaagacccccaaaataatgtcaggaatttttgaggtgaggagtaatgtgagttaggtgctaaaatcttaagaaacagatgggaagataattatattcgggaaggagattaggtggtatagctgaaaaagcaaagccctaaagaagtaggggtgttctttttatttatctttccacgagaattagggagtaattggaaggagcaatggggagtcagatatatgaaaaagaacacccagctatataccacaggccagagttaagcatcccacatccgttgtttgagcttggaacacagcaaagctagtttggttgccatggtgaccaacgccatgtctccgggctcattaatcctctattccaaactaagcacttagcaatagcttctgaataaatgcaacaaagctctgcatactgaaaagggcacattcatgttaagcagaggaaaagggttttcaatttcattcattaaacttgagtaaataatttaatatctttgtgcgtcagtcctcctagctaatgaataaggataaatgcttaatggaaaatctagcttaataaagttaacagcattggcactacatataaaggaaattgatgttgccggtatacatgcatatgaaggggaaaactgaaaggaaaataatatatattaagcatctatgatgtggctatgtcaggtacttgaaaataaaatgtttcatttaatccttgcaacaaccatgtgaggttgcacattattctccttatttaaaaaatgaggaatcggagactcagataagttgaatcaggcctcagtacaaagcttgtcagattcaagcagatcaaattttatttgttttgggtccgtgatgctcccactgtgtcttgctggaaattgaataatgcttatccttctgggacatttggctaattaaaaaattaggagaaaagactgtgctaaggtgacacttaatatctaaaagagaagcttaaatgctatatcagaatcctattagcttaaaaaattaactatcctaagattttttaaaggcttttcttaaaaaaaaaatgagaaggcagctgggtatattagaagtgtgtttaatgaaaagatatgaaaaactgtcgatgtttcttccgaaatgagtcccatcaaggcaatcgtttatccccattctgtcgttttctaacatgaagaattggagttgcaaagcacactctcaacacagaaactgatcctttccttttaagtatcatgcctttattttggtttctggatttgctccaacaagggtgtagataagtgattgaaaaagatatattgaaaatccattaattcattttccttaaaattaaactctttaattaaaaacaacactttgatcaatttctaatttctacctccaacaatgtaatatagcaagggttaaaataatagaaataactaggcgtatgttaaatatccctgtcactaaacttagatgttagcatttttctttttttctccaaacactaattgttttggtctcacctatacgacaattttaggtcaattttctcaagtttgggttgcttactgcagccaggtgattcccaagtgcttcagaggaaaagtagtaatcacagccttctttcccacctgttagcattacaggtttccttctctgacccactctctttaaattctacaatcaaaaaccatatgtgtcttctgttttgagttttcagtctggatgtgttatctttgttttataactggaagcatctgaaaccggaaattgaaggatgaagtttccttaggcctgtacttctttatttattttctatcagcactttaatttgtttcttacttaggggagcctggagcttattatcctctgaacattttaaatacccatttagcaaaagatatcagacttacaaacagaaatgcaagtgttttctttgtcatctctgtaagtaataacttatggaacataatataaacaattttagaaggtttttccattaagctaaccaagaaaacatacaaataggggaaatgatgaaagctcagaattggatgctaagaatcaagcacatgccagcttcttgaagtttttactaattagaaagctaatggggacagaataacggtggacccctctcttttccaagacaaaacattttgttgacagcccgcccctaccgagagccaccaagaagtgaacgctgcagggaaggcccagttagggagtcccctgaaagcaaatcactccagcccccttttctttgttttcttgcggcctcagaattctggcagccctcagcaacactcttgaattaagagggccacaccaaccaaagacctgggtggtaagagtaggaagtacgtgcacttctcgcaagcatagttgaattaacctgggtgggggcaggaggaagagccgtgaagaaagatcggcttggacttaataattaataataaccctgtaatcacagctacttgggaggctgaggcaggagaatctcttgaacctgggaggccgagggtgcggtgagccgagattgcgccattgcactccagcctgggcaacaagagcaaaactccgtctcaaaaaaaaaaaataaataaataaaaataacaacagctggatatggcatttattttgcatgcttggcactttgtctatgctttcactaatcctcacaactatcctatgaggttaagatttgcagattaaaacactgagcttgagacaaattgcttaatagtgaaatcaggttttgactgcagtgacctcaatacagagctctcgttttgtccactaggtggtgctgccttccctttgctactttagagtcctgccgctaatgtaaattagtctcgggactgccttgggtgactttgctgtttttgccttattctgtggatctcatctccactgtagactgtatatgtcagtcagcaaacctgccactccctcagcttcttctataactgccttgctcccagcccctgatgaaggggaagcacaggttgctatcttctgtaacacttgatcctcccatgctgtagcctattagaccaggggtggtgttcaaccaagggctggccaggaggctcgaacatggcttgatatgaaaagaggaactcaaggacagtgcttaaaagtgaaggttctggagtaagacggactcggttcagaccttgactattccattcatgagggcaaaatttaacttctttgaatcttagccctcacctaccaaatggggctacggataattcaagttgattctagggaactccagcaaggctttatggattatgtaaggctcttttcccccatccctggacctgtgaaagtatctttatgttgtctagaaatgcgtttcccaaagtccactgtattaagcaatgatgctggagctgttaataggtgtttcaaaaagagaattccttggaaaaataagtcctggaaaatccatgttaaactggacagatttcctcaatataaacttctcagaatctttcatgtgctaatgtgaattgtaaagatacaaaggtacataaaatctacacatttatttaaccacagagcttttatttttaatccatcttgcaatactaatatgccacagagcagactttgggtaatgctggcttagaagaatgaaattagggcctatagctagaaggggaactcacatttggtgcagcaagaactccatttagccctgtgtacgtcagtcttctttccagcttctcttctgagggcagattctatcagtgcgttaggaagaaaaacgaccctccaaagatgtctaagtcctcatccttggggcctgtgattacatgttacttgatatggcaaaaaaagcactttgcagatgtgattaaattaagaactttgagatgaggagattatcttggattatccatgttggtcatgtctctttaaaatcagggaccttttttggctatagttagaggaaatgtggctatagaaggaaggtcagagagataggatgtataagagattctacccaccattgttagctttgaagatggaggaaggaggccatggtcacgaaatgtgggaagcctctagaagctggaaaaggtaaggaaatggactcttctatacattctggttgacttcaatcttagcccactgtcagggttttttttgttttttgtttgtttttttttttttttttttagaaatcgagccaatagaatgtgtgtgtgtgtgtgtgtgtgtgtgtgtgtgtgtgtgttcagagacagggaatggaatgatttattttaaggaattggctcatgcaatgtggaggtgcaagtctgaaatctggagggaaggccagtaggctggagacctagggaatagatacagtctgttgccagagcccttccttgcttgtgggaggttagtcttcgttctatgaagactttcaatggagtggatgaagcccacccacattaaggagaacaatctgtttttaactcaaagtttgctgatttacatgtgaatctcatctagaaaaacaacatcacagaaacatccagaatattgtttgaccaaatagctaagcagcatggcccagccaagttgttacataaaattaaccattacctccactgagacttgtgtcagacttctgacctgcataactgtaaataatcaatttgtgttgttttcagctgcccagtttgtggtaacttgtgacagcagcaataagaagctaggactctcacctacccaccctaggcatcctaggcattactatctgctataatgtaagtgatttccttttgaggaattggtcatctgtctgtcaattctggtccatttctctaattctgccatcatccacgaaggatttcgatgctggcataaattaccagtccaaaatcaccctcacaactcctggacctccacaattctaacaatctgcatttcactccaggtcagctgtgcactcacatgatctcatccttggtcctttatggctctccagtattttcgcttcttatctttccatcattctctctcagttacactgcaccaattctttaatgtcttcatgactccagttccttgcccctttttgaatacaggtctctcaccctctcttaacgtcatttctttctctactcagtctgggcttccttgttgattacttgaatttctgtctcaccgacactataactttgccacagtacaatccttctagattagcacagaccatatacacctctaatacaccattccctgcctactattaaatcatctataaaaatacagaaaaacttaccaaagccctttagcaatagctatgtaaactaaatatatgaacaaactataaaccaaagaatggtgaaatttctattaattacatcataaaaatgaatgaatttggatgtccctcttaaacaaaatggacagacaacccctccaagagttagaggaagaggttgactgacatgttcagtgtctggcttcagggtacacaaattctccctccctttaaattcatcattctgacaggcatgcaacctatcaggtatttgaaaagatagtctcagatgattagtcactacctgtcttacccatttctcagtgatgaagatggtacaaagaagcgcaacctggagtccatgaaaatattctggcccagcatagagggagccttaccctgactacacacgggaagataattctgaaatggcctttctgcaagaaacagacaaaaattgtgaagtcttttgcttaattccatccaaagtgtgaaggggacttggtctttatgagacctaaggagatgatggactgagataaaggcagaaatgcaaagggagctggagaaaaaacttccctcttcaattcacctaaggggctgttctaaacctttatgtagccatagctctagtttcaccagctggtgacgtagacagtatgacacctaggcatccctgtgtttaacaactgtggtcctccacacactgtgttagcagggaatcttgtttcttcaaggtactccttcctcatatgaattcccagcagagacaacctctgtccaagcaattgtttttctttctttctttctctttctctttctttctttctttctttctttctttctttctttctttctttctttctttctttctttctttctttctttctttttctttctttctttctttccttctttctttctttctctttctttctttctttctttctttctttctttctttctttctttctttcttccttccttccttcctttctttctttctttctttttctttctttcttttctttctttcttttcttttcttttttttcttttcttttctttttcctttctctctctcttttttttttaagacagagtctcattctgtcgctaggttggagtgcagtgatgtgatctctgctcactgcaacctctgcatcccgtgttcaagtgattctcttgcctcagcctccagagtagctgggattataggcatgtgccaccaagcccagctaatttttgtgtttttcatagagacggggtttccccatgttgaccaggatggtctcaatctcttgaccttgtgatccccccgaccttggcctcccaaagtgctgggactacaggcgtgagccactgcgcccagctgcagttgctctttctgtaaggcactggttgtagaataaaccctggtattccccctggactaaaggactccttacttattatcaaagatgctggctgctccagagatgggcaccatcacccttgcttttgctgctgttgctgccactcaaaaaagtaggctcactgttgcttgacaaattccttctcatacaattggcttctaataacccaaagccccattggtaccactctccttcatgccatgttatctccctgtttcactccagtcctgcctccatgagccagggccattcacctctacccctagggctggtccaggcctcctcttgcctttgagtccagaacagacagaattttgtccctgagtggaggaagaagtccttatcactttatccaaacttgtatcttctaaaaaaatcagtcttcctcagggttaacctctttttcagttgaatgataatagcagcattaatttccttcaacgaaaacacctttctgaccataatatatggtctgatttcatgagcccaacagattagtgcaaaataatacagtaatggtacatattccaaagtctgagttattcagtcttatctatggttactttgcaaaattttaatcaatggttttttggaattaaaaagataaaaaataaaataaatacagggtgactgagctcagtgtctgcatcttggttattctccaatagcatgtctagaaagatatcctttctttaaggttgagtaagttaaaaataaacaaaatgataaataaacatgggttcaatgaaaaaaatgtgtctcccaaaggatgagaagcaatattctgtggagttggcagataagctttgatatgaaaaagatttgcttcaggagacaggggaaatagtttgtgatatttgcttcctgttttcaatatggcttaaaaaatacgagtagctgttaaagaagaagaaacttgtcatgagagcagaccaagtgtcaaaaagtttggtttaataagcatttataaagccgagctgttttcctattccttcactggtctttgttcagtcttatttgctggatctgctactcttttctgtgtttaaatatttgcatgtcctagggctcagtctaagaggcccttttctccatctgaactcaaacctgtgtgatcccatctgcttctgtgacttcaaatgtcatcaaatggtgttcactttcagcttggtatctctagcttgagcctctgctctgaactccagactcatctatccaactatatataatctgtctccactggatgtttagttatcctctcaagctttccatgtccagaaagaaagtgtttcctatccctgtgttaatgatcatttgcatggtttgttcttgtagaaatgtctgtttatatactttatccatttttaaattgggttatttggctttttctattgagttgtaatagttctattttttttgttgttattgttggagacaggttctcactctgttgcccaggctgaggtgcagtggagccatcatagctcactgtaacctcaaattcctgggctcaggcaatcctcctgcctcagactccccaaatgctgggactacagacgttagccaccatgccaggtctagttttaatagttctttatgtattctagacacgagtcttttatcatatatatgatgatagaatttggggacctgtctgttcacagataaagagaaaatagtagttttgatttctccaggaagttatgtataataggaagtgcaaggagcaaatgatgatgcccaaagtgaggcaaaaatttagggagtgagaagaaaggaaatcacagaaaaatcatcacagactttgttttcagagagggagaagaaagcacacccaaggaaactgaaaaaaaaaaagaatttcaagaaatgagtcatcaataccattagatatagtagagaggtgtggtaactggaaggttgaaaaatgtagataatcaattacaggccactagtgatcttcgtctgagcagttccagtggagtgtggggacagaggcaaggtttgatggactgaggagtgtatcggtggtgagacagtggatgtggaaaacagagaccaccctttcaaggagttcaaacaaaaagcaatagaaagaaattggaggttagctaaaagggagaaaagagttgcaaaagcttaagtatgcttagaaaatgagggcaaagagtccatgggaatggagatgttgggtaaataatagagataaattacttgtggagcaatgttctactgctgggtgtatgatcaattgcaaagaggaaggtgttggtcttaaattggaggagagaccctacttcccctaaaaggatagagagaaggtaaagatgctgaattagtcagcatttctgtttgttttaccaaaacccacagaaactcaattcagcaatggtagaaataactagttttcaccaatatcttgttctcttccactccaggctcatggaagaccacgctttctagtccacttgaagttcagcaggcatatgactcttctagctaatgacatatgaacaaaagaaataagagtggcttccaggcttagacaatgaaaagtccatgaggaatttttaaagtcttcttctccccatgatattgtgatagtggggcaagcctcaggtagagatggcgaagccataagaccaaggcagcttggagccctgagaaatcaaatggagggccttgattctgaattgccccttggaactgcagtgcactatgtgacagtgagaaataaccttctgttgctctaagccactgaaatatgagtgtctttacaacagcataattaagtttattctgactaaatcctaacctaaggaaaaaaattagactatattggcactcaagaaagagttgaatgacctagatacctagataagggtaagatagagattaaactgggtaactggaaccactaactcaaactgagtccaacaagatgatgtacaaatctttaacagggattccactgcaggaacgaccaatgagattttttatcattgccacacaatttgacccagaaggtttagaattgtaagtgcaagtgtgttggatgggccatccacaaaggttttgcagggtgacttcaggacagagataaaaggaagacttgagccagacacctgtgccttcagggaaaatgggagagtcactgggagttagtaagattatagataagaagaaataaagagtaatttcacgggatgacataaatcttaaagaatgaggtgcacaggtgaggaattaatggttcttgttgctctagaagaaggtagttctcaaccccagactctagagaatgtgagtgttagataaatgagaactgaaaggaaatggtacttcatttaagatttcatttgagacaagactatggaagacacaagagaatatatttgccatagaatgtagactgaaagggcaaaattgaaactagaaaaaagcaaccaactgaaaatatgctttggcgacagttcatgacatactcgacactgtacaaaattgcatccttgacaaagaagcagacttgagaaataattccagaacatgcagaaaatgaaaagccctgaatagaataaaagggatctaacctttgaataatagatgtttctaaataattcgtgctgtgagaagtaagcgagacaatatatgtaaaactcttagtgagtgctcaaaaaagagcagacacaattaatattttcataaaagaatgcatgacaaatgtgctgttctttatctgcacagaagcctataccagcccagcagtgttttgtactgaggcaggtgcaggtcaaggtgatgagagcaagtgtaaaccaacatggatcaaacatctcagataaaataaacaactaatgaggattctggacttctacctgaagttatagtaaatggaaccgaattccttctcaaatccttacgaataaaccatgataatattttctccatggtctttctgacctgtcttaataccttttctaagaaaagtgtaattttttaaggtgatgttaaaaaggcagccattagtgatttactatgttttaagtcatgcatttgaggactggagttaaaaattttgagaggggattttttttttcattgactttaactcacttgataattggtgggtggtgaatattttaagcaaaaatggttttatagtttttaatacataaagagatgttttctttttgaatatgaacaatgtttcaaaacagagtagaataaaaaaaatcttcatctaaaaaacatgccttgtttggagatgaaatgggtaggttcagtttggtaaaattaacaaaaacatctaagcccagaaaaacctttaataaaatattaaatttcagtgctggggcattatattcaatgatatgctatatccctgagtcaaggaataatttgaattctgaattttgaaagtgtccccccaacaggggcacatgtgcctctgacacggtggtgggtactgcactgcagaatctttaaggaagttacggacaaagggagcagaaacaaaatataccattaacagctgttcagctgatctctccaactcttccagccaactaagagactgaacaaagtgaaaacaattaacactctgtctacaaactcaggtttattggaaagtatacaaacaagctcaactggtggaagaataaaaaaataatgctctgttgtttcagatctcatagaaggcttggctaaaaatgtgcccatcaaaagtaaataagttgagagggtattctggaaccatagtgactgaatacagagtattgcccattcttttccaatccctacttctacacctttatcttagaagcttattatttagcttttcatttgcttttaatttatctgaaattaaacacacactcccactccccaccccccatccccatccacacacactagagatgaaatctgtgcttttacaacattgttagtctttggttccaatacctttattaatagtccattctttatccactgccacacctgtcattacagatgctttctgtaggtaggtctgtttctaggctttacgttctatttcattggtccagttttctctttatgcatcaacaccacattattttaattagtttgctttgatatttggtggggtaagtaccccttattcactgtcttttctttccatcttattcttttttaattttaagaaaatttctttctcattctttttacttcacttttccaaaattgatttatttttgctctttactctgcaaattttgtggggaaaaatgtttgaattgcattgaatttatagattaattctgaaagaattgccatctttacaataatgagtctttctatttatgaacatagtaaaactttccatttattgagtcttttgccttcaataaaaattttatcatttccttcatagtagatctttatatattctgattatgttttcaatacataaagaaatgtttcctttttgaatatgacctttattatgaaaaataaataagaaaagcccaacccaatgaaaaatgggcagaagctatgaagagacaattcttacaagtgagattctgtggcctgtaaacatatgagaatacactttactggtaatcaggagaatgcaaattaaatcaaaataccatttaattggcaaacactaagaagtttgagagtatcaaatgttggaaatgattttgaacctttaaactctactgatggacatatacattgatatatacactgatgaatataatttaatatggttgaaaatgttcatacattacttcccagtaattctatttcttcctctcaagtaactactgcacagtttgaaagatatttactattgggaaaaagctaaaacaactttaccatccttcataaaggaatagctaaactgtggtttatacaaggtaattctgttcagcagttgaaattaaaaaaaaaaaacagttctctattcaaagacatgttgtgatggataaaaacaggttgcaaaagtgagatacaatgtacgtagttttttaaaacacaaaataatagtatattttttaaatggatacacatataaatagtaaaaagaacaaaaatttaccaagcaatgataagcatcaattttagaacagtagttacctctgtggaggaaaaaattatgggagaaagaagaaagaaaagggctagggttttctgtaaaactcgtaggacagaagaaaactaaagcaaatatggtaataattaaattcagtcaaatatgggtatggtgtacaggtgtcaatattttctggaattttctctatgtttgactatttcataattcattaaagtcttagatttggtgctgatgtaataatagatatttagatgcagtaacacaacagagttctctcttttatatataaacacaaaataattttgagtttttaaataactatagcattttaaataactacagctgcatttctagaaatgcagctatggtataaatcaaggagaggctgaactttgatttattagaactttaccaataattttttttattttggaataccattcatgatggcaatgatgctcgtggtgtttgaattacaatataaaacacctctatcagttcgaatatgtagctgttcaaattctacacatgggcttaagcaaataatatttcattatatcatttaggataatctttcctaaatattaacatattgaatttcacactacatcactgtagtttatttatattatttgtaaccatcataaatttgcctctacatgttaggcagggcattgtatttatttttaaaagattatgtgtagatgatactctctatggcttacactgcagcataggaagtgtctggaagggttgggaagcacttatctgtgttggtcctcccgtttagtaccagtctctttccacacaaaggcttttcaagaaatcaagaccatcaggacaggaaggggtctccatcttctctgctgaaattcttatcttatctgtcctgttcatcccattctcagtgcacacaaaccagtgtttcttttgcccacagatgaaatctgaaaattccctcttctttatcatgcagagaaaatttaattttttatctctctcatttactataattctagactagttctggagaccctcttgcataaattaaaaggttcatgaaggaacttctcccattaaaagtcactttaccccagaaacaatgtactctgcccacttagaatgaaaactgctacaaattttatagggtatagtttatagaaatgtaaagaaaactttttagagaaacagactgtatgtctgcatggaaggactccatactgtaagaatgtcaattcttcctaaattgatatgtacaccaaaataaaatccagacgaatcaaattttaaacatttttttaacatttataaaaactagattataattaatcaagattgttatgcaacttctgaaaggagtaggacattctggtacaaaggaaaaggcaagggaaaacttgacaatcgaaagtcaacatcactgtgtttaggaaaaatcaaactggttacaacgtttatagcaattatgatagcataagcttatatcttgatgaagagctcataaaagtgcaaacaaagccgaacgatttcacctaataaagagacaatgaactaaatttggacaattaactaaaaaagaaataccattagttaataattacagagaaagtgtctaaactctaataatcaaatgaattcggattttaaaaaataagaatttttgcaagaatttctctttaagtgtgtaatatactgcttagtgaggtaattagtcttatgcatcacagagagagataaaaatataacttttggtagttattaataaagactcttaacatagttcaaatgtttcagcttaataattctattttgggggaatttattccaaggaaataatcctaaaatttacatacaaaattattaattgtagcattaattttaagatcaaaattttggaaaaaatcagcacagtagggtaaacttactctaaggagtatgtagttattttaaattatgtttaaaatgactatataattacatggaaatgcttataagagtaatataaaagcattgttggtcagtaaaaatattaacgtgtctaacttcattggtaattagggaaaccattcaaatgcaatgagatatcactctgcaaccaagaaattggctaaaattaaatagacggaaaataccaatgttgataaggatgtaatacaatgagaaaccctcacccatggcttatcggagtgtaagctggtacaactgcttatttgacagtacttaatgaagttgaagatatgcatacccagtgacccagcaattccactcatagatgtagagcccagagaaatccctgcacgtgagcaccagagtacaagaatgtgcaagaatgcccatggcatcagtgcttgggatagcctgacacgggcaatgcccatctacagttgaatggataaattgtggattactcgtgctaaaagacagacataataaaatgaacaaatgagaactaaacagcacaagacagattattttcaccaatacaatattgagtgaaagaagcaagtcaaaagaatttgtgtttatgattccatttattcaaagttcaaaaattggaaaatggaaggattttctggggctaagagtgtctaatttcttgaccaaggatgtgattagaaggtgatggctttacaataattaaaaaaaactgtacatatatattttatatactatgtaacgtatgttatgtgttatgggtcgaattgtgcgccaccccccaaaacacacacacacaaagatacgttcaagttccaacctccaatacctcagcacgtgaatttatttggaaataaggttgctgcagatgtaattacttaagttatgttaaaatcatactagagtaaggttgttccctattgcagtatgactggtgttcttataagatgaccatgtggagacacaaatgagacagccaagtataatcgggtccccagagaccctctaaccagcctgtgcactgggagaatgggatggagctatggaagttcctgccgtttgcagtggggagcagcctggcctctccttttcctgggtggtaacctgggatccagtctgtaagatgggggcctgttaacaggaacccctcttactttgctgagagtctttttcctttttgccaaataaattctgtaaccactcacccttcaaagtgtctgcgtgcctaaattaacctggtcatgtgacaagaacccagattttcctgcaacacagagacacagagaaaatgccatgtgaaggtgaaggcagagactagagtgataggtctacaagccaagaacttccagccatcaccagaaggtaggagagaggtctgaggcagattctcctccaaagtctctggaagaaaccaaccctagacactttaattttggacttccagtctccagaggtgtgggagaataaatttcagttgttttaagctacccagtgtgtggtattttgttagggcagctcttggaaactaatacattgtattttcacattaaaaatatatttcaaagttcccaggagttgatgtttctggtctctaatttattgaataaatcacaaaatctaaaataaaaaagtagccaaataattgtactttatatatttcctggaaaagttacactggcgacacaattcaagtataaaaataaggaactcctattcagaaaaggaaaccatgtagcatatctagttgcaccaacaggtcaaagatcaatcgtaaatgtccaagtacattaaaaaaggatgtggtttgttccaagttggcctgtaagaatttcatcctgaccctttgattctcttccttactggaaattctccagcatctgaagtgaccctgcacatggcttctgggaagacattctcattcgttccatttcactccagagcaaagacgagctgacctgaaataagacctgacccagaacttctctagggcagaatactgataaacacagatggcttcatgaaagaccatctttggttacaattctgccttctacaagttaggaatacagtctcagagtttacagagcaatgtactcttgggtaccttccttggggactgagtttgtataggatattgagcatgcttgtaggagttttggctttctcaaatatgttccatatgatcaggagatgccataaataagggcataaaggaacaatacatggtaaacggattttttttaaagctaacaaaatgcaatgttatctttctagtactttctggttttcatatagtaaaagagagtaaactacagaaaaattttccttcagaaaagtaatatgaggtggaatagaacagtgataaggaatttcgaagccagtctgtctgttttcaaaccttggttcaacaatgaggaaggggtccccagtgggagagagccccaggtggggaagaacaatgaacagttgttctgagaaatgggaaatcacaagcaatgacttcttcctggcacaatgaccttgttctgtgcgcacaatgacctccttcagcacagcagctccccccagcacaactctataaaacttcgctccagttgcaccctgcctctacacagccccttctctgctgtgctgccggttgcaactttgcaacgcattttcatacatactttctctaataaatctgcctttctttacctacaactgtcttggtaaattactttaccacctgtgacaccggccccagctagttgcactcgtgacaactagctggttgtacttttggccaattattaacctctctgagtacaaatttcttcatccataaaattaggattaaaaactgcacccactgcaaaggattacttggaaggttcaatgaggcaatatatgaaaagcatttagcccagaatgtttcacatggttaagtgcttaataaatactagttactagcataataataacaataataataataagtctgtacagactaatacttgaagtagctataaaaaattccagcagcgctgatattagagttggccccctaagggtcatttggttcacctcattaaattaggcagagaaggaaaatttcagcttcttgagttgaccactctcacatttaacatttctaattagaaaaacaaaattcacttaagttttctagtctgttaaataaatgggttggattaagtaattctaaggagctttccaagtacaaaaaattcctatttctaacatcctttgtcaaccataaataaaacattttgcagtctctgaatcattttctctctttcaatgagtatttctactataccagcttctgccccttttgatgaaaaatataacctttaggctagtttggtgactaaagtcgtgtgtgtgtgtgcatgtgtatgtgtgtgtgtgcatgcacaggcatatgtggtggtggtggtgctgcgttccaagaaagcctcacagacttgggcagccctaatactgcaatttcagtcaaagggatgggaagtttccataccactaaagtttacttgcatcaaacttttaggtttatctgctatgaaagagaagaaaagtattattttgtggaatattctaaacagttgatttttaaagagtcaagtgttgtgacataacatttgtttttaatgatattagcaaatatcattgttatgttgattaagaagatttagttgtagaaatctcttggtatttccaaatccacctgggagtaagaagtgaaattcagcaacgctccagcattctggcacaaatccttccttctcctcccctgggtacctttgctggttgtccaggagatggcactgttgcttcaagggaatggcttccacgaggcccaggaagagagcctgggggcaaaggggttgagggttggggataatatacggcagtcagaagttaaaagagaagcagtgagaaaagtcttgtttaatgaaccttaggaataatgacaaaacatgtttaaataattgtcttcctcaatttccctttataggggcgaatgtgaacatgaagaccaacaaccaagatgaggagacgcccttgcacacggctgcccacttcggcctttcggagctggtggccttctacgtggaacacggggccatagtggacagcgtgaatgcccacatggagacccccctggccatcgccgcctactgggccctccgctttaaggagcaggagtacagcacggagcaccacctggtctgccgcatgctgcttgactacaaagccgaagtcaatgcccgagatgacgactttaaatctcccctccacaaggcagcctggaactgtgaccacgtgctcatgcacatgatgctggaagctggcgccgaagccaatctcatggatatcaacggctgtgctgccatccagtacgtgctgaaggtcacctccgtgcgccctgctgcccagcctgagatctgctaccagctcctgttgaaccatggggctgcccgaatataccctccacagttccataaggtgaggctctgcccagtggtcagcaggttgaggaagattcaaatggcagccttgtctgaaatctccaagtaactcaagcttgcttgaggcttgagtcctgggctaactacctctgatcctctttgaccttccattacatacctaatcctagctgtctcctcatctcatcctagtctaggtttgcttgaaattgggtgtgagagctagaatgagaaaaagagtagcaaataatttgttttgccttgtgtgaacaccagtgcactggtggcttcctgagggactgaggtaagtctgccagaaaggtgaatagtgttagacaggcatacatttgccatcttttaaacagaatgactgatctaaagatgactcagcctgctttgaaattagcttgtagccatgaaagggccacccgattttccagtttaatgaaagctaacgtttattaagtactaaaattatatttattatgtataataaataagcacactgttataagcattttgtatgtcttcatttaattcttacaacaatcatacgaggtatatattattattgtccctatttgacagaggaggaaactgaggcacagttaagtagcttacctgagctcccacagtgccagtgccaggattcaaccttagatactttggttccagcatctactcttatgatatcacactgcacggtttttcttaacaacattcataatctcaaacaggctggtagggaccagttgctaccagtattgatatgactaagacatgggacgtatcctcaagaagcttagaatctagcagatgagacaagcaaataaaggggtaattttaatatgctgtggtaaatgacaaggtagaagaataatgagtgctacagaaatatggaagagagtgaattttgcatagttttatagctagtaattaatttggaggccaaaatgcattttacctgaaaataaatcaaataatactatacttaggtttcccccttgctctaaaaatttaattaacaacaagaagagtttgaagtatacaacaactgactaattaggccacagaaagcaaagtaacagatgtttttctgaattcacagcttaagttctacgtcttacctgggtaaaatgtcagggacttgtctgaagtcctgcagtgtgaggcttagttagaagaaaagttctactagagaatttaagggtagtgccttcagtcagggcagattccagatggacaaaccagagaactttcaaatgaagatttgatgggttcagcaatcctgtgatctcaataggaattttctcttggttatcaggatgctaatggaagattaactaattcttttttaaaaaattatatgtaaagcccagaatgtcatgaattttccaaaagttttttagggaactacaaatgattaagatgaggaatagaataagaataatgttacagtaactgtcctgtgttgagctctaaataggttttatacagactatttcattttatttttataatggactctgaggtgggcactggcattactcacatttaaaaggtgactaagctaaagctaatagtgttaatatattttcataaagtcacacagagtaagtgtcaagttcactcatttgtttatttaacaaatatttacttaacacctccgaagtgtcaggtactgttctatttgctggaggtagagcaatgaaccaaaggccttcatgaaagatactttctagtgggagacaggaaacaaacaaaacaacaaccaaataaatatactctgatatgttaggtgctatggagaaaaagcagggcaaaaaaaaaaaaaaagagaatgccagattatgtgtgctactttaagttgattagaaaaaataaggatgtggggggctgggtgcagtggctcacccctgtaatcctagcactttgggaggctgaggcgggcggattgcttgagttcaggagttcaaggacagacagcctgggcaacacggtgaaaccctgtctctaataaaatacaaaaaattagctgggtgttgtggcgtgcgcctgtagtcccagctacttgggaggctgaggcaggagaatggcttgaacccgggaggcagaggttgcagtgagccgagattgtgccactgcacttcaccctgggtgacagagcgagactctgtctccaaaagaaaaaataaggatgtggaggaacaagccatgcaaatacctgatggggaggtggggagagcattccaggcctaaggaaaagcaggtgcaagggtcctgaggtaggagagggctaagcatgtttgagggagagcaaggaagcctcagtggctgaagtggagtgagcaaggggaagataaatccaagaggtatatatgtgggttgtttgcagaccatatatgtcgccttgtaagctgtgggaatgttcttggtgttatactctgcatgggagaggaagtcactgaaagattttgagttgagaaaaataaaagtctgatttatattctaaaatggtccttttgactgcctttcagagaataactctgagtggggggctggcaaatttgcaataatttagatgagagatgagggtaacttagattcacagtggaatagtgaaggtggtgagaatcatggactttggggtcaaacttggattctgtcacttacttaagagtgtgattaaataaactgctgaaagtttctgggcctcagtttcttcccctgttgaatgagtataccctgaatttatgccttggcaatgcgatgcagactcagtccttccccagaaggaagttattcctactcatagcacatcacaaatatgctcaaagctcagaggatggtgccaaacatttctttcctctttctcttggacttctttcagtcacagcagagtctctttcccagttcctcccttcagtcctatcctacatctatacacatctctctctttgtttacttccatctttttttcttacctacatcttgctaagggctggtcattcttcatgacgttagctctagaagacaaaaacatctacctctgtaatacagctcacttcacaaagcataattttctgcatattgtcgttcaaagactactttccctccagcgaaaaggatggacagggacacagggcatgaaggtgccagagaaacatactctatcactttatccatgaatagtaatagccttcttgtaaggctgttttgataattaaatgagatagcatttgagaagtggttagcacggtgccatgggcatggtaaccattaaacaaatgatggctatgactattactattcttaaacatgtgttgagcaggagaattggtgctcctgggcctgctttactatagcagtcttcccatccaggagagacagtatgtgtgtgagtccctgcccagagactaaatgttgacttgtattctgaaacttgctgtggaatctagtagtggcattcaaccctagtgttcacttttctcctcctctcaacatgtgctcttggtccagcataagcatctcccctgctggcttttcttggtagctccaccagcctgtaaagtaggcatacaattttgtgttccaaccaactttgtccatggttagcattttcttattcagttgttttgctcctttgagttcctttagtttggctgtatgctaaagacatttaggatagagttggctactggtagatggctggtattacaaacatttttgttgctactcaacagactgtgtaggagagctggcccccctccaaaggaaaagtaaagaaaaactattcaatttactatgcagatgcttcaaagtgatttagaacaactactccacagcccgactttccaaagagaaagtcatctttacgacaagtaagtgactgactcatttatccagaagataaagtgattcgttcttgtgtggatggggaattcagtttccttatttacaaggaacaaggtcagagctgaagatgttttcttccaaatacaaagccaatttgtagagggtgtatttcactgaaagccaatgtgtaaattacataagcgggggaaaaaagaattatagggtctgcaattgctttccagggtacaaaaggacatttgatttttttttctcccagcgtaattcagaagaaagtgacaccccagggagccaagattgggttttcttgtagggcaagaaagacatttttctagaggaggaaaaggtaacacgagggtctgggagaggtaaggatgatttctgccattgaacaatgctgtatatgaaggtaggcagttctctttgatcattaagtacctttctgaacacatatatatcaatataaaagagtggaagtagcttgagaatgtttctgctgaagtggcttacagatgatgtttggatgagaagagaggcagggagacttaccttgaatctcttttttaagagattgtgtattaatccatgcttttgggggttggatggtgagatgaggtgtctaaatctctcttcagtagtcaccacagtagaaataacttttttgtctaattgttcctccatgaagggagaataagagatgccagagactcatcaaggtgagcttactgaacatcttctgttttctgggctggcaaggtcaaaaggaggctgtggtttctccctttggggtccacatcagtctgctgtctcatgtttcctttgtcttatgttttcatgaggaaaatgctgctaaaataaaactcccactaatctctgtccctaaccttctcacttcacttaacagattgatgagttgggaggaggaattgacttagcttgctcaaccttgggtctagaggatccttgaattctttgttcatttatgtggcaggcttccagtaataaactctgtctgccagggagaggcctgcaattttagggtataaattcagtttgggggtagaatgttagaagctgtgtatggccccctaactaaacatatgtaatctattttatcagtagtaaagatgatattctgatctctgattgtcatcttcatttcattttttaataggtcctacactaaaaagggaaaattacttattgggcttctaacactcttcgtgctgtgacaccaagggtcttaaagatgaggacagggcagccctagctacaacttttcgtttatcctttatttatcccccacaatctgttccttacctgtttcagtccacccaactcccagtgacttgaccttctaattcaatctgctggtatttaatctgtcttcatctcttgatcttcatgacccccttgataatctcactttgaatgctttcttcatttggtatctttcactctgacatgtctggtgtttttttgactttggagtcatgcagacttgagtttaaatcctgactctaccatttcctagctaaaagacccagaggttaaattttctcagcctttggtcttaaatctctgaaatggggatgaatataggaccaacctcataggattgttcaacggctgagcaagttaaagtatatgaagatttaacacagtcccttgcacatagtaagtcctcgaaaaatggtagctattattttcccttcttcctctctcgtgcctattaggatttctgaagctgtaggtaatgatcctctatcttttccatttatacccatttagactgtcactgaacttcatggcttctgccagcacatactttgatgacacataataactccatcttagctttctaatggggagcatctattgtgtacattttttgctgacatgaatggctgggcgcggtggcttacacctgtaatcccagcactttcagatgcctaggcgggcggattactggaggtcataaattcaacaccagccttaccaacatggtgaaacctcgtctctgctaaaaatgcaaaaattagtcaggagttgtggcatgatttgtaatcccagctacttgggaggtgaggcaggagaatcgcttgaacccaggaggtggaggttgcagtgagctgagattgcaccattgcactccagcctgggctaaaaacgtaaaactccattaaaaaaaaaaaagatgaactatcctcctcctcattatctgtccatcccagattagtatgttccttatttctgtcaatcagtggcaactcttgtttgtcctctatctctggcttccaagttgtattctttcttcctcctatctgattagtattaagccctatacttgtttcttctcccagcttcagccacccctccttcccagcactagccctgacaccagcctgggagccggttggtgcacttcccattagcctcccctccactctctgccctcgatgcacttgtcttctcctctgtgggttgctgatggtgctcaaggatcacctgatgatctttatgttagtcttttattatttactgacttatattgctctctaactctttgaaattatttgtgtcttttctcttcaactaggttgtaaactgcttaaagacaaaaaacaggtcataaatctcccagaattactgtcatagtactaaacccagtgctcaataaaggcttcttaatggaatggataggttgaatatcatcccttctcgttaagagtgtataatagcctcttcttgcctgtcaagtcaatcccaagctcttcaggctgacttccagatgtgctgccagctggcttcatcttaccagctctgacctttagccctgccctgactccatccaggttggcctctttactgtcaacacacacagacacactcactcacacacacacacatgcacatgcacacacatgcgcacactcttacttagttggatattaagatcataacctttctgtctctgttttatctgtgatcccaagacattaggtctttaccaccctacactgaaaaaggcaatgctagaccacctatgaggaaggttgtcgagcaacacatttccctatggagagaaagtcggttttgtgatcttttgctcaacagtaataggttgaggttgatacggtctgggaaattaggaagaaatgtctttggagaaagttgtttaagtgcagaggcatgcctctcttctaatgcctcacctaacaccaagtgaaaggggctttaggaggaccccctcagaaaggttgatttatgttctccgaagtttcatgggaaaaatggaactgatacgaaactcatgatgaacaaatttagaagagcagatctgtggctggagctgcttgttgggtggcaatggaaagaaagatgattaaactgggagtcaggaatgccttttactggccacaccaaaagttggttaagtgtataaacatccatgtagtttaatctaaatgttaaagctaaatctttctatctcctgaaggagattctggccatcttgactaagctttcaagtatttttggttggttaataaactattaaacagagtgtgctaagagctaactgaatttcatgtcatctttcatttgttaatgaaaggtaaaataccaataagtgtggtttagtacatgacaccagccctctgcaggcattggactgggaagataacttggctcaacttgcatgttactctgtagtttactttacctcgtggtcaccagtgaatctaagttgattgactaacattgaattttttgataaaatgttctgtagagctggaagagtttcccaggcagctgggaatgtattctgtgtccagtctgtctctaaattgcttcaattatgtacaaaggcaaagtaattcttcaattctcatcttctttgttagtgcctctttttcacttgctcgtggaaggtgaaagaaattggtttgattttattaatctatctatttgccatggtggcagtgtactggaatactcaaaggcgtgagacttctgaaaatcgttttagcattccagggagcttaataggtctgtgggttctggttttttttttacagatagggtcttgatgtgttgcccaagatagctttgaactcttgggctcaagcaatcctcctgcctcagtctcccaagtagctgggattacaggcacatgctaccatgcccactggtctgtgaattcttgatgtctctgtgagcagaatgaatgaaccatatatgtgcatcaaacagatgaaactctgtgcttcctctgcaggtgatacaggcctgccattcttgtcctaaagcaattgaagttgtagtcaatgcctatgaacacatcagatggaacacaaagtggagaagagctatccccgatgatgacttggaggtaaataatcgattcccttctaatagttttcactatcaagtacttccagactgctctagaagtacagaaaattgtaacaaaaaagttggttttgagaatgcctttaaagcgtactcaaatgcaatgagacaaagggttataaaatgcaggtttgagagttaatatttccatcaaatatgtggcattaaggagtgtcttggggaattcctccatttaagggcaagttgaattaagtatataaaggtggcagttttcctttcttctcattaatttagatgagttaaatgataacatttggaattgcttatatagcatttttaccagaatattaaagcgttttgtgtagattatttcatttacttttaaatatcatgaagtgactattaggcaggaaagagttttaaaaaccctgtcttgggtcctacagaaaaccattggcagagtcaagttctcacttgcagactttcagactttgctaccaatgtataccagtccttcccactgaacacccttggttcttggttttagatgtcaaagtctgtctgtaacacatggagaggtatcaggcacagggtgcaaagttcactgggcttggaggtctgtggcttaggtgtaatcttattctgctacttattggctgtgttacttttaaaagtcacctaacttgagtgagctgcattaatccttcacttccattaaatatctgaatatatgcatcacaccaagcacataatgtgtttaaaattgctattttggtttagattcatccaggcacttcacacttgcatattttatcttatctcctgggttctgaattgtagaatgttatttcccctcccctttccttgtataccaccgcctcactgctcccatttcaatattgcgtttaatttttgcctcaccaatagagaccctaggaagctgccattacgtatagaggttagttgcagcattgctgatttttattgatgtaaactgtggggccttgctaactttaatttgtcttgccttccttttcagaaatactgggatttttaccactctctctttactgtgtgctgtaactctccaaggactctcatgcacttatcgagatgtgccattagaagaacattacacaacagatgccatagagcaattcctttgctttccctcccattgtcattgaaaaagtacttgcttttagagccagagggaattatttattaagccttatgagacagcagttcccaatcctaggtatttaagtggacttgctgggtagacacagtttgcctaaataaaatggtacttgggttgattataacacttcagggatttcaaaacactttacaaacactgccattaatcctagaatatcatggtatggggaaataaagaagaagtaaagttaaggaattttcaaagacaaggatgtattcagaatgtactgatagaacagtaataactaatatgtatagtgttcttactaagtacctgaaatatttttgtaaaacttcttatatcttatctcatctgaaatgggacccaggttttcttccaaccaatataattctgtgccttatcagtaatatgtttacattctcattcaaatggccatatagcaggctttgcaattggcctcttaaacttggtgttttcccccattaccccttagcagtaattactgtcactagttttgcaaactcctactccccaaaccaagctactcaagtttatttcagtgatgaaggcatatgagcatagtcaaaacaaggagatcttggagtcaaattagaaatgagaaagaaacatcagtccagttaatagtcaagaatggacatttgaaccagacatcactgagccagagactggagatgcaaagatgagtcccatgtgactcctgccttccaggatctcaccatttagcagaggatccagacatacacacagctaactgcaatataaagtgatggggcaagagtacaggtgcagactcacttttaatgcttatctttcaaagttgtgtttctgacatgaagtgtgatttttcttttaagcatgaagttaaagagtgaaggggttatgtaaagtagagggatctcctgctcttgttagggtatttttaaggttttttctagatagtgtgtctttttggtatggtttcttggttagtattaatactttcccagactccttgagaaaaatattgcacactcaatggctccagtgcatgtgacaaggaagcataggaaaatgggggaaagaaagtgtgtgaggggacctagttgattacttcggtctttttatgtagcagactgacatttcatagcattgtagctaagagataaggagcactttgctagtgacagtgggctacgaaaagtaaatagagagactttttgaaaatggtaaaagtttgagaaacttgggaagattagtgtgttaatcaggcttgctagttagtggattgcagaaagaaaaatgtaggtgattaagctctgggccttgtggtttatgaggtcaattttgcttcacttttttttttgttcttgctaatcacttttagataagctcattgctcttagcatcattttttagaggttaaagcagaagtaaattgcaaacaaatctgtcagttgtgagcagatttcttttatgtgtgtggttctccatcatatttaactttggatgctggagtgttgaatagagatgatgtcagatattccaataggctatcatttaatgttaactggcaatcacctaactggttaatctcagttgagactgtgcttctgaactgggattgtcttactcccagggctgtgtaagaaaagtcataggtggatacaataatctcttttaagtatcagttttactcagatattttggtggagatattttgtactaaaacaagatctatatcatggaatagaatgctgaatttgtatgaattattcacataaagcttgatctttcaaaaaatagtttgcttgcagcaagtggtattagaacacatcctaaaacagaatgaaatgatgtcttttgcagcaacttggatggagctggaggccattattctaagtgaagtaactcaggaatggaaagtgaaataccatatgttctcacttataagtgggagctaagcaatgaggatgcaaagacatccagagtgatataatggactatggggacttgcaaggggaagcttgagagtggggtgagggata

SEQ ID NO: 16603 - DNA, 232547 bp, Human
gcaatgtcttttcatgttttcttctttaggtgcttcaagaaagacccacttcaggcaggaaaacattcttttctgacccagggaggttttaaaataataccttgaatgtcttactttgaaactttgaggattttccctcatttggtgattttgtttctgatatatggtatgtgctttccccatttctgtgtaagaagggagcaaggtttgtcacttgtgcaaagctcagcctgggcccagcctggactctcttgcattctgtgtcccagagctcccagtgaaacaggcccatgtggttcaggcctgcgtggagcctgggctccagtcacggtcacttagaacacagagacagccagcgaggcttgtcctctaaccagcgtttgtttgtttatttgcttgtacctactttgagcacatcttagatctcatctcaattgtgttagtaactcatagacaagaagaatttttgttttcctacagtgtttgggaaattgtatgtgaaaattcctaactgtgccatgcattttctcactttattcctattaataataatttaaagaaaaagaaataaggctgtgccatccgctagtaacaattaaggacaataatatgcatagaatatacttctgttgctcctagagagctagggaatgcaagattttggctaaatgggtagtataccttttttttctttttctcccacagagacgcatgcactccatgcctggaaatttttagaaatagaatatgtccaatactaataacataataactatatactaaaaacaatgttccagaagctgttttaaaatacatatgtttgtaaattatgtacatatgactacataatatatatgtggcatatgcattatgtgtatgtggtacatagacattacccataacaattagaaagtacctctgtctccgttttacagatgaggaagctgaggcacagagagattagtgacttgttcaagatgagacacacgctggtaaatggtggggctaggggttatgtatttaatcaccaggtgatactactatacctccacgactggatgtttcctgggtgtctcaggaggcacttcgatttttgcagtaactcaagaactcaccagtaagaaccttagttaggagttcgagttggtaggaaaacaacggaccaagactcataacctttcttctacaatttacgagttgtatatacttgggcacatctcttaacggaatctcactatcctcatctgtaaaatggagattataacatctatccacatacttcatagaggtgtcataaaggcacgtaacataatgaatctaaagacccctgaaaacccttgaagtgctacataaatattcagaaatggtttcttacatggtcatggttaggtctggaatgctgtgctaaggctttatcactctgagcccagtgccccctttcactcatctgtgctatatcaatgtgtctttcaagcaaattcacatgctaatctgtgttagttcctattctgcagaaatgagaagtgttaaactcattctttaaatataatcccctcactgctatgatagagaatgtgttacaccattaaagaacccacctctctttttttttttcaaatttaagaagcattactttccttttctccttctttcctaagagactagaatcctgtattgcaaatggaagttccctcaataaattttaactgagtagaatctgggatgctcagaatggaagaggtctcttgtaagctggaccaagactttacagataggaaagctgagggtcttatctgacatcacccagcctattagggccaacgtgggccaagagcccacgtgtcctgacttccagcccagagccagttctgcttcatgaccctgccccttgcactcagaagctgagggtatttgtggtttgtttgttttagtgctttcttttattactgatagctcttctgcaaggaatgcctcccctctctaagcatttattctttgttacttacagaagaagactgcataaactgggcgtgtcaaaggtcacccaagtggatttcctgccaagggaagtagtgtcctactcaaaggagacccagactcctcttgccacgcatcagtctgaaggtaaactatgtctttggcttactttccatattatctctggagaaatcgctgggaagtaacatctttcttgttgatttcctcttaccataagagctcttcatgggatacaaacataatgacactgaaagccaaagcctcttctgagtttgaaagctatggagagggaactcggtgatactcttccaagtgacctggcaactttaaattagataaactaaagaggtttatctcactacatcgaaatcatgtgaggagaacaaaaatcatcaaagaacaatgtaatagaaacagtgctgaattttatcaataagaatacattaagcatacattaagaatcttaagcatacattaagattcatcatttacatggcttagcaaactatagcccaccacctgttcctagaaataaggtgttgttggaatacagctatatccaaccattgacttctgtggttactttcttgctgcagtggcagggttgagtagttgtgaaagagaccttatggctcacaaagcctaaaatctttattataacctggccctttacagaaaacctttgctgaccactgatttggtttgccaattgaggtaacaacacacgagagtttctgaccacaatttaaaagtattttcccatgcaaactccacataggtgaatggaaattgaactccataccttctttgtgtatgccagaaaaatatcaagtgaaaaagtcacatacgggtatcagagaatcataaaaatacactcatgagagaagtcgaagttgataaatacttcctagaattcaaaactttatcaaagcaagattatgcaaaagcagaagagggagatgtattttgaaaatagggtaagtgaaagtttcattgttagaggctaacgttgttatagcaaagcaaatactctttttactttatgttattttattcttcggtgggtgaagaggatgttggaattctgggttccttgttgctatgtagtaagtatggacaaaagccatgaaatgcaaaaatgattagcatttcccccttagtgatttaccggaaatataaaaatcagtgcatttttgtttatgcaagctacaggttttcagttttggttctaaataaataacgccaaaagcaaagtgaatcagattccttgaagtccggggtgccgttaggcattctgaaaatcttgcctatacaagctgttgtggggacagttcttcagtagcagggcctccatttctcaagccccagtgaaatgaattttagaagcaaacaagtagcaccctctgctggtgagcttttaaaccaaccaacccaacaaatgagacctgtatattaacgtggctgaaaatacagttagcgagggggaaagaaagaaaagaaaaagaaaatacaaaattagaaaagcctgtgagagttcacctagtctatccttgggcctccagacaagaacaggaagatcgttaaaaaacatcctcaccacccaaccaaaacatttgtttgacttaatttgctgccagaggtatttgcagagctgtagctggaggcatgtttatttagcccaaaacttgacccatagcataaagttatacaactgaaataggagaaggagtgaattattttttaaaatgtgtacttaagatattggaagtggtaaagaaatatttacaagggaagataaattaaggatgaaaaggcatcagctctaaagttttaaactggagcacatcaaaaggaaaaggctgtacattccattttattactgcaaggagagcttgggagccctcattatgctgtggtccaagcagcaggaaagggggaatttatttctcagctattggcagaagttctttctgttttgttcacaagatccatcaagcttttttgtggtgaagggcatttacatggttcagattacaatacagaacccaaagctagctaccatagttcttgacatttaagcaatcctggatggatttggacagaaaaacctttcaatttgggttcagcaaactgcccctcaccacaggcgatgatgccttgacccttggctgccggcagtcacccggctgcccggccatcgagggtgctggtgctcactttcacctgctgtggggaggtggttggcaggagagctgcgtggagcagtggacagttggcactgaggttctaccatgcggcagatgtgggttggctccactgtggggtttgagccatggcaatgttttcatgaaaactgcgcctttcagcggcaggaaacaactacggaattttatgacacaatgaggctcttgggtggctaacatttgaagctctggcatatataacatccactttggcttgctgttgcccacaatgtaagaaggcatgctgattattttttgtcattgtttgactgtggacagtttaatgataatcaaactaatgatctcagagcattgatttgttctgcctctaatggattctagtgcattcaagttcttacacattcccattttacttttgaaaatgaaggggaaggcactttggatttgcccaagcttaagcatcctttctgtactgtgcaccgtaatgaacattctcatcatagtaagtattaatttttgatcataatgatctgttatgagaaacactccagacagtgatataaataagcaagatttaagtataaattctccatgaatactgttctttcaacaaggttagaccttccttctctgcagggaaagaaggccaagaatggccaacactgacttggagaaggatacctttgccccaatatatttgaaacacataattttattcccaagtagcaagaaaggaaaacgaaattatggtcccctccaaggctgcctctctgttgcctattatgaacccatttctgtaccaaccatgaggtcctgggcttagggagccagtcttttgcatctttattatagtgagtgagtgcatggcttatcctgagtacccaagaaatgctgttgaacgacaaagataatgccagacatctctagaaacaccaagttcactatgttccccctgggggaatgagaatttcttaatctgctggaaagatgcaagccacactggaggaaggaggaggaaatttctacaacctggtacataatcatagtttgttttgatagtcacctggtatcttgtggtcaaggtttaatctctactcaggcccagtagcaaaccaagacatctctctcaaagggagagtaatgcaataaagaggccacattattattctaaaatctaagcacttcttctgagactcacctcttagggacatttgtttgatttgccatagacacttggggcaccattgggtcagctggaccataatttccaagtagtatagccatttgaaagaaaaactttcaaaccactgggtaaatggattgaataaataggtgcaaatgttgaacatgttgcctgcaaaacccagaatgacccactaagcatttcgactcttaatattagagaattaaggtattcacatatactttggagtttaccagatgactagaccaatagagactttcttaaggtagcgagtacttatgttttcaaagatttttcctccatcctctggcctacataatgtcttaactaggtcttaaagataccagctacagcttcctctccaggtcctgctgacatgatgctccatgttgaaggtgagattgacaagggctacagatagagaactggctcagccctgaggtaggatgatgaagatgcaaagagaaaggctgcaggtctttggctgtcaagcaaggcttagtgtagaacatggtttggaggtactcccaggcctccgtattcttacctacattcaatttcccattatttcctgatcattgctgtcactttcacataagtcacctggtgacactagcaattccacagaccttattcagaaacccacagaatttaaactttgcatttgactttgacatttttgtagatacttatcacaagcagagaaagtccatgggtctatgcctagatctaaaatatagagacttcaacctgtcatctatttcttacagctgtccagtcccattagaagtatccacctcatcctagtgtctttaaattcttcatgccactcacactattcaatagcagtgaaaatttgatcccctaaatccttcttttcaacggacacttcattaaagatcaccatagaagaaaaattatgtagctatttgttacagctgacagattcccattcctgaactcttactgaatttttattttctttagcatcagctatggcagataaccaacatcagcttcccacgtgactatctcctgatggtagtttctgtaccagactgagtttgtggttgctgacaatagaaactaactctaattaagtttaaacagaaaaaaaggtttgttgagaagatatgagatacttgatagaattgacaaaagaaaaaaaagccagagcattaggtttgaaataaaaagtaaattaggtagctgctatcgactggattgtgtatccccacaattcatatattgaaggcttaacccctaatacgactatgtttgtaaatagggtttttaggaggtaattaaggttaaatgaagtcataagggtaggatctctaattggtggccttattagaaaaagaagagagagagagagagagatctttctccctgtgtgtgtgttcaccgaggaaaggccatgtgaggacacagcaagaaggcagctgtctgcgagccagaaagagagctttcaccagaaaatgaactggctggcaccttgatcttggacttcccagcttccagaactgtgagaaaataaattgtccttgtttaagccacccagtttatgctatttttcatggcagcctgagcagactaagacagcagctaacacagcaagatcataccagttaaccttcctggttagaagacctgagcctcctgacttccggtcactggatactctctgttaggctcatgatttaaactctgtagtcactgctggcttggaaacctctaactctctctgcctcttgacagtgttccctcaagggagtccattagccaggactaggttacatgcccctgtgttagctgtgagggacaaggcagagaaataactgcccaagttcagcttcccataatgtttggggatgctatgactcaactttgatctatttttatatccttccttttagaacaatgggtgtttggatgctaagtggccaagaatatatattggaaaaatgcccactttggtgtaagaaaaagaaaaaaaagggaggtaaagagaaaaataatatttattatgtgttcagcacactcatatacattattacgcttgcagcattgctagaatttactcaccttataaatcagaggtgccgagagaatgcagttcctttattttatctgcagccatttataataccactagttgacatggagaaaatatacaaaataaacaactttagttcactctcatcttttaaaccgtccctgttagtatgttccattaatcttgggtagaaatgcccaaattcatagagtccccctctcatctgcatctctctctgagatcatggtcaattgtagagggaagaaagatgaggtttacatgatctaatggccttggtggagatagggaggatgagggactctggccttgtgctagtccctggcagcatgctggctgacatctgttgccctctggcatgatgtcctttgtccacctgggcactggcaccctgtgttagagtgtgtagctggtgaacttgtgatttgttcttttggcttagtttggcaatgttcctagggagcattggctatctctcttttgatgatttagtctcctctcagctgtcatggtctccagaccttgagttgatgccttgtcctttctccatcctagaggtctaccttcagcccatgccatgcctttatccaccacagcagatctcttggcatactgactctcgctttggtgcccatgcctcagaatatttaagggagatcctcacctgttcttttctcagtcttatcatgccagtcacccccagggaggctcagatgcctatggtgaataagatctattgcatggtggtctcttttcagattcccaaaaaaggagtgtggttcaagaaccctgtgctcattcctcctcttagtttaacactccacctctcctaatgcttcccccagaaagtgaaaatccagatatatctgaaactttgtctcttcttccgaaatgctcctatctggaaataaattcccctgtttaacttccttcaatttatatcttcattctaccatggagtctcaaggttttactgttctggacagaaggagtgatcttggtagttattgatattttaaatggtaaggaaaaaaactggaatatcctttctccctcaattaaacttggctctcaaactacagtgggattacaaaattcaatgttttgagatggaagctgagttttaccttagctgttttattttcattctatatcaaattctaatctctctactggcaaaaaaaatgccctaggtacactagggtgaatatcattacattcacaaagacaaacagaaaagcatattaataattttcaaatataagccccgctacacacaaaaattgtttttgcctacctctcataatcaatgacacagtcaagaaatagcagaactaaataatattacaaggcatagcaaacctttaattccctggagagtaacaactgatatgttgacttacttaagaaacatctaaggttccacttccagcataaagtagacacaagagatagagcacatggggcatgtgagatggtccatgaatctacttcccagtaaaattggtaaaaatgataacaacaacaaaaccgcacaactatttaaaatatctgggagcagtcctaatagcatatagcaagtaaaaaaaagaaaaaaagaaaaacatttatctaataaaactaatcacaacttggtaaaaacaggaagattctatggtatttgaaccatactccattccctccttgcccccaattcagctttaaggaaattacttcaggtggatgcagcagaaaacacagggctacctctcctgccagctcccacttggagagctattgtatcttcctggaagaggcaagatattagcatttctcatactgccccagctacttgtttcagaagataagttccaagcaagtgtgagtacaaggtggggactcccttttttcagcccaacactaacttgagggatggagattttaccttggcttcaacatgctgagaacatgggaccccaactgtcttctccatggctcatgtgtaaagcagaggtttcatggtgggaaaagcaagctaagtagaccagaagcaatagcagtaccctactctcccacacagccagctgctaaagcaagggtgtcactcagaaagaagtgtgccattgtcccctcccccagctccagaatcttggtgcaaagattttgaccagggagagaggcaagtcaaaatcagagagctcagaatgtcttctcaaaagagctaacatgattttcaatgttcaagcctaagggcatcctcaaaacaatcaagatagtggtgtaaagcaattaagaaaagactggtagatgtgctaaatgtgtagacaagctgaaacatagctagcttaccagacagaaccaggaaaacagacagctaagaagagcccttctgggatcacaacacatctcaaaaactggtctcaaaaactgtaaattaaattcaggcttatttcaacctgtggagaaaattgtgccccagggcagtgttgaaaactatagagcaacaattatggaactcaatggcagcaattagtgaaactgagcagttgaagtgatcagagaaaggaactgctaaatggactacaaaaacctgttaccgcaggataactatgcacatgcccaaggctgcgcccttccaggaccagtatgagaggattcacactgtgggaggacaggggagaacagatttcaccaaaatagcccaaccaatcactaaacaaataagcaagcaaataacaataacaaacctgggggttggggggactggtatccagtgctgctacaatatattatcaaagtcaatttcttaaaaaaagaaatttgaggcaaagaaaccagaaagtctgacccctacacaggcagggaagcaggcaacagaaactgcctgtgagggcaactagatggatttaacaaagacttcagagttgtgtatgtgtgtatgtgttttttcaaagaactaaaagaaaccatactaatgaagtaaatgaaagtatgattactatatttcaccaaatagagaatgtcaacacagagctagaaattttttggaaaaaaaaagaatcaaatgtaaattctagagttcagtacaaaaactgaagtgaaaaattcattaaaggcacataaacaaacattgaactaatagaagaaaagaattagcaaacttcaagatagattgatagggagtatgcagtctgaagatgagaaaggataaacaatgaagaaaaactaagagatcctcagagaaatgtgggataccattaagcaaatcagcctacctgtaacaggaatgccagaaggatagatcaaagaaaaaggagtagaaaatactcaaataaataatggaataaaatttctcaaatttgatgaaaaactttaactataaacctaagaggctctaaactccaagtaagattaaagcaaatagttccatagacacagcatagtacaaatgctgaaacccaaagacaaggaaaatatcctgaaagcagcaagagaaaatgaattttcacttacaagagaacctcaataagataaactgctgacttcttatcagaaataatgatgaccagaagacagtggtgtggtgtattcctagtgcccaaagaaaagaagaaaaaaaaaaaaaacaactatcaatcaagaatcactacccagcaaagctatcttttaaaaatgaaggtaaagtaaaaacattcacagataatcattgagataatttgtagtcacagacccaccttacaagaaatataaaagaaagttattcagactgaaagtgactgaccccagagagtaattcaaatctatagggaaaaacaaagagcacaagtagaggtagctatgtaactataaaagatagtatacataaatatttcttttttcttttccttctcttaacttatttaaatagcagtgatataaaacactataccaataattgtattattcagcctataacttatagaaaggtaatatattttctaataacaggacaaagaaggtgagtggcagcactttgttatttacagaaattctccattgttctttttttttgctgaaatcctgtagtctatagtaactagcattaaaactcttaaatgaaaaagagtcttatattttggggatagtagagaagtgaagaagaagtaattatggggagaggaacagcaaaagtaaagtaagtgataaaataatcaaagagtaaaaagagtcatgcttagctcttgtggcataaagcaagaaagaaagtcataacaaataactagtcaaagacacggaaatgagggcaggagagctctgtgtggcctccatacattttagacagttaagggtcaaaatctgggctatctagttgaaggcattagaaattcaaccatatgacctaggcttcatggggggtacattaagagaggaatgcctacttccctttttctggtatccagaaagagcaagcttccctcaaacttctaacttgtatgcctttcttttctcctcctaatagagagagaattgtaggaaggtaattgtccaacattttttgattggatgtaactaacttatcaatggttctaagcatgaagaatttggtctatttatactaacgttctccccagaccagttagagttacgtgtttgctctgccatgtaggagctgttccaaggtctagaatctgcatggaagaagtagtaagtccagttttacttttacagtaacttataattgtcagcctattccttattactagtaatgatgatagtttggcctttatttgttttattcctgttcttatttttcaattaattcagaacttggacaggaaaaagtggtactatttcaaaaccccgacaccttggtacattgcctggaaatctaacccagtcctcccacatggtaagagagaattccaccaaccgaacacacttcctgtccacatctgatgtttcttccaatgtgaagtccgttcgtggaatactcttagcttcttgccacccctttaccactccactctaccctgcatactccacccccagaggaggtggaatgatttatccaattggtaggtttggataaacgacccgggcagtttcaggccatctccagtttttttcctgggggagccagcatacctgtaggggttacaagttactttcttctcctttgtgccatgagtcatactcaagtcacatgcaagaggggatgcctgtcaggtccagccttacctgtgagagagtgggtaagtctgcctatttcaggaaatcaattagtagatccatttggctttcttcataacctacatcttcttactttttttttttttttttttttgagacagaatcttgctctgtcacccaggctggagtacagtgacgtgttctcagctcactgcaacctccgcctcctgagttcaaccgattctcctgcctcagcctcccgagtagctgggattacaggtgcacaccaccgtgcccagctaatttttgtatttttagtagagatggggtttcaccatattggccaggctggtctcaaactcctgaccctcacgatccgcccatctcagcctcccataacttgcattttcactcgttcgttatcaacaatgaaaatgttattttggcctccctccatttttttatctttccctaatttctcatttggatgctatttatttagtcctcttaagaatctcaaacagtagaaggaaaattatgtcacgatgtcagttctgaagaaatcaaagtactgaagataatgttaatgaccataggtaattacacaagaaagagtaacttaggcagaagggagagggttatattctaggaacaaggaaatagcccatttgtagaagtggattacagggtcagagtggaagcagcaataaagtcaccttgatgctgagccctgaaatccttccaattctctatgaatgtgtgtcaatgctgagcctgtgtgtgaaggtactaactgtgtaggtttgtgagggaagagagccaggaagcttgctatacttgatgacttatttgaaaaggaaaaagaaaaaaaaagtaaaacctggtcactattaccataaagccatagcatgaaataagattttctgtaaaattgttagcacagcattccagttttgataacacttcagatgattttgttgcagtaaaatatatcagactgaaaacctttcctttgcctaaaggaaggtagttcttggactatttgggaacaaatgatctctttcaatagctcaaaacttgtagtgtgacatttgttttcttgtgatcaatagagcaagtgttcattttcaccatgagggtggcatactggaggctcaagctaattatttttctggtaatgggaaataagattgagccgatggctcaaagcaagtgagaataacttttgattccctctgcctgattattctctagtgtcatatggcagcccctggcagcccattcacatttcctgattaagtaagcagtttgagtcaggcatatggtcatgcatcagatagttctctggataatattagttccaaggtaagaaagaaaatatggttaaatgtgtatgagtttataatttatttactgttcacaggggtgggatttgccttgcacattgctaccctcatagcttccatttgtttgatatatgctctggctgaggacaccatattcatatgtattttttttatcttcagcagaaccatttaaaatttccttcctttcctatttccttcagtatgttctctatttccaaaaccatcttctttccctggagcaaccattttcttttgtttaggatcacaaatttcacatctcctgtcaatctttttgtcaagaggatattgtgaagataaaatgacaaaatggttggaaaaaatgcttttctttgaactattatttcaataataggtattgttttgctgccgaagactgagaaaagttttatggataccaattttcccctcataaagtagatcaagacaatgttcttgccaaaaccgggtacttcttagtcatgttgagctttgggaggtgtctattttctccagaagaagaggacaaagagatgcaccatatttcttaaagtcctggataggaagtttgagcatctgtttccctctatccatagttcattcacagtggtaacttcagcagtcatccagcagaactatatagtgtccccatcatcttcaggtgctctgaataagtagtgatttgggctgctagaaagatccttgggtgggctggcagtaacacatcttccagtaatcattactagaagtgtcagcctaggtaaattcatgttcatctgggaccattttctcttactttgcttaaatttaacccagatcttaagatccaagtgttatattgaacattggtgaggtacagcgaaatttgaagaggtgggaaaaagttttcctttccacccttacagagacaacacgctgaggaaataggactctcccttcgtctatttaggtaatccttggcttggcatatttgggtaagaaaatgaaaggtttgcctacatagttgaaatctctcgtcacattatatcatctgaagcctatttgtacgttgggatcattttatttggttttggttaggcataaaagtgttctgtggtctcctcttttttcaaggccttctggcttttggaaaattgagtgatttcatccctgtccgggtttcctagtgaaatcttgtatttttactcaaattacttgatcaattagttatgtcagctgcccaaaatgtgcctttttattaatagcaccttttatcaactcattggaattagaaattgcaaccatggtttgaggctggtaacatcttgcaataatttataaatattactttttaaaaagacctcacaattgctcatttgtgaactttttggatgtgtccctgtgtgagaaattgcatttgtattattattagttctgacaaactggattagatcttggctattgttaagtggttctatctgccctcaaatctactgagagacacagcattttaaatgaatttaattaaaacggcatgtggtttatagagctgcctccagttagtatgccattcttcttgactgaatagagtttctactaatgtataatgatgttttatgtgagagatgtttgaaactccttcatagtagccccgaggtagtttccgtggaatgacatggtggtgaaattttaaaattctaaaaaaccttttatacttaagtgagtcatgtttacactaactaatgtatgcataaatgtgttaaatatgtttgttgaagctgtgagagacatggattgtatttcaacaccagcaatatgttggcagtgagagatttttaagaaattcaaatctgggagcagtttggaagatctgagaaaagatatatggataccaataatatgtattattctttgaagtatgaaaaaagaccactgtggaacttcctcttaaaatcagttcctttggtcaactagttttaatggttctcccctaaggaataagaattatacataaagacgattctcagcatcagtttaaaacaaagtcttggaaaatatcaatgatagaagtttatgtttttttaatgaagattttttgcatttttgaatattttaaaagaataaattgttcaataaaactttatagagggagtcaatgaagccatttgactgaatagactcaaattctggttctggaaattgatctttgatgataatgataggataactgcagggaagtcgtcttgacccattttcctccacagtcagtcttctgaaatgacactactgagaaatgcagtctttacatcatcttcattaagtacacaacaaaatgtctggcaatgttgtagactccagcgggacatggttagagaagaagtggttcagcagaagggagtaagctccaggtaaacatgcagcacaaatgaggaagaatttccaggacatggaaactaacgggtaagagagatgagctcagattggaggagctcacctcagcctctcaaaatgctaggattacagacatgaaccactatgcctggcccttcatttttttttttttctaagagacagagtcttgctgtgttgcccagactggagtccagtggcatgatcatagctcactgtagccttccagtgagcaaggaaggaaacaatgaactttccatgggaagagagttgaaataaaggaaggtcatgagaaactcaggctgtgatttcttgagaggaagtcaatgaaatgaactacaggcatgaacaatgaagaaaagttaaaaggataatagagacaacagcttggccgggcatggtggctcacacctgtaatcctagctctcagggaggcagaggcgggaggatagcttgagcccaggagttcaagacctgcctgggcaatatagcgagaccccgttctccacgaaaaggaagaaaaaaaaagacaaaaaaaaaaaaataagcgtaatagagacaacagcttataggctacatacacagcagtattctctgtttctcctcaacctcagtaaaagctaatctacctcatagggctgtcatgaagatcaaatgtagtcaatataaaaaaaattcatgtaagatgcttagtacaatacatggtatattacaagtactcaaagcattttaacttaaaaattaccatttgcatgtattctaactagatgtctttcttaatgtttccataaaagattccatatattgattcaaaattaacaaatatcttttcatttctagaaaccctgtgttttctcctgatctgaatggcatgtcattttagaattcttattgtgagatgtttcttcttcttctttttttttgaaatggagtctcagtctgttgctcaggctggagtgcagtggcatgatcttggctcactgcaacttccacctcccaggttcaagtgattctcctgcctcagcctctcaattagctgggaatacaggcactcaccaccacacctggccaattttttgtttgtttgtatttttagcagagatggggttttcccatgttggccaggctggtcttgaatgcctgacctcaagtgatccattcgcctcagcctctcaaagtgctgggattacagacatgagccaccatgccctgcccttcatttttttcttcctaagagacggagtcttgctgtgttgcccagtctggagtccagtggcatgatcatagctcactgcaggctcaacctcctgggttcaaaggatcctccctcctcagcctcccaagtagctgaggaaacaggtgcatgccaccatgtccagctaattttttaatttcttaattttttgtagagacagggtctcactgtattgcccaggctcttttcaaattcctagcttcaagcagtcctcctgccttagcctcccaacgtgctaggattacagatgtaagccactgtgcctggtcttgatcttagcttcttaaaaaatcagaagtgttttaggtagtggtatcttccaaaaatgtcattatcagaaagaaagacatttttaaaaacccacaacatttttattccttgcacttaattttttggcctctaactttgggagatgaaaataatctctctgaagaaaaaataaactaccaaaggtcttattataaatcctacttttaagatctgggtaacactgtttaataatagcatagcagctatcctttattgagctattacttgcccagtacaatatgcaatctacatatttcctctacagtcttcacttctatgctaaacaaattgtattattctacaattttataaagaaactaagactcaggccggacgcagtggcccacacctatgatcccaacactttgggaggccgaggcaggcagatcacttgaggctaggaaaacaagaccaggctggccaacatggtgaaaccccgtctctattaaaaatacaaaaattacctgagcgtggtgtcatgtctgtagtcccagctactcaggacactggggcaggaggattgcttgaactggggaggcggaggttgcagtgagccgagatggcactactgcactccagcctgggtgacagagtgagacctgtctcaaaaaaataaagcaaaacaaaacaaacaagcaaaaaaacccatactcaccaaaagaaaaaaaaaattaagacttagagaacttaacttgctagcaaataaccaagccagaattcacactcagtgcttcctgactttaagtttcttcccatgatgccattctgcctcaaaccagacagccaatctccttaagaagacaacaattttttatcaaaatattttgacattagtgaattaaccaagtatgccacttgtctgactgtgcaaatccttaccaaggaagcaaagtggaaaaaaaaattgaggaaattccagacaatggaaacacaataggcaaaaagacatttcagttttatctggagaacatatgaaaggagcagcagtgatcacagagaacaagctggaaacacttccttgtgagtgatggtattctgtttccatggtaactagacatggcagaggaagtcaatgcctcgtttctgtttactcaatctgtatgagctcagtgtatacgacagggcagttttcaacaaagaataattcagtgagacagccctgatcatgtcacccctgcctaaaaactttccaggattcttggctaagtgcaggacgcctcgtgggcataggaggtcctctactcagccagtctcatctcctgctctctacagttccgtctctatgctctggtccattctgacatgcacccaatccgggctgcatattagagtcacctagggagctttaaaaatatacagatgtctgggcttcacgaaccccagggattctgatttgatgatctggggtagggtcttaaaatctctccaggtaattagaaagcacagccgggattgagaagatcactgatctaatcaaagaggattctaaaaactacttcattctcctgactctacactttatactaacgcccttcctttctcctgaaagatcttttctctctcctcccctttcaccttctctggccaactataccttttaaattcttttcatcttgtaaagtgtttctccaatgccttgaagcttttcttaattccccgtcctctttttagttgaacatagtatctctttcatttaaactttaaaaatgtgtttttacccctcttatagcatttatatttcctatcactacctcctctcacccttctctatgagcaaggactaggttttgcagatttcttgatatactaaaggctcaataaaaaattaaatacctgtatttcaaaggttgcaaaatatctgtctttggaaaaaagagttaatatcctccatttctgatgatgcttgaattgagttcaagactgggcccaaagtccatcccctaatagtgagaatgcttattttagagcctgcaagccccccggtattgtattagaatggtgtatgggcttgggtgcattattttcaggagagtttccgtagctttaatcagactctcaaagttacccatctatgattcattaacatgttaaagctactatcctacaagatgaatcttcagaggctcagtgctcagtggtgacagtggccttgatttgacactgtttactggacactaaccttccatttctctttctgccataattttaggccacttcacctccatttaggttgaatgccttcatgaaaatgttagtactccaaagactaatcgagaataacacctatcatttggatgattaaatatttttaaatgaaaaataaaattaggccaggagtggcggctcacacctgtaatccaaacactttaggaggccaaggtgggcagattgcttgagcccaggaattcaagacaagactggccaacatggcaaaccccatctccacaaaaagtacaaaaatctagctgaacgtggtagtgcacgcctgtagtcccagctacttgggaggctgaggtgggaggatcgcttgagcccaggaggttgaggctacagtgagctgtgatcatgccattttagtccagcctgggcaacagagtgagaccctgtctttaaaaaaataagaagaagaaacaaaattaaaggtacttttgttattggctcagaaaaatgtgaattcccatcttggttaggtgataaatgcatagtgtctttgccaccattgaccaccacagagaaaagtgctcatatgcatgtgtatgttgtgtgtgttttgtatgagtattttagcaaaatgtgatttttcttagacaaaaaaattgccaaaggcctggttgtctgcaaaaggaataaaattcatttcggcaggccacctctgagtttcttaggtttcattatttgctgctgaaatatttgagactaaaacaacaacaatcaaaacatgacttagtagctgttcgaagtaatttttctacttctgggcacaaaatagccagaaaagcgtctgtcttctcaattgaactgatttgtaattctagaatgtaagaggaaaaaactggaaggacctccacttaaatctgtaattttggtaattctgaagtaacgtgacacaaggaattttgatcattgctcagttcagcctgggggaatctcctttcaaggaatgagaaatgcttgggagaagtcattggaggaagctgcaattggggtttgacctgaataaattgaaatagaacatgggagatattacctagtgagcctagtagaaattagcaagctgaagataagagttagcagtatatatattcacatatatatggctgtatactcaaaattgttgcaaagtgtgaacatcagacttaatcaaatgacatgctgatatgcctccttataaaaaagggttggcattaaaattcagaattttcaaaatacaaaaattagaaggtgattactcacgtttttaaaagaactctttgccttaaaaagaatctaccacattattccattcaaattaccccttatagaaacgacttcctgttcaataaatagttctgggacaactggcttatcatatgcagaagactgaaaatggactcctatgttacaccatacacaagaatcaactcaacatggattaaagacttaaatgtaaattacaaaactataaaagccctgaaagttaacctaggcaataccattcaggacaaagaaactggcaaagatttcattttcataccaaaaacaattgcaaaaaagcaaaaattgacaaattggattaaacttaagagtttctgcacagcaaaagaaaccatccacagagtaaacagaaaacctacagaatgagagaaaatatttgcaaactattcatcatctgacaaaggtctaatatccagtatctataaaaaaactttaacaaatttacaacaacaacaacaacaccccattaaaaagtaggcaaaggacatgaatagacacttttcaaaagaagacatacatgtggccaataagcatatgaagaaaagctcaacatcactgatcatgagagaaatgcaaatcaaaaccaccatgagatagcatctcacaccaatcagaatgtctattattaaaaggtcaaaaactaacagatgctggcaaggttgcggataaaagagaatgcttacacactgttggtgggagtgtaaattagttcaactgttgtggaaagcagtgtggcaattcctgaaatagcgaaaaacagaactaccattcaatccccttactgatatatctgatgtaataaatcattctcccataaaggcatatgcatgtgtatgttcattgcaacactattcacaattgcaaatatatggaatcaacctcaatgcccatcagtggcaaagtgaataaagaaaatgcggtgcatatataccatggaatactatgcagccataaaaagaatgagattatgtcctttgcaggaacatggatgaagctggaggccattatccttaacaaaaatgcaggaacagaaaggcaaataccacatgttctcactttaagtgggacttaaatgatgagaacacatggacacatagaggggaacaacagatactggggcctccttgacggtggagggtgagaggaggaggaagggagaggatcagaaaaagtaactattgggtactaggcttggtacctgagtgagaaagtaatctgttcaacaaacccctgtgacacaaatttacccatataaaaaaccttcagatgcaccactgtacctaaaataaaagtttaaaaaataaataaaattaaattaatgaaatgctctttaaagtatgttaaaattgccatttggttaatttcagaggttctcacacttcagtgtgcatcgcagtcaccagaaaggtatgttaataaaaattaggttgctcagcccccaccctcagaatttctgattcagaaggtttgggatggatccctaaaatctgcatttcgaacaggttctctggtctgggcaccagtttgaaaactgttggtttattaaaattcttcctgaacgtagtttattagaaaaaaatctatgatgtaacaggaagtaaacctacaagtgatttttagtggatgtgatgtgctgaattgtgtatcccccaaatttcatatgctgaagtcctcatccccagtacctcagaatgtgactgtgtttaaagatagggtccttaaagaagtaattaagttaaaatgaggtcattagagtgggccttcatccaacatatgactagtgtccttataggaaggggaaattaggacccaggcacacacagaggaaagcccatgtgaaaaaaacagggagaaggtggtcatctacaagccaaggaaagaggactcagaagaaaccagcctgctgacaccttcacttggatttctagccccaagactacgaagaaatatatttccgatgtttgatctccctagtctgtggtcctctgttatgggtctagcaagctaatacagattgtgggcttcaaaataaaatagctatttagaaaatgtattcaacggttttgcgtttggtctaagggtaaaaatcaaaagtgatagtaaagtaagagaagcaaacagagtaaaatgcactcttaacctctgcttcatgtccacttttgcctttgtagatgtctctgggcatctgggcttggaggagatacctgaatttatgtttaatcaggggacactattggtgtcaggttggttcacaaatgtgggagaataagagagctacatggaaaggaagagtccatatgaacagaatgaagtgtgtggcctagggagagttttaatgttcttgcatattcagtgtctttatgaatagtataccaaatatacaggggttataaattgggggaaagggagcatgatgcagagtgtgggtgaagagtgtgttttatttggtctgctcactgtttgcacaatttgaagttaaatgatttggggtgtgtactctatcctcactcctcctttggtcacatatccaccttcttcacgcatttgttctgcctggtctctagatgcctttcagtgggtgacccccaatttcaagtatcctatagtggttattgtcccctacacggtacatgttagttgtaagttctggtaaattttgtttttgtaactttttttttctttttgagacagattgttgctctttcacccaggctggagtgcagtagcatgatttcggctcattgcaacctctgcctcccaggtttaagtgattcttctgcctcagcctcctaagtagctgtgattacaggcatgcaccaccatgcccagctaattttttcttttttttaaattgagacagagtcttgctctgtcatccaggctggagtgcagtggcatgatctcagcccactgcaacctccacctcctgggttcaagcaattctcctgcctcagcctcctgagtagctgggattaaaagcacacactggcccacgccaccatgcccagctaatttttcttccccccgagacagagtcttgctctgtcgcccaggcgggagtgcagtggcggtgatctcggctcactgcaagctccacctcccgggttcacgccattctcccgcctcagcctcccaagtagctgggactacagatgcctgccaccacgcccagctaatttttttgtatttttagtagagatggggtttcactgtgtaagccaggatggtctctatctcctgacctcatgatcctcctgcctcagcctcccaaagtgctgggattacaggtgtaagccaccgtgcctgacctaatttttgtatttttagtagagatggggtttcaccatgttggccaggctgatcttgaattcctgacctcaggtgatccgcccaccttggcctcccaaagtgctgggattacaggtgtgagccaccgcacctggccctgtaactatttttattataagaattttctcctagcagtagtgatggaaataacattagcaatacaaatgctatcttatagagggagaaaatgaggaggcccaataccatttcatgagtgagtcagaaggtgaaatccacaatcacttgcttttatgctttgctcaaagtggcaggctccatggcctcttaaaaaaattgccatctttttattataaagtaataaataaattgcaaattctgccataaactctttcctcgtgacctttcttaaatttgttttcttttttcttcatttcttaataagtctttatatattttggcacagtaagctttgaaaagggagggttaaaaatagcttcctggtttcagctaccaaacacaagcatgttttggagctctcccacaacaggctgatttccaaagaaacacacatttattcatcctgaagggctgtgatgttgaggagtcagacaaaaaattcaactattatgtgaagacagtttgagaaatataaataagggagtgctttcactagcacttgcagtatggatttgtgactcaagaaagtcctgttcatgtgtttcttcattttttccctgggtttccataatcagagaagggaaggacaggaaagcatgtgatatttatatagcagaaatgatactatattaaagggtttctttaggtgttaaacagtttggcttgcaaacgtctagacttttttaaatatctaaaaatgacaaatcttaaacaccactcccaataacttccttaaaatttgatataagaaatgttgcctgggctttatagtcccataattgcttggctgagaacatgtgccttactcctgttcctatacaaggtccatcatcttgctggcactccatgaatgtcaactaccaagtgtacagatttaggtatcaaagactgctgatgatgcaaaacctagagatctaggaaatactgaggaataatgcagccagactcaaaaggtttgtttctttgagctgccagagctagtaatgtaagtggaaaatatagttaatatagacagatgtcaaacaaagccaagtggaaagaacaggaaacaaaaatattaaatgaaacagtagagtgtgcttactgggttgggacttggagaattgggtttggaatctctttgcagtctgccctgtgaaagactgaaagaaaattttgaagtgatgtgaaaatttattcggttcctcagtggataaccctttcccaaacaatgagaatctctgatgaagcctctgctgttacttatgaagaaatttgataactatttaacatgttgatattatactactatcaagtgatattgtaaatacctgcccttccctcatccacccatgcaaagcatcctggaacatcccagattattagttgctgtagtccatctagaatgctataatgagacaccataaactgggtagcttataaataacagaaatttgtgtctcacaattctgaaggctggaaagtccaagatcaagattccaggagacttggcacctggtgaagcctggctttctggtttatagaaagcatcttctctgtctcctgatatgatagaaggggcaagggatctctctagggtctctttataagagtaccaatccccagttatctcccaaaggacctacatctaataccctcaccttgggggttaggatttcaatacctgaatttggggggggacataaacatttagtctattgtattagcactgcaagcatagggtgtaagagtgtgtatcttcttttcaaacttaggaattagctatttcttcatagattcttctagttagtaataggttggtgcaaaagtaatcacagtttaaattttaaatcattataactaggctcaaacacatctttattaattaaaataggaaccattacaatcaacacatttttgccaactggaaataagtttgtttattcctgtagcataaaaatctgtgcttcgggattcaatgaactcttggaaagcattttctgcatcctgctggttgtggaaacattttccatgtaaaaagttgtcgagatgcttgaagaagtcagttggtgagaggtcaggtgaatatggcagttgaggcaaaacttcttagcccaattcgttcaacttttgaagcattggttgtgtgttgtgcaatgagtggtcaggcattgttgtggagaagaattgggccttttctgttgaccaatgccggctgcaggcattgcagttttcagtgcatctcatcaatttgctgagcatacttctcagatgtaatggtttcaccgggattcagaaagctgcagtggatcagactggcaacagacaacctaacagtgaccacgacccttttttggtgcaactttggctttggaaagtgctttggaacttcatcttggtactgaccactgagctggtcatcgctggttgttgtataaaattcacttttcgtcacatgtcacaatccgatggagtatagttcattgttgttgagtacaataagagaaaatgacacttcaaaatggtgatattttcaattttcactcagctcacgaggcacccatttatcagctttttcactcttccaatttgcttcaaatgccaaacaaccatagaatggtccatgttgagttcttcggcaatttctcatgtggttgtacgaggatcagcttcgacgattgctctcaattggtcattgtcaacttccgatggctggccactatactcctcatctcaagtctcctgtctcctttggaaaacttcttgaaccaccactgcactgtacattcattagcagttcctgggccgaatgcgttgttgatgttgtgagttgtctccactgctttacgacccattttgaactcgaataagaaaatcattcgaatttgctttttgtctaacatcatttccattgtctaaaataaatataaaataaacagcaagtaataagtcattagcaaaaaaaaagtgagaaatggccattaaagtgatatataacataactacatttatttaagaatgtattccaatatcacacagcaaatttcaacaatgcaaaaactgcaattatgtttgcaccaagctaatagtatcctgtcttatgccactaattaccttagggctgagtgaaagcggggcctgctagccctgatgatggaccctcagttcagagtcagcttgagagggaggcaagagaaaccatcttctccacctttcccctcctagggcagttatctgagagaagagccggcagaaggcatttagccttcagtctgtgaagtgttggtgctggacaaattatagcagaagctgggctgctacagagtaactagggttggcaatagcttgcttgttgatggccactttcttaggcaagtccagacacagtatatagcggcttcaggtgggactagaacatccctgcagcaccatctgcccaggcttgctcggtgaagagccctgagccctaagccctaaatcctaaggtggtgtcagtttagcttaaaggaaggtggtcttcttggagaaatgtgccaagcttgagagcgtcctaaacatcatggcaaaatatgaggcaaaagggtaaactgacgaggattgttaacaccaacattactaataatgcgtgcttatattacttaatgtttctatttgctagatatcaagccttaacactgactactttaaattcagtgtttcattgaatcccctcagcaactttatgagttaagtattattactattcctattttcagagaagataactgacaaaaagagagtaagaagtttgcctaaagttacagttattaaacatttagaattggtttcacacacagctcagtccgactcagaatcccatactctttcccctaaactatgccacctgtaaacaaacacaggcaaggccagtgagaaatcagaaaccaagttgcttattatttcatggtgttgctgtgtgttgtgggaattacaaatgactctaaaatattgtttctaccctccaggagcctagaatgtcaatccgtgatctttctcatcaattctgtttatgttttatttatccccatatgaaagctaaacagtaaaatttattctgtatccaactgaagggcatgtttttaaatttctaaaaccccaaatatgtcaaatgttagtaaacactgctagactgagaacagtgaaaataacttttaaatacttgttcgatgccattgcttataacttgtaagaccaacatagaaatttatctgtagtttatcagtgaaagttgatagaccaggattttatcagctaagaaaggagggatatgccagggcctatggaattttaggaaaaagggaagcctttaattgggtgaggaaaagtagaaattgagttataacctcttccatgggtcgtttattagcacatggtcattaacatctatccccaggttcctaagcaggaagcaggaaaagcaacaaaccagagaaagtcctgagccccctttgaactttatagaaaggcactttataaatcctaggaaaatgaatttatgttataatttgtctagagtgactctgagttaaaactcttttgaaggtagggcctgtttgatacaccatatagaaagtcacctctctccctgccccccagacagtgtagcccatcctgtgttgacttgtcctctattgaccatgattttttttttttggcattctttcctgtggatctagattaaaagtattaagaaatacaccttaaagagaaagagcctattcaataggaggcctagagggcaggaaagaagaatttagccctttgtcatgaagtggaatgagtagtcctccctgagtgttgattaaacaagattataatcagccatgtatggttgcgacttaattggcaggcagatctgcttgctgtgcagagcagtatatttgtatgtgctcatttttttaaatgtgttccaaacccttatagttgagttgattttttttttttgcaataatgatatgctttcagtagcgtgtcattttctttacccttgtagagagataacatgcaattagggagtgatgtcagcctgtaacattttggtgtaaaattttggtcacaccaaaatactgggctccttaacaaagctggcagacacatcttttggcagcagctgctcgccatgtgatttaaaacttcctgtcactataattgatgtgtttttattctttccatttcctgaagcctgatcagaattaaaattgctgttggaatttcctgtcaaagcaactcatttattctctgagctctgcactttgattggacattgccttcagcaatagtcaggtggagattgctgggaattattctctccacacaggttagatggccacgcacggcacatctgcaaatctacacagattgtccatcatgtggtaaacttgtcctaatggaaactccacatgccaaatgttaatgatttgaatatcaaacttggccacctgctggggcctctgggttttgtgttaatttaggaaatcccgtagagttttcagccaattgtctcaccattgaatttagattgttgttccaaggttcactagtgaagcatctcagaacaagactctgatctgtccctggtttagataacatgactaaaaatgtttaatttttaagcccatttctccatcccttctgttcccccatatgctatttacatataacatcttggggtgattgggggtataagggatgaatggttctgaaatatgccctagtagatacttgctcacagatgtgtggccaagacaactacaaaaattcagacgtgggtaaaatagtaggcagtggaaagatctaaattctacctcgttttatttttatatctgaaagtaaatccataaaattacttctttatgcaaaggaaagaatcactaactttcctcagtgtatccactgcacagaggatttatttatttactttttgattgtgagttcatcttctttacaaatgactgttttccagttgaggcaggtgaaagaaacgctttcatgagcttaaagaagaggttgattaagtttaatgccctggacaataaggactatctttacttatcctggtgattagactcgaagatttcattatggaaatgggaatctctttttttaaaaatacaacaacctatcctataaaccacaacacaaagacgtttttaaaaataatactttattgaaaactcaatctggcatttaaaatgcttttgttttgtcaccaagtaaaggtaggctttttgattttttttccaagtacttgtaaaatattgtttttaatatttcaaaaatgtgaaatccacaagtctcagaccttgttttgagactttgcttacccccaccacctaggacagtgccttacaaattgtagatactcaattgatatttattaagtgaatgaaggaagccctgtagaattgtaaaatgtcaaagcaatggggaagggaccatgttacatctggagacagagcttccaagcatagtaatcttgctctgcataaggatttctgaccctgcttatatgtcagaatcaccagaggggctttaaaaaacaaccacaaacaaactggtgccgggatgcctccatgggccatgaaatctgaatcttctgttggtcactcttgggctgaaatgatgttcaagtcagaggtcagcgtttccccatactgggcacccttgagattgaatcccaggcacattccactccagatggccaggtctgatgtgttggttccaccaagtcagaatcatcctggacattttttatatattagcttgagtcaatgactccttgaaaaatggagatggagaacagcagttggtggagagagtgaaccactccttcaggcacgttgtgagctgaactaatttaaaatcacaggtaaggataatgctacatgtggagtgtgttagaaaccaccactttcattcaatgtttctagcatgttaggatatttaaagcacggaggggaagaaaaattacatcactagatttttttctgatcttaaagtaagttttgaatatttgattcttttctatgaatattctccgggaacttctaccattgttatctgacttctattctacctctgtatgtatctcttttgccttcttattccccaaagcctctgattttagagcagcttgcagaaatagtggtgaataatgtgcttattatcatgtaggtgctcgcctgtattttgtatgcaaggaggtatctgttccatgggacacatgagtttgccctgacgatgacccagaaagggtctgcatgtgtatttctgctgccttttccggccacagcttggggagcttgtctgtagagggcgtccgaggctccatggatagtgaggtccatcctactgcattttcaacactgctccatagcctgtgctcagcatgccactggaaaggaatcctagctgtattctcttcaaatttcccttcccctttaattcttacttccttcttgtgacattctgctattctttgccacaaaccattgcaaaacaacccatacaagagtttttgcctcctccttggctagggtagaaggctctttggaaaccacaaagccacatctccagggaacagtagctttattaatataataatcaccaccatcatggcctggatacaatatacacattactttagaaagaaaaataaggactatctggggtttgctggagaagctgcacttgaggttagatgtgtatagttaaatttggagtcaagctgaggtcattgctaaggagatttggagttggaaatccatgtggaaaatggttgccccatggaagttatcctctcaccattaaaactcattttgaataatatcagttagggaaaatacgagggtttgatcctgtaagacttgggcttttcttgatgccctggtttacttggaaaataagttgtatggtatataatctttgccatccatcctctctttctcaaaaaaatcctagcacaaatggaataaaaaagttttattaagaagaatcataccatgtatgtttcatgagattttcattctaaataacatataaggaatgagttgcacaataccaaatattttagactgtgttccttctaaataagttgagtgtatttaatgaaagattttctccaattgaaatggaataagaagaaaatattaaaaggtcctttaatttcttatttggttgtttcttggatatagaggaggaagaaaaaataaagtgtggcaaaacaaacaaacatggcatcctcctttttaagcaatcatgtcagcttggatggaaataacaaaggatcccaactaagtgtgccagagcctccggcaaaggcagactgctgacatggcagctgtatgtttccagctgattttaggcctagataactatccctttcagcttaaatgatgctctacagtcattgactagtgcccagttaggttggagcacagttcttttggaacctgttcagaccaacttggactgcctgtgagatctgggccaagatcagactggtttcctggagcctgaggcatagtacaggctgtagtaaaagggacagagttctctgcatgtgtagtagaatgtatcattgcatctgtttgctacctttactttttaagaataatcacaaatgagtgagagctacactgtattcttcagactgaagcagggtgtacaccaaatatcttttccaataatctgtaaattcaacaggttatttttcttttctgttttaaaaatagcttgtacttatccccctcctctccaacccaagtgtggctcttgaactattttcaatatattgcctttttaggatcccaaattctccttttaatgtgaaacttgctttaattgaccaaaaatgccattttcaaaatgttcaattctctgcaaaagcattgcttactgacagtgcttattgatgaaggctgtggaatctaaaggatgtcaacagatgaatgaagcctagtatggtgagatgagggctgccatctgcttaagggttggccaaacacctggataatttaggctaaaagaccagccatttcttcattctgaatacataacagaaatcactgctttttaggtttggcctcaatcaacaacaagaactgatttccctggtgatgctgaacaaatgtttaagagagtaagatctgaaactgattctccaactttagtgggccagtgcataaaatgatccaggttttctgaatgcacatgagctgccagatgggttgtttagtataagcagtgcaatctttgtttctttagctgctgtctgcaaatattggtatttaagggcggctctaaagtgaccaaagaaagtttgtgaaattcaagaggctgtctttttcctttcccaaaaaataattgtttttggtatatgagcccaggagataattgcatgctgacttcttgttctccagtggcgtgttttttcctgctattgagcagaactgaaatagttagcatgtagaaaaatacatggaatattaaactaaaatatgtctgtctagggatccatttagttgcctccaatagctcctttctttgtgaatgccattatgtttatatatatttaaatgccccctttgctacactggttttagcttcttgttagcatcacttcttgttagcatgatgttctacagcacaaggcagctgaagaagtgaaacatgtgttgaagaatttatgcagtgtcctcagattctttcattaagagaagcaagaataataggtgcatattataagcttgctgtgttaagcaatatgttattgctatgcttgacagacatcttgtttacattcatgttatatattggggaaaccattgcattttaagaacatggcatttttttatagtattatttatactgtgcctcatatgcatgggaaacgtagtcgtctaaaaacatgatatgttttaaatccacttgtctcctcctcctaatgaaatattccaagtgctttccccccagcgtagggagttcaacgtgttctttattcaggccattctaattactgccagccacattccctcaatttattaaaacaatggcccagcttatttcagtttagtttaattcatgtgtgaaaactttacccccatcttattccatggagaacagtatgaaagctatctttctagttggtccagtgtttttgtttttagaaaagcaccggctgtttccaggctgactcaggaacttcattaatttagttgagccttgtgcaattgttaatgggcatgagatagcccagtggtgcagcctcatctggagtgcaaaatattacagtactccatggccaaatcttggtagcaagtattttttgctatctttaccctcactaaggagaaacgtgaagtgtgaggcaatttagtatagttagtattttagtagtaagtaccgtatattgaaggtgggaaataagaacatatttaccttctcctagtttttacatcttttgcacactgaaatcaaactgtgcttctccaaagtgttttgtgccattttacccaaatgcttccaacttatttagggaagtgttcattttaagagtgtggcaccttgtattttctgaagcatccttttctacctccaacagggagcagcaaggctagtcacagctagttctagctggacagtaatccatgccaaggactggaacccagaagaagtaaaagtgaagaaaataagtggagctggattaaaagatagacccacacacaaagaggcagacaggagacttaatgtttgcaatgtttcagcttgtgggaaaaccaactgtcatgtgaatattctgcaaagaacagaaatgatatcattttattagcaccacaattcatagtttattgaatgcttccattttccaggccttgctaagtggatcctttatttaaatttatccttataacaactctgtggggaaagttcaatcattcctctttgataggtaaggaaactgaggcttacagaggttgtggagctgtgtgagggtacaaccaataattagtagaagcagaatttgaatctctgtttgactccaaagaatgagaatgtgcatcattggtagggtgtacttagttgaatgctagaaagcagtggatgctgctgtgagataacttggcttagagcagaaagcaactcccaaagagagcctagagacaggtgggtggagaggagcagcagtatcctgagaatgtgttgacagtttggcaacattttatggctagatcaaaagatttctagtccagttttgccttatttttctggaggcataggtactaggcagctgataagtgggcttggttagccctttattttagggtatatggagaagtttagactgccctaaatctggcaactgcattatggtgcaagggcatcacatcacagaatccacatgacattacttccagagtactgttaccaaggacctggaccctagccagacctcaggcccttgatcctcagttcctctttccctgctcatctgtgtaagatggaggcagctgactcccagagcaactgctggatgggctgatggacagaaggagatgcaccctagtaagccataagtgatatgctttgcctagctaattctgcaaaagagaagtgacagatactcagcattgagaaattggtcagattatttataacaaaatgggaggagactggagactgggagatgaagagacacattttcagccaatggcagatgcaggacatcacagaacattctcttaggatttgcatgttggttagtattggggagattttacatatatatgtaaaaatacatatgtatgtatacatatgtgtgtatgtatatatatatatacacatatacacatgcacacatacacacaaagatatatatatacagacatcccaataataagctttctgtaaatagcagaagggaatgtgatcttgaattcttggaaaactttttccttgacatccaatatctctgaaaagaattgtcagttaaagtgtatgttctaaaaacttttagctccttctttggactatctgcctgccacttgattgtttactctctgacccactggcatgatatttctatattgattttcccaacattccttttgtcacatctctgttcaaagtttcagaatgctgaagttgcctatgcaaaaagtcaaaatgccttatcactgaaatcagtacttttcacaagctaatttcagcctgcatttccaggttcatttctacagtttccctgtgtaagttctctagtttaagcaagtgggtcaatttattgtttctgacccttatttaaagtgttgttttcacttacaatgcctccactgttttctttacctgttggaatgccaattggaagccaaattgatggcctagaattataaaccatgacaggcaacagacaaggtgcattttggcttggaaagtaattgaggtcataaatagcagtagtttcagagtggatgaagtaaagaggttcccatgttgcgtgtgcagaaacactaaggcaagccttggtccactgggtcagtgacatcggaatggaataggtcagtaccctggatagctcccaggaatacaaaactcgagtgctgacaaggttctatacttggagttgtagacctactcagctgcagactcatattttctgcacccctttttcttaaaaaggccactgtcatttttcctctaagtttagcaactagagattctaagactcatgctaatattgcccttcttctttcctgacctatgtctcaaactcacgtggggtccctgattatgctgaagggtttatcctccattttattgcatgagatgttcgccagggggtttgtctttcttcgggtagggatagggactggacttctactaacgccccattgtgtctgggcttttttttttttcatagatggcatttcattatcctgtcaacactgtgagcagattaaaattttgcccatccttcaagattaagtcccactctcacctttgctttgatctctccactgatcagcccaatataaaagtagctctctctcatcttaactagaacactttgtagtctttatagtcattcatttcaatattaatgatatactgttctttataagctatctttttatctctctgtgttatagctctccaattggcttggatgcttcttggggacatgcttcttagcaacagggcttcccaacggtaaggacccagtgaggatgcactgcagattattgcatgaactatattttttctgggaaagacagagagaacagtttcaagttttctgatagacatgttcagtcagtagcccttttcaattatatgtaaaatatatttcttgaagtttctattatttctggaagccttctccttgttgtggtgtaatgaatatagcatggactgttgtgagccaaagagacctgggtttgcattcttatttcaccacttataactgtgaccttgggcaagttacttaatccccttgagctacggtttctgcatctaggagtatggaaacagaattcactgcatatgatattcgtaaaaagtaaatgagatattgaatgtaaagggtctcaatcacttgtcacagagtgagaggcttaattcttattgatgccttttcctttttttatacatctgtggctcttgctttttaatcaaacttttctgagggtctttaaaacaccacctttacgtattttccaccatgtgctcacagtgagtccttgatctcggtgaaggacttatctttcacttccatttattcctagaattagccttaatttttttttcattaaaagattgagacttagttgctttatttgttattcaaaaaacagacctttaagctgtatgcttatatttactggggtgggagaatttgtctttgaggaaatcagggtggagtacatttgctcttgcttcttttatttatagaaagccccattatcaagcaacctgaaaaactacagtctactatagctccaagaaaattaaatgcttgtgacaaacagaggtctcaggacacacattgggcagcccagtcttcattgcttgcaagtggctgattctcagagactgtgaaggaaaagtcttagaataaatctgaatatttatgaaagaaaaccaaagcattttagctgggcttccatctctttaaacaataccagtcacagaaatgtggtttcatagtcatttaaaatacagtttacagaggaattaagctaaaccacttaagctctccaagcagctgtgctttctcagcttccttaccgagagctgcttgcagaacatccgctttgaaatcggcagctcagtcaaaaacagagctgttgatctctgagctacttgctttttcttgtcccacacttctcaggtaatgcaaaacagtggaaaaatatttggatacgagcatatatccttgccccgctttttcatgtttgaagcagccttactctcatgagtgtaagtgagcacctgaaaatgagttaaggtcacacagtgtgtgctttcataagccaccatataattgccagaatgaccgtttatattttgggggaaactttaggacttctgtcttcccggagaataatctggcacttaaagctgtgtacagtcagcctaacctcctctcacttgcacatgggagcccttggactcagcccgttggtctcttcactcttcactatggtcaaatcacattcctgtccctgtgcctgtggtcttgctcttccctactcttccagtgacattccctctgctgtttaactagccccaaccccacccattccactgctgaaagcccaagactcatctcctcacaaatagttcctacagcctcttcagttcagtttcccgtcctcattctctgccttttaccaggactgtatcggttcatttggtccttgttctcaagtagaccacagggcagtctacttgagaatgaatgtctcaatcaactgttttttttttttttggtctcagaatatatatatatattcaacattcaataaatattgtttaacagaattatcagttacatggaaaagtagaaaagcattgtcaaattgagttctattttttgaaaacaaaatatgagtagcaagaaataaatagaatgaaaacaatacttgcaaattatgtaagtaaattcaaccaaatgtgacagatggaaatttttataattgttaactatgttttatttactttttataacatattttaactaatacaaaatagtgtttaggtgttggcaaatttagttaagcagtcatgggtatcttatttaaggaagaagatcatgaaatgctctttttaaccttgttaaacaaccacgggaggagatggagactacccgtgcaaggagactgcacttatagagtttaataaaaatgtatctatcataaacttagtttctaaaacaataaaatatttgtttatagaaccctatcatggagctctctagttttgcaaatgagctatttttccacatttcattctataagcaagcatttgacacctaaatagcgagctgtagatttaacatctattgtgttataccctaaatatcaaagatttaaaaaaacactggtaggcactattgatgagaccatgaaaagagttttgaggaaaataatgcagccttttgtaccagaaaacagtaataataaaaaaagtgaatgactcatgatgctcataatacaccaaatggctaaatattactggttgaacaactcttcaactctgatttcctgagcatttttctagctaatctgtaggatttagcattcagtcgtctggcctctctgggtggggcgaggggtgggggttcatccatagccaaatgcaggagagcctccttgattgctcactagcagcccaggaatctaggactcctggtgattttccccagcggttggtttagaaagtgtgcaggcttagatacatggagagcagagtgctcggcagggcatccccagtggagcagcactggaaagctggcatcaccacattatcatatccagagtcatagtaaaatgtaccttgttaaatgtgatcttggcctctaaagaaacaaaagactacttttaagacaaaacataaactgcattacaagccagggagtagggttgatgggaggactatgggacggcagtggggggaaattagagagttgggcacagctctcccagacagtgtctgaagaaaaaagactgtgtttgttcctggaacagaccaaaaagggaggatgtgaagactgatgaaataccaaagagagacttgggataaagacagttctaattgaaagggaaagaatggcaggacaaaagttcatggggaggagaaagaggagctcagtaatgagacagcagaaaaaaaaaaaaaaacccagctgaaaactctggagaaacttggagggtgggaggggggtggggggggggggcggggcgggaagggaaaatacaacttggatatttttcgaactctagcagcaacaaggatgtttcctaaccacatctttggctgtgagaaccttgttgttggaaattacatgtaaaacaaaaatgtgtccagattccattttgtatctattcatttttaaacctgtgtttattgggcatcttctgtgtgactacattgcactacagccggggtttcagggggcatggcttgggcatgctcacactctgctgtcctggaatgtgaaggaattggatcctgggccatgaaaggaaaagaggaaggaggaagagaaggacctggcagaaggaatgagggtgaagctggagtgacttttataaaatataaataaatcgcatcacccccttgcttaaaacccttccgtggtatctggtgctctttttttaaggaaaaattgtattattttaattatttttatgtacagaaaactcaacagtgtacatttaagccactttggtgtgacaagttctttaacctttgcctcttcgagcttggcagtgcgagccacagacttgggacccagcatctggttgctcttgagatcagtccaaactccttgctaggtgctttgagacctgcgttacctggactgagcctcgttctccatcctgtttcatctgtctttctctctctttctcagatggtcattttggggttgcgcttgattcaagtgcacttcagaggtggtcctgggtcagaagactggctgcagagctggccccactgttaggccactgcaagaatctccttgcctcttttccttgcattgtccccaccttgtcacccctatagggatgctgtaaggatgaaggctttgctcttgctttgtttgacctatctgaattggaggactcagaattcttctttctcctttcatttccactcaatattgagtccctcctaaggcctgtgaattatttcttcatatttcttggatcctgtacctttcatgtcattcccagagctaaaaccctaactctagccattattacatcacacctgaaataatacagcttcctaaatgctacccccatctgttcctcctcccacccagattaactggcattcaggacttctgtgtccaggagccagatgttttgtattttctgttatattatctgacagccctagcccttcatccatgcatgtataatccatgtaaagtggacacttatccctggaagtggtaagtcttgagctgggctctgaggcatggattaaggtttagagaggctgaagggcaggacagggcctcctgggcattagcaagggtttggaggcaggtgtgctggggccagtaagtagagcagagagtaatgggaaatcaggttgcattgggctttggctgccttgtcaaggcattagaagaataggaatcagtacaagaattatggacatttataggttacagactgggttcaagtcctattgctgtcacttattagttacatgaactttgaaagtactcagatttctcacctgttaaagaggcaatagcacccctcacagggttgttttgaaaatgaaatcagatcatacatacatgtagctcacagttgctcatgactagcatgtagtagaggttggccgtcgtaatattggccatcatcatctttatcatcatgacctttgtcatgatcattatttttttggataatggtgaatattaaagatttggaattttttaaaaacgagaggtgagaaaggatagcatggtaaaagctatgctttgaaggtgtcacatttttaggaggttagcttggaagagttctgaagaggcattctcactcaagtgtggggatagctgggctactctgccaacagctatgatgatgtttccagacacagtataaaaaaatagaccaacaaggcttgataatccacaattgtcaaaaattagaacagagcaggagtcttgaagccagggaaacttcacagttttggaggttcgaacttgtcagtgaccaaagtgaagtgatctgaagccaggaggtaagtcatgatggcgaggagaagtccagtccagaggaggaaggcattcagattctgagaatgaggcagattattggagtggggccggtggagagaccccacagaggtgacacaggtgacactgaggcagtggtggtatgtacttctctgcttcagttaagggtcaaaaaaggctgaccagaggtgagaagaaggaaagcaaggagggaaggaacaatatcaagcactcctcctgagaagtggctgattggaaatgtgcccatgaaggacacagaggcccaagcttacatttaggaaatagttgaaacactagggaagcaggaaataacacactctaaggcagtgattctcaaatttgagcatgcatcccaatcacctggggggcttgttcaaaccaggttgcagggcctcatcttttgaccttctggttcagcaggtctgaagtcaggtctgtgagttgcacgtgtggtgaggtcccaggtcagcacctgctgctgctggtctaaggatctcatcttgagaaccactactttaaagggggctatcctaccaataagataaattagaaaaatgtgtatagctagtgtttcaaggtcactgcaactagttacagattatctgtaagaagacttcagagatgataaagcatgccctaatctgcaggatgaattcccaagcactcaaatttgtgaacaggtaatccaaactttttaaggctgcttgtttagcactcactcatcacttgaacatcattttttttttcttttttgagaaagaatcttgctctgttgcctgggctggagtgcagtggtgtgatctcagctcactgcaacctccacctcccaggttcaagtgatcctccttcctcagcctcctgagtagctgggactacaggcatgtgccaccacacccggctaatttttgtattattagtagagagggggtttcaccatgttggccaggctggtctcaaaatcctgacctcaggtgatccacccgctttggcctcccaaagtgctgggattacaggcttgagccatcatgcctggcccacttgaacatcttgatgctaagaaaggagaggaaaggcagttctggagtgaaggagtttatctggcttgttctgttctccgtggtatgaggacatttgcctttgatacgtttaatctctcttgttcagggtgtgcagtgcatgtggctcaggttgaagagctggtctttcccactccttgatttgcagggacatagagtgaataattaataatgagaaatcatgttctgatcatgtgcaggttctcctgccagaagaatgcccattgaggcacctctctagcagtagagaaggaaccgttctagccagacatgcaggcttgccccctctttgaccaacatgccaggcagctttggaggcgggaggaggaaaggcaatctgtttgtgtccattgtctagagtctcattagcaccagccctggtcaaggactaataacccacacttttgtccttcctctgcctttgtctgaatcagcttctaaacagtgggaggaccacctcaaaggcaggagattggtgggctacagaccaagatggacttcctgtatcttagtattgtggcagtggattggtttcatgcatccttggaaatagttactcccccatgctcccaaaatgagaaccaacttttgcaagttggctaaaaaaaagaaagaaagcaagctagttaaatccctttgattaatgctctaccactattggcaaaaatagtctgttaatatttttatgtagacttttcctttggcttgtttgcttaaggtgagctagtgtctctttcattacttgcacctctggttaggagccagagcctagttcatggttctatcctgggtgggaaaaaacagatgttaatgtgtttgcatcttcatattcatatagaaatattattttttagttctcttgaaatttcataaactgatccttgctaagtaaagtggtcctgatctaaaaatagaacagagctcttgagcggaggtgggggcatggtgccacacatatgaaagagagctggacatggtaatatggtttggctgtgtccccacccagatctcactgtgaattgtagctcccataaaccccaggtgccatggatgggaccctgttggaggtaattgaatcacgggggcaggttttcccatgctgttctcgtgatagtgaataagtctcacaagaactgatggttttataaagggcagttcccctgtatgcactctcttgcctgctgccacataagacatgcctttgctcttcctttgccttcttccatgattatgaggcctcctagccaagtggaactgtgagtccattaaacctcttacctagtctcaggtatatctttattaacagcatgagaaaggactaatacacatgggtaacacatagaattagggaaatggcatccttgccagtcttttggattatgagtctgatttttagtctctattcactaataatgctatgggtttaataattcagttgtctgtagttgtgcttcctaatctttttgcattaatatcagagtatttgcatggaacactgggataaatgaaggaggtagccccatcctcatcccagggctgaggatatcagttgcttacaacacacttgtgaccccttagtggcacaccaggtgagaagctctgatcttgggcagaattgtgcatttgatctgtttgcaagccttttagctttgacctgtttcatggccagagctatacattcacccaggcagggactgggttgataggtttattggaagtaccaggcaagaaggcctgaatggggcaccagacctgttactcctggaaaaacaattcaaagcacatttcatctatgacatcatgaatcatattactattttcattttctttactcactaggaagctttaagccacttccagtagctgaataggatggggctgctttcttgtccatggctctaatatttcccctcattagaacattcctgattatttactgtatccttttgtattatggttatttttataggccacttgaaatcctttctgcgggttgtggattatggaagagagcaaataatttaaaaagaaagctcaaaatacacttcttacccatattgggtcagtcatgtctttttttgatgcagacaaaatattttcaccctttaataaaattggtaactgaatatggtattagtcataatatgaaataatgttcctttttaaatgtgatgatcatcctgctttatttccccatctgcaagatgagaataataattatccctttgaaaatatcatatggtcaaattagttaatgttggacaagcatttcaaaatgaaactacctaataatttattagtggctccactggtgtgcaatttgagaatgaagtctgcgtttgaggaattggcatttgcattaattcatgttttcccttaaattcattacagaggtctagtctgaattctcccggctgggtgccagctgtgcccatctgtggcacatggtctcgtggccttttcctccagaagtcttgtttgagtaatcagaagtcatgtcctaaaagggaaactgagcaaatgaaattgctcatgtacttctcttaaatggaatcacttgtttgctttttaattaagatgagacttttgattaaagcaaaaatctggtggcattttattttctactctgtgcccctcgagatccattgcttgaccctgaaatgaatgatctcagttatatcttaaatgacatagtgaattaactgtatttcatgtgccagcatttccttcatgttacttagataattaagttcttcctaattcagaaagcgtgacatttttgtatggtcacaaagacagccaaggaggacaaacacataataacgaactatagtaatagctatcattcattgagcacttttgttccagaagctttgtgcattattatctccagtacaaccctgaaaagtatttacagatcaggagcctgagatcagaaagatttgactaacacgaacaaagtcacatagctaaagagatgggttgctgggatttgaacttacatctatctccagagctttgatttttctgtttaatttgtattttataaacccaaatcattgaagcatatttatgttttatttctatacacttcaggtaaagctatttttttaaacaatttattgaataccaagaagagttatgtcctgatggagtggggtcagattaaatgattctcctgttcacttggagctataaaactatataaatctatatgtgtgagaaactctcactgtatttaatgtgtttttttcagtgctactgtctacaggactctggcaaattgctgtcaaataaaagtcataaattcacagaatgcaattcctcgttgtcaatgaaatgaaatgagaaaatttctcttttcactcaaatgggctatacatttatacgatctaaattcccatattaacaaaaaaaattttagttgtttgctttccagttaggttaggatatttcttctgtttaagttgggatgtgccaataaatagggtttcccattgcagctcacaggcagagaaagtgaaactgcgcttggtagtcttttcatccgtatctgttcaacaacaacaaagtgatctccccaacctgaaaagagattgatttgccttcaagtaaatacctagttatcagtactcttagaatctgttgacttttgaagctttgagatttgatttttctctaagaatatatgcccagcactataccattctgtctgaactgcttaacaaagaacatctagaagtcatactggtgcccatatttaaaatatttatttaaaagaaactagccacagatggaaatatttctaactaaaaattatctttctcaagtataaaaacatttctcaaaatgaaatatttcccatataaagtcacttcattgtgggcttagagaactttattttccattgccaataaaagcctttgattggcgagcttttcttcgccttaaatttgaaactggagtatgtaagcagagtgtggatctgagtggaaaaactggcctaaattatgtgagtttcagaaatatcactccatgtttatttgaacagtttcctctaaaggggaaaattttgtttaatatttgaatatgtttatttataaaaacgatagaataatcagtagacatttgtgttctattagatctgagttgttctccattttctttttgtgttttccatataagggccgaattttcatatatcttatgacagagtacttacctgaccattgagaaatagctacgatttcacatctgacctttattatgtgaccattcattgtttttttgacatacgcagccttccctcggacatttccctgtctcttaaacccagttttgccgctttgtcctgtcttggattccgcacgctgcacaaaaaatggccagtagagggcgctgctggcttactttttagaaaactgctcacagcctgatttcagcactttcaaaaacatggaaattatcttaattcagtcaaagcaatcagaacgagaaaactgtcttaaattcatcaaagttgtttctttgtgtctttttctatttcgtttccccaaaggcatcaataaaaccaggcaattagtgtttcttcccttttctgcggagcccttagctgacccacagtaaggatgagtatggtagttgagggcaaccgggtgtgattatctaatttttccatcagcttgaggttcttatgtgaaagttgtattcatggagagccaaaagaaggggaaaataaaagcctgtttacactttcactttccaaccggccttgccagttatcccctgacctggtgcaatgacgagaaaatatctgtgcgaccttggcctctggattgtggactggggacggggtgtccgtggcttcggtagcgagaagcgggtgggaggggcatgattttatagactcaaaagctttctctcctttcaggcaggcagtgctgagaggtgatcggaggaagaccttttatatcccttccagcacctccattctttgagatgaactattgacagtccctcaatatttataaaatattataaactgctatgtaaatacagcgtcaagtcgaactttctagccagagctctcccgagtacccttccaaagaaaatgctatgcttaagcacctcctcctgagacattctggaacccccaccacttatataggtatatttacagaaccccatccccaatcccttcagtcattcaaaaacggtacaagttgctgaagacgttgtggtgaaatagaaagtatcaaaaataccacgggaattgcatttgctagtcatctttgtgatggcgtcagtttgtgccaacagcatcgtgataaagttctcagtggatctgaactttgcttcatgtggtttttcttcaccttgtgggcactgggcactcgccgtccttcatagctggtaggtgccacttttggccggccctgtagctggctgcagtcggctgtccttccacaggatgaaaaatgtcttccattagctaatggctgtgttctccgtgaaacattctgccccttggcctggggctgcaggagagcatcaatcaagtctcttagatgaggcctcagaggaccaagggaaatttgtataatcctgaactgtaaacatgaggaccagtggttgaggtttttggatttgaacaacatttaaaaatgtctatttgagtatctaaagtaaacctttattttaaagagaagctgaggcttgctgggtggccttcaggaggtcagctgacctttctgcctccgtttccctgtcttcaaattggtggagggagcaaaaaaccttactcttctgttgcacaggagaatccatttaatcttgattgattacattaaataaggaagtcaggctttctttatgccacttcacaccttatgggccacattataatttccctgcctctcggtctaagtgtccactagtgatcactgcctggtgtggttttttgttggtgttgttgttcctgtgggtctgtagttttcctttcagccatttcctttctcttgttcttctcctccccacttgctaaccaaggaagaagggctaaggggctccccacccttcctggcggtggcaaaacagcttcttgttcatgagggaaattgtggaagcatagatgtaaaaaggagagaagtatgtgggtgtgtctgtgtgtgcacacatgtgcatgtgtgggtgtgcatgtgtgtgccatttagcagttgcctttttttgtgatggtttgttgctgttggcacctgtaaaagcagtcaagctgaagaaattcctttggaaaaagaaagaactaacttcctagaggtgaatggaaggttgctgaggccttaaggggaaaatttatagagagctgagttttctctgttttcctttgcattgcttatttgaaattcttcattgttagaacacagttttgtttaccatgccccccattattttcccttaaacaataccataaatattatcatttggggaacaacctcaatttcccagaattcatgacttttccattttaatagacaatgtatcagaacttaaatcttgtgagatcttcttaaaagagtacttctcaacagttttaggaactgttttttactctagcctttgaggacaagatgggagggacactgaagaagttgttccttttgtacagagtaggcaactcagaaatattatggaatgacagttgaatgacaacatgctgattgtttgctcagtaataaactagagttttgctgtgtatttttatatattcatataaggctatgcattcttgcaaattagcaattaattctactgaaatatctgaataatgttttccataggttacactatccccctcacaaaaataaaaaaaaactagacataatattttgttgctgaccctatgttacagacttagaggtttttccaaagactaggaagaaagttatttctgggttggctagctagaaatatgctatgctaattttatctctaaataccatatgatatccattctattttcataaatatagattaatttcacaaacagagttaatcaggtttgatgtttggtttcatgtttctaaataatttaaaaatcagcttcttttcatggccacttctaggtaaatatgtaaaacaaagtaaaagagaaaaagttatgacatcatatgagaaaagctgcaacaattcatagttttaattaagaggactagttggactctgggcaaacattttattgtccaccaactaagatgtcctctctgtgtgagctgtcacataccaaatctaaaaatctgtttttgatatttaaaacagctcaaaatcaacatgaaaattggcatgctcttctcatatataatttggggaaaaatatgaagtgagaacaggaaagatgtattaacttcttaaaaagtaatctttaggagcaaactgaaagagttcccagtggtcaaagctggaactacttgagcaatgaaatgaatagcgtattattggattattctcaaaagtagaaaatacatagccaggagtccataataaagtaaacgtaaatgatgtaataaataaatataaagagagaaaatagacaaatctcccatacagaaggatctcagataatttatgtaaattttgtatcttcaaggaggtgaagcatagctccccacacctgaagtgtggggttgtgcatagcaactcctttccaaggagcacaatatggaaagcgggggaaggagtaatcctatagtcgaggaactggacagacactgcttcagccaggcgatcaaagtcaacatcaacagcaatgaatcatgttagtagcatgtgcctttagaatgagatgaggagcatggcactttacttctgtagtcttcctcccccacacccacaaaccccgtctaatcatgagaaaaacatcacgcaaatttcactaacagaatatcagagaaaatacctgacctgttttcccaaaaattctcaaggttatcaaaaacaaggaatgtctagtggcacctaaggagacatgatgaataaatgcaatgtggtaccctggataagatcctggaacagaagaaggacattaggtaaaaattaagaattgtaagtaaagaatggattctagagtgtccgtattggttgagacaaatgatgcagtaacgtatgatgtgaacaatagggaaaactgggtgaggggtccatccaaaaggagactgtattgccttcgcaagttttctttacactaaaactattgtaaaattagaagttcatttaaaaaaataattcttattatcatatactgttcctacatctcagtgtcattattttcctaaatcttggttgatttttaagagatgactttaaattagacaaaagaaaacaggttctccaagatttgctatcatacacatttattattgtcataggtgccatttgcagcgctctgaataccatggttgcctttgcttataaatagacttataattttatcttacagaaggtgtttattaagaatccaaagtatgagaaagttcattccccatttttaggattgtcatgactatccttggaggaggattctctgagtaacttagtagtaggtggccgctttcacattcagtcaagaattgtgtaattttcagttgatggtttagaaacaattaaatggtctccccctttctgtgcacattgctattaatgttacagctatgttcataaaaccaagattgttatagtctttatcgacatgacattgtattttcttgcattagtaaatccagtacttttaaaagaaagttaaatatatttcctttgaggtgaaaaaacgacttttccatccaaaaactggaactgttcataagatgtgtaaaatttaccctgcatattgataaacctatcaagattttgggggcttcattgtttcatgactataaagagtatgttattatgactatgaaagttcaaaaatattacagattcctaaatatgccatacatctagaggacaaggagacactttctgggagagcccttgtgtgaggcccaagccccaatttcaatccattattacctttgtattcatttcagaccaagtctagctctttccacagtttccatcttagtgttcaactacagtctgggacagacttttctgcctacagaaagaaacacatggtctgggcttcatcatcaaaactccttgtgtgatcttggggtctttgaggagccagtgggttcttcaattgttctcttgtctgcacacaccctggtcaccttccaaaatgaaatcccgggagtcaaatgtgcaccacatttatgagcgtgttgactgaccagtgactcatgagactatcacacaactcatgatgaatatgtcgttttcctctttaaaatgactgctgtgcaatatggttgtgagcagtgtgatcctacagtttccttttaacccagtaaatacttgctgtcttattctttgaaagaatagtttagtcattttgaaagaactgagtgagcaactgctttgtgcaattactgagtattgtatctagacttgagacaaaataatgtcctagtagattttacttcatcttttaaacacacacaagaatttaaattgttaactagaacacacttgaattttcccatgtttaatcattaaaaaggcaaaacttaatttcatcaagtgcaatcaaagaatttttcatagtagcaattaaaaaatatgaaactggaatttcaatgacacaaaattaaacagctgctgtgttatatttttaatcttcattcaaatcaaatggcaaatcgcatttttcttcaggatttttttttcttttcttttttaatattagtgtgtgtaaaggtggtttcagtaattcaaaaaccttctgaaacatgctgcggtatatttggaaacatatttcaaacgttactctagagtgagtaacccttgtatttctgtaggacacagaaggcaaaactctttggagaaggactgattggttagcttgctttggcatgagggaacttccaactatattgagctgtttaactaaggaaaccaaaacctattttgctcggtttgcctttctttctgtactccatgtgtggcatttaccataagagaaagtaaaaaccacacatgaagcttgtgtccttctcattccttcctatttccatgctgggggagaagggctatttttgtgatacccagacttccccacacttttatgtgtaagacaacgagctgggacatatgtagctgatatataattagccaaatggtatctttttcaccccagcacaaacacgttccctctgattttcctcattgacttttaggtttaggcactaaggaaaagcagcagcccccggtcaaaccaggactccaggttttgaaaaaactacttaaatacttttaaaaggtagaactatttaattatttgtcatttcaaagccttccagtccttcttagtttacctccatttttttttctaaaaatggaaattgagttctttggtcttgagcactcttagttctaaagacgtattttagctcattagttctcatcaaacttctctcctgaccctattctcagagcggatttttctaaagtcatatttgcatttttaattcaaattaaaattaatttcaattaaaatttgttttaattcagagttttaatttcttcagggaccttctgttttcatatcttttttcttgttgcacaggggattgttctgaggcttagctgttctcacaccagccaggactacacgtacagtgacttaagtggtaaatcagtctttgggtaaagacttcagctcaccattttctttaattataatttactggataataagggaattgctttggctagtagaatttatttgaccaggataaggtaggacaagaactctgacttattcaatgtgaaaacccaatgaccattaggacatagttaataaagcaatctgaaagagtcactgatagtaatttttttaaaaaatagagagaccccctacactgaccttgtaaatagtcttagtgcccaaaagaagtaaaatgttggaagaaagccagtgacaaagaacttgtatttcgcttattttgccatcgatgccttatgaggtttcttgtgaagcttaatgagacagtgtaaaccctgctttgtaaatgtaaggtactatccacacgcaaaatattattattattactaaattataggttgtgttacatggaggaatactgtactcaaacaatcatttttgtgggataacaacattttgtagcttatttgcaaaagttctctacacagttaaaacaatggtatgttgattggaaagcaatttaaactttcccataatatttgttcaacattcttttcattgctttaaacaagatgcacccattcagaaattatataacatcattgtacaaatggcatttgagtgaaagggaaggttataatgaagtattatctaccaatacatttttaaaaattcaggtcctgcataacaattacttactggaacttaataggcataatggctatcaggaagtgacaccaaggcatgggaagaattttgtatgttcttcatattgggcacctctttatagccgtattatttgccaaggaaaaacaagagagggtcattgctttgtactttggggccattattgagaacagttttccccattggagtgtgatgtcatcgacctattggaaagcatacatgggcactgaatggatgatttacagagcatctccccaagtttctttgcactgctgggtttatgaaatgaacatagtgattctgagatacaatcttctgtgttttgtatctcaaattgtcccattgctttggtagtcctgattaacatcttaatttctaaatgtgtgttccttccaatacaatagccactagacatatggtgctactgtgcatttgaaatgtggctagtccaacttgtgatgtactgtaagtactaaatacacactggattttgaagatagtgtgaaaagaatggaaaatatgtcaataatttttatatcggttatgtacggaaattatgttggattgttattagagtatattattaaggttactttcatcttttctttttgctttttgaatgtggcactagaaaattttaaattacatatgtggcttgcattgtatgtccatcggacagcagtgagctagatgggatatggcatttttctgcttctgatgagaatgcgaaatgtggaaacacattaggtcactcattagaacaattctgagtgttccttaaacttcagctaattttgatgggaggctgagaattagatcaagctctgtttatccaaaaacaaagatgtggaaagctagtacagcacagtggttcaacttggaatctgctgaagggggagtatctgtctgatcctgatttgtgaaagaaataccgtaaactgcatgggcaggaatggaggttacatctttgatctatcctagtcaaaagtgggctctctcctagagtctcttaggtgactattaggtggccttagccaaagcttttataatcacacagactcacccaaggacagccctctgatctctcaaggagaatgcaatacaacatagactttggcaactgaaaacctcaaacctaatccttggtgacttaaggtttctgttggtattcacagaaatgcctttggcttgtcaaaatacgagttgcaatatttgctttagtatctgctcaccatcccatcccttctctctaaactcgttcattaccattaggatattctgggtggctgggatggttcatgtaagtggggacaagacttgccaatatgttatcaatgtcttgagcttaaaagtacatgtttggatgttcaccagagtgaaaatttgtgtctaatcaccccctttccacctcccttttgatgaaaatcatcaaaatgtgagatgaaaggatctaatgggttgtctgaatgtttttcccagccctgttggaaatgattgaggcattggctcttcaacatttcctctgagaaagcaattccaaaggttggtgtcaacttacagcttagtaatggactaatacacattatcctgtatgcaactctaaattatagcctgccagctgtgattctggaagtttggaataggttccttcccgagattctaaacagaaatggctttgaatgttgcgggcatgagtctgtctaacccttctaaaggtggcataaacgctgtaacatttctattgatttttaacatccagctctctagaaaacagaaaatagccaaaatttgacaggcattttacaaaataatctgatccttcatagatgcagagtaagagctttgttcacaagtgacatttgtgcttaaacttggatcaaaccttccttgtttctttcttatgccagttttattatgtggagttgaattacattttactggatttaaaataatgctttaaacgttattttgtcttctttagtttttctttttatcatttaaatatctgtagcctcaaactcataaaaggagagtacaaacttctaataaagttccttaatatttaccctgatgcataaattaaagaaatccaaatttaaacaaggagccctgttgcatatatttagttgtcaaatataatgcccagggttggcaagggtgtgcattaagcagctccagaggagagtgctacaggagttaaaaatcatcttcatcttgctgaaaggcagcttggttttactgatcatcataagatttcaaacaatgtacatactgagcaattcaatttctgggaattgttcctgcaggaagtaattaagaatgacaggaaagatttaactagactgtaagaatgctcattgcagtattctttataatatcacaaagtaaaaaatctagaaatactattactggtagactagctatataaattaagatgcatttatactgtgaagtactatttagccattttaaatgacagcttataatatattttaagttaaaaaaagttacaaaataaatacattacaaaaatgtatgtgaatctgatttgatactgataaaatgatatctattttatacacatgcatagaaaagactgaaatggttacaaaaaatgattaatgttggttatttctgaatgttagaattataagggttttgttttttatttttagatgtatttattttttccctttgagaaggtacagtaactttggcttcatggacagttttccgaaactgttttcaaagacattaaaattttcctcatctctctatacgtggttagatgaataaaaggtacataaacttaaagtaaggataagacacaagtgagggatgtgaaggaaccacactgtgattcagactacctcctctacctgtctattaactgtcttaatagctacactgttgaccttgttcttttataatcataatgatccacctgccctctcctgagactctttttcaacatggacagcacttgtcgtccctcccatatcatattgtgtttaatttaatctttagcagatagatacagagtgtgtgttcaaactagttttttcatttgttaaggtgctttggaattgtaatccaaatttcgaacaaattatatactcaaaatatatgacaatacaatgaaatttttgtaaaaatattttaacaaactgacctcatgagcaaaaactgctgtagtttttaataattctgtttacagatgattttattccagtatgtgaatcttcccaagcaaagaggggaaaaaaagtgttcatttttaaaaatgacatcatggaagtccttaaagcatctaatacaagttaatgaactctgcaaccatttatactagccctaatatattatatatacgcacctggaaagtcatccaacagatacttacctgaacttcaaaaagttgtcagtctagtaggggaggtgaccgtccatacaatgagaggcagaacataacaatagtcagaagacaggcaaatctaagggctacgggagcgtcacaagggaaagggaagtgttagggatggggtgatagtagaggtggcatttgtgttaggacttaaggccattattggattaactgagaatattgaatatgaatagtggattagttaaaaatactatatagatgttaaatttattgagcttgataactgttctatgggttatggaagaatgtatccctttaattaggagatacacgaagaagtatggggatgggggagagagtgagaggatggctgagcaaatgataacatgaaacattaacaatagttgagtgtgggggtaaagggcatacagacactcttcatactatttttatttttgcaatctaaccgttagtttgaaatcatttcccagtaaaaagtcttttaaaatccagctctcagataagaggcaacagaggatagctgtccttattcactgccttctgaagaccagaactgatgccagctgcttttttatttcccccaaaatgtggttcacgctagttatttgttgacttcaccaaaccaccgcataatttcacacaacccaggatggagggtagcagcgtctgtttcacagaacccaaggcctgaaatagcaggagggctgtgttgtggtgtggcgtggaagcctgcgccctgccagccacacttggcctggtttcagcagtttgctatcagaccctacattatggaagaacagccagggcaaataaaatggagagtcagacttacaaaacaaagcttcctgcctcccaactagtactgccttgcttcctccttcaggatagcacccatttctgtagatatttcctggtagaaatgttgtgacttccctgacattgctgttaaattgtagttcctgcaaaaggaggccaagtcctcatttctggtgtccagataacctcctccaggtattttctcaatatggttcagacctaagttactttatttcctgtgccttttaaagacacctctattcaaaaaacacattttccagagtgctgtaagttttaaagaccccaagtgacaatgtgcctgaagaggaaatcagccccctgttagtgcaaggagctgagtggctgaagaagcccagactgtagtgggcttgggaactggctagagcctgttctctgcacgggctcccactgccacacaggctgcagggggagtatcagtgccccaccccactccccagattccaagggcgcacttaatgttcaccacgtgcagtgtttgtcacctgggcttcagtgttagtgccgccaggttccagcagtggctgttctctgttgccttttacctgagagctggcttttaaaagactttttactgggaaatgatttcaactggctaatacggccatgggcagttagtgagcttcactaagcctcagttttggcatccaccaaatggagataataatagtctccagctcctagagttgtgaggatgaaatgcaacagacaatgcatataaattatgaagcataagtggtggttcttgctgttttcttgtgcttgttaagagtattactatgtgagcctggcttctttcctttctccctcccttccgtccccaaacttaccggtattacacagttgatacaacagtgttcaagatactcctcgtttgaagataagagtcctgcaactgggtacgagtaaagtgtcctttggaaaactgtgatgtactcaacaaatgcataaagatgagcatgttttaattgtccaggcccacacaatgtggatgattttcatattctatcactagtattttctgctcttccatcctgcaatgccctaacctcccagggtgcccatgcctagaatatccctttccttcaccctgtatttattgaactcagtcctcaaaggctggctgagtgtcacctactgtgatctttgctcacaatgagagcagaagaaattgctcctggaactccctttacctaacactgtaatatgtaatactttttatgttttatgtaaccttattacataaaatgatatggttttgctttttatactcatctctcctacttgaatataagtttctggaggctaaagcttgtcatatttttcctagttccttcatagagcctggaaagtatgctgctcattaacaattgtgctggggttgtttgttgttgcttgtaaattttttgaaagcgtaaaagcatgcaggaaagtactcaaatcaggagtgtacaacttgatatttttgacatgaacataccatgaaaccagtcttcagatcaagattcagaatataaggagaaacccagaagtccatattcagtctctcctcccccaagggtaaccactacatcatagattagttatgccccttattaaattttctacaaatgtcatcatatggtacatatgcattcatggctaacatctttcatttcacattatgtttcagaagcattcatgctgttgtatgtagatgtggttcattcactaccatgactatgtagtatttcactgtgtgactatgccattatttatttatccattctgctgctgatagaccttgggaagtaactgttttgtgaactgaaatgaatactaacatctggctcttaagaaacatttcccaaggaaagggtgacagcacagaaggttagattcacgaatgctagagaagtagccctgatttctcactttttcaaagagcattgacagatggctccccatatcaagagccagcacaatctttcagaatcaggacagcccattttcccagaccatgtgatatttattctattctagcctggctggttgctaaattggtaaagatcagagagcttttgggcacagtggtgttcttagaattctgttttgctattaaatattggcctacaaatatatagctaaatgtgttttactaatgattggggtggcattaattgtaattacttgtcaatctaacttgttgctggtgtcttaatttccagcatatctgagaggtttttaaaggatttcactagcagtttggtaagtcatttgtcaataaatgatgaaaaggttgggctatttatatttcaatgttaccattttaatgggcaactgtctatgtactgtccaccgcagaaatgctttttcctcccttttcttgaggaaagtgtctaaggtggagggaggtctggttgctatggatatctgaaattttatgtttacaatttaagaggtaagctgaaacctcactatttggtctccacctgagtggcattcacatttagaaattacaagattgttattggctatctggagcttgaggatgtggctgagtcctggcagttaattaaaactaggctggttttcaatatcagaattattcagcctgttttggtaggatgtccgtaaagtcctcactaccttgcaatgtgtttttgatgtaaaaaaaatatttaaaaaggaaacataacagggtagcttgtcctcatttactggagaggttggttgctccataagcttttcagagtgggattctgcccccattgtttcttgtctgttagctctgtaggttctaggctacagtatttcagtgttcacaggacagctaattggagaacaaagccctggcattttcctggaaggaagattgcttcatgtgatgcttattgggaagatcgtagaaaaactggttaattcagagtattgctgcattaaatgtcaggtgaaatattttctaattattcttttattatcagtttaatcttttaaatatgtttttaagtatagaagtaactcatgaatactttttttttttttggagacagagtctcactttgtagcccaggctggagtgcagtggcgcaatctcggctcactgcaacttccattccacctcccagttcaagcaattctggtgtctcagccgcctgagtagctggaattacaggtttgcaccaccacacccagctaacttttgcattttttgtagagatggggtttcgccatgttggccaggctggtctcaaactcctggcctcaagtgatccacccactcggcctcccaaagtgctgggattacaggcgtgagccactgcgcccggcctatgactacatttttaacttaaaagaatctaataatactgataaagagaaaattccacttgacttattttcatcagttctagtttgttccacatagatattcctttcatcagactagtttgtattgttctagttcagaggtcagcaagttctaacccaaaggccaatccagctccctacctgtttttgtaaataaagttttgttgaaacacagccacgcccatttatttacatattgtccctggctgctgtcacactgcaacagctcagctgtgtagccgcaatacagaccacatggcccccaaagcctgaaatgtttactgactagcgctttacagaaaaattttgttgatctctgttctagatcattttcgtttgcattttttatatttaaattaatatacagctaaatgttattttactattgattgtggtggcgttaatcataatgacttgtcagtctaacttgctgccagcgtcttaatttccaacatgtctgaaaggttttaaaggatttcacaatatgcaattttatatttactatttatatatgtataattgtgtctatttttacataaatggtattatatagtacatattgctcaatacctatttttccatttaacagaataccttcaagatttgctgttcatgtcaaaatatgttgctctctacctcattctgtttagctgtcacatattgtccatagcaggataaagttaaacttattttatcatctcctatgggtgactatgtagcttatattcagcttttactgttgaaaggaatgcagcaataaaaactggcaaaagtctctatttctcctaccagtactggaaaatcacatacacactatggcggcacattttcacaacagagaaattaatgtgataatcatggctactataaagaaaaaaggggttaattaacttggtcagggacttcaaacatgacagtgggcattattcagaatggacattttatgcttctaattgctgggcagggactactctagggaaaggcctgagcagaatggaaaaatctgtctacctaaaggacatatgaaggaattagaagtgtccttgggtagggtatttgtcagcttgaccccgcctgagaaaatgtcaagatcacactgcatatattagaaacatgaaaccattgaatatgtcaagcttctaggaacttccacaattatcaagttgaaccctttccatttttagatgaggacaccaagcctcacaaatgttaagtgatttgttcaagatcatagtagtaggtttcgatcatggcttagcttgtccactgacactagaaccaggggctaaaagttgaaatacctgatttttacaactcagaaggcataagacttacagtagcacatcattttaaagttttctagtttgtcagactatctttatttattttttaattttttttttttttttgagatgacaatgtctcactctattgcccagacttgagtacagtggcacaatcatagctcatttcagccttgaattcctgggctcaagtgatcctcctgcctcagcttcctgagtgtctgggcctgcaggcttgtgtcatcacacttggctaatttttaaatgttttagtagagatgggggtctcaccatgttgcccaggctggtctcaaaatcctgtcctcaagcaatcctcccaccttggcctcccgaagtgctgggattacagatgtgagccacagcagccagcacagagaatctttatttatactttttaaaaacataatctctaaatatgaaaattcatattagagtagcttcatttgtgataaaatatcagctgtcattgtctcagcaaccacagcaaagaagagtccaaatgaatccacagccggtttgagattctcattcctaacaatgccagtctgtttgttcatgtgtattaaagtatcattagaaaggaagcagcctcagatgaagccattttagccattgatgtgtctcaaaagggttaatcagatacagaaacttaacaatttctagaattgtaaggaaataattttgtttcttgtaaagcaagagtaataattgatgctcacgtgaattgacatttttggtagcttagaaatggcaccaaatgtgggttttggcaaaacctatattttcatgaagaaatggcttttaaacatgttggcatttctgttcatgatagacacaccatttgaatccaaacccttgcagaggtgacatgacactgcactgaaggcagtgacacattttttttaaaaaaaacttcacataaaattatgtaaacacttaaagtgaatgagacacctgcctttgagacacccgcctttcagtcgcccttgttatgccacccacagccttttctccttggctattcttagcaggatttattttgagcctagtggtggtaaaagatgtaacataaaatgaaacccgacacttagagctccctattattaattcataaattcagtctgggatcacccattggtgccaatgaaagattagcctagagaacaatcacggttcacattctatacagtagtatagaagaaagtttgccactgataattgtatttatgtaagtgctagcaataattgcctggtggtcttggaacagtgataaagaagaaaatgaccagagtaaactctgctgttcaatttcttggactaaaaactgcatggagacaggaaaacagcctgaaaacaaccaaccatggcccccctcaatgatttggagaaatgaaacaattttggacattttcttaggttaatagatggttactgagtacttctggagttcctctagggtataccggtacactattaggtactaggggtcacatgttaaattacaaacaaaagctttggttcccaaattatagcccttgttaggaaaagcaaagaaacaaaacatgatcaacatataagtgggaattttttcttagtaattcaagtaattcttaaggcttccattatgtaaacctgtggctgaacttataaaatactgaaacaactcattgaaaaccaatcagttacatatccacaaataaaatggtatgataaatagttctttctcatagacactgttagtttgttgtcttggcttcatatgaacagagaatgaaggcaagtcctcattgtaaaacaccaaagtcatagaataaagaactcccagaactggaagagactttaagttcacctggttaactgccaatatcatcacatgtattatccacctggtggattttacttgttttaaaatccctgcctgacttctccttgcctctccttgaattttaaaattgctatctcatactatcacttgagactgcaaatcctttttcatactagcaaaataaaaatataagaatataaatatacacaaaactacaaagtaaaaggaaatgacttgtagcatctcaaagttaagaaaaaacaccgaggcttttttgttcttcgtttttttttgtttttgtttttgttttttgttttgtgtgtgtgtgtgtgtgtgtgtctgtgttagaaacacttaacataagatctactctcccaacaaaaatttgtaccataaattattgttaactatagatacaatgtcctatagcagatctctagagcttattcaccttgcttgagtgaaatgttatgcctttgattagtaacttcccattttcccctccccctcagcctgtttaccaccattctgctctttgattctatgaatttaactattttagagacctcaggtaagtggaatcatgcagtatttgtctttctgtgactggtatatttcacttagcataagatccccaacattcattcatgatgtcacatattgcagaattttcttctttttaaggctgaatagtattccgtggcatgaatataccacattttctttatccattcaaatgtcaatgaacatttaggttgtttccacatcttggctattgtgaatagtgtttcaatttacataggagtactaataacacttcaagattatggttgcatctcttttggatggatactgaaaagtgtgattgctggatcatacagcaattttatttttatttttttgaggaactgccaaactattttccatagagactgcaacattttgcattcttgctaacagtgtgcaagtgctccaattaaaaagcttatgcacagcaaaggaaacaatcaacagcgtgaaaaagcaacctaaagattgagagaacatatttgcaaaccataaatctgataagtggttaatgtccaaaatatataaagaactcctacaactcaaaagtttttttaaaaaaactaataccctgattaagaaatggacgacagatttaaatagacatttctccaaaaaagacatacaaatggccaaccaatacatgcaaacatgttcaatgtcaacaattatcagggaaatgaaatcaaaaccacaatgagatattgcctcatacctgctagcatggttattattttaaaaagacaagtattagtgaggatgtggagaaatttcatgtttttttggtcttagctgaagtatacagtaacacagataatttctttctttccattaaaggagctagtcagatgtgacctcacgtacctcacatttctcataatactctcatccaactgctaaataggcaagcaaatattaaattcaagaatggtgtgtctgcaagagaatagttattatagagaagtagttactgagaaattaatgaaatatgtgtatttgtcatataaaataaagaactcataagagttcaattatatacatggctgatatgctgggaaggacaggaaaataattgggaaaactaatgtcaaaacgatagctgagtttttagtaatgaaccatttccctggacttgcattgatgatagtcacaagtagagtagctataatctaaacacttcttactaaaaataagatcctagaatatccatagactgggaagttggccatagatagtgcccagatttatagaaaccaccacagaatggcttttcatctgtatctggtttttaggtgaaacaaggtgtgtttaaaaagcatatactggaaaaagagaaaaaaagaaaaaatctgtagaggaaaaatataaggaagagaagaaaattaccaaaaaagagtactgtaattagtacattttgtgtaatgagatgatctcacgttcagaaaacaagaacaagatgttgtggaaaaagcagaggacaatagtttggaaattaaaaatacgattgttccaggagaaaaaaatcagacatagccagaatatggaataatctataagaatgtgaatgtctactaaaagggaatgtcattttttaaagtgtgtatggaataggtgggggacatgattggggacaagactgtattaggttaaaagattccaaagagaagtaacagttcattgtagcattattcacaatagccaagatatgcaaacaacctgtttgtccacaaaggaatggataaagaatatgtcttcacacacacacacacacacacacacacacacacaaatactattcagcaattacaaaaaaagaagaaatttgcaacatgaatgaaacttgaggacattatgctaagtggaattagacacagaaagaaaagtactaccttatctcacttatatgtggaatatataaaaattaaattcctagaagcaatgtcaattaccagaggccagagtatggggaaaatggggagatgttggttaaagggtacggagtttcagttacgtagggtggattagttctagagctctaatgtgcaccatagtgactatagttaaccatagtatattggatacttaaaatttgttataatagtggatcttacatgttctcaccacatggacaaaataggttaactatgtgaggtgatgggtatgttaattagcttgactgtagtaatcattctgcaatgtagatgcatatcaaaatgtcacattgtatacctcaaatatgtacaatttttatttaaaaaaatttttccaaattcgatgtatggaccttaatttaatcttcgttcaaaaaaaaaaaagcacctatgaaagacatttagcaaacagctatagatatatgcatgtagatcagatattagagaatattggggtattatcattaattttcttggtataataatggtattatgattggtaggagaatgtgcttgagttatgagatgtttgctgaagttgttagtgatgaagcatcattatagctgaaatattctaaatggttccaaaaatattaaaacaaaaaaatgcaaaaatattattatactttaccttttcctattacaatgacaatccatttttaatgtagaagaaataaatatatacagaaaaacaagaagaaagtttacaaccaaccataaacacagctctcctccagacactgctaacaccttgatgtttgccatgtatgtataatatatacttatatatgtatacctccataatatataatatatatacactcacacacataataccctaatttattgtacccatctcctccagtgagtggagttttacttattacttgggcccacttcttccttttggtgcctgaggctttccttaagcgtgcaaaacttggggtgcttctcaattccctcttgttgagaccttagcagtttgttttcttatccattctgtcaatgagattttcctctcatttgcattagcccagaagggcaaggagcatttttatctagatgagtgtatcttacacataacaaattggttgcatatctttgctcactgatactttatttagcaggctaatctgataaactatttctcaagttataataacattcaccatggtggtaaacttgataaagtttctgagtctcgaaaaacagaagtcaattgcttgcaactacattgcattgtaggtaatccaataaagaatttcttttcatgttgacaggataaaaattggcagggagcaggggaaggtgttaacctgttagggaaaatgcaggataatcacatatggcattttattgctttggaatctttttattgtaatatcctcattttggatgaggtaacttggcatcagatagatccagcttcaaataatggctctgttactttttcaccttggacaagttattgattttttctgcccatttttctcatctgtaatatggatcatgaggtatgtatggaaatctcataggtctgttgtaaagatgtaatgagtaataaggtcatgtattgaaagctttttgtaaattattaagtgctaatggtggtgattggggtgggatgtaggtagtggttgtggtagtggtagtagcaagaattagcagtagcagaaatagtgacacaagtaaaaatattagcaatggatcaccttatttatttttaataaataaaaaaccattttttgtgatgttagggtgtcaattttggatctttcctgctttctcttttgggcatttagtgctatcagattccctctacacactgctttgaatgtgtcccagagattctggtatgttgtgtctttgttctcattggtttcaaagaacatctttatttctgccttcctttcattatgcacccagtagtcattcaggagcaggttgttcagtttccatgtagttgagtggttttgagtgagtttcttaatcctgagttctagtttgattgcactgtggtctgagagacagtttgttataatttctgatcttttacatttgctaaggagaactttacttccaactatgtggtcaattttgaaataggtgtggtgtggtgctgaaaaaaatgtatattctgttgatttggggtggagagttctgtagatatctattaggtctgcttggttcagagctgagttcaattcctgggtatccttattaactttctgtctcattgatctgtctaatgttgacagtggggtgttaaagtctcccattattattgtgtgggagtctaagtctctttgtaggtcactcaggacttgctttatcaatctgggtgctcctgtattgggtgcatatatatttaggataattagctcttcttgttgaattgatccctttaccattatgtaatggcattctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtttcttttaattggagaatttagtccatttacatttaaggttaatattgttatgtgtgaatttgatcctgtcattatgatgttggctggttattttgctcgttagttgatggagtttcttcctagcctcgatggtctttacaatttggcatgattttgcagtggctggtaccaattgttcctttccatgtttagcgcttccttcaggagctcttttagggcaggcctggtggtgacaaaatctctcagcatttgcttgtctgtaaagtattttatttctccttcatttatgaagcttagtttggctggatatgaaattctgggttgaaaattcttttctttaagaatgttaaatattggcccccactctcttctggcttgcagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaatgttggcctgccttgctagattggggaagttctcctggataatatcctgcagagtgttttccaacttggttccattctccccgtcactttcaggtacaccaatcagacacagatttggtcttttcacatagtcccatatttcttggaggctttgttcgtttctttttattcttttttctctaaacttcccttctcgcttcatttcattcatttcatcttccatcactgataccctttcttccagttgatcgcatcagctcctgaggcttctgcattcttcacatagttctcgaaccttgactttcagctctatcagctcctttaagcacttctctgtattggttattctagttaatacattcgtctaaatctttttcaaagttttcaacttctttgcctttggtttgaatttcctcctgtagctcagagtagtttgatcatctgaagccttcttctctcaacttgtcaaagtcattctccgtccagctttgttccgttgctggtgaggagctacgttcctttggaggaggagaggcactcgctttttagagtttccagtttttctgctctgttttttccccatcttcatggttttatctacttttggtctttgatgatggtgatgtacagatgggtttttggtgtggatgtcctttctgtttgttagttttccttctaacagacaggaccctcagctacaggtctgttggagtttgctagaggtccactccagacactgtttgcctgggtaccagcagcggtggctgcagaacagtgggttttcgtgaaccgcctatgctgctgtctgattgttcctctggaagttttgtctcagcggagtacccggctgtgtgaggtgtcagtctgcccctactggggggtgcctcccagttaggctgcttgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccgggctgctttgtttacctaagcaagcctgggcaatggcgggcgcccctcccccagcctcactgccaccttgcagtttgatctcagactgctgtgctagcaatcagtgagattccatgggcataggaccctccgagccaggtgcaggatataatctcctcgtgtgctgttttttaagcccgttggaaaagcgcagtcttggggtgggagtgacccgattttccaggtgccatctgtcacccctttctttgactaggaaagggaacttcctgaccacttgcgcttcccaagtgaggcaatgccttgccctgcttcggctcacacacagtgcactgcacccactgtcctgcgcccactgtctggcactccctagtgagatgaacccggtacctcagatggaaatgcagaaatcacccgtcttctgtgtcgctcatgctgggagctgtagaccggagctgttcctattcggccatcttggctcacaattaaaagaactagaaaagcaagagcaaacacattcaaaagctagcagaaggcaagaaataactaaaagcagagcagaactgaaggaaatagagacacaaaaaacccttcaaagaattaatgaatccaggagctggttttttgaaaggatcaacaaaattgatagaccgctagcaagactaataaagaagaaaagagagaagaatcaaatacacgcaataaaaaatgataaagggaatatcaccaccgatcccacagaaatacaaactaccatccgagaatactacaaacacctctacgcaaataaactagaaaatctagaagaaatcgataagttcctcgacacatacagcctcccaagactaaaccaggaagaagttgaatctctgaatagaccaatagcaggctctgaaattgtggctttaatcaatagcttaccaaccaaaaagagcccaggaccagatggattcacagccgaattctaccagaggtacaaggaggaactggtaccattccttctgaaactattccaaccaatagaaaaagagggaatcctccctaactcattttatgaggccagcatcatcctgataccaaagcttggcagagacacaaacaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattctctttgaaaactggcacaagacagggaggccctctctcaccactcctattcaacatagtgtgggaagttctgaccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatatgccaataacagacaaacagagagccaaatcatgagtgaactcccattcacaattgcttcaaagagaataaaatacctaggaatccaacttacaagggacatgaaggacctcttcaaggagaactacaaaccactgctcaatgaaataaaagaggatagaaagaaatggaagaacattccatgctcatgggtaggaggaatcaatatcgtgaaaatggccatactgcccaaggtaatttatagattcaatgccatccccatcaagctaccaatgccttccttcacagaattggaaaaaagtactttaaagttcatatggaaccaaaaaagagcccgcattgccaagtcaatcctaagccaaaagaacaaagctggaggcatcatgctacctgacttcaaattatactacaaggctacagtaaccaaaacagcatggtactggcaccaaaacagagatatagatcaatggaacagaacggagccctcagaaataacgccgcatatctacaactatctgatctttgacaaacctgagaaaaacaagcaatggggaaaggattccctatttaataaatggtgctgagaaaactggctagccatatgtagaaagctgaaactggatcccttccttacaccttatacaaaaattaattcaagatggattaaagacttaaacgttagacctaaaaccataaaaaccctagaagaaaacctaggcattaacattcaggacataggcatgggcaaggacttcatgtctaaaacaccaaaagcaatggcaacaaaagccaaaattgacaaatgggatctaattaaactaaagagctcctgcacaggaaaagaaagtaccatcagagtgaataggcaacctacaaaattggagaaaatttttgcaacctactcatctgacaaagggctaatatccagcatctacaatgaactcaaacaaatttacaagaaaaaaacaaacaactccatcaaaaagtgggcaaaggatatgaacagacacttctcaaaagaagatatttatgcagccaaaagacacatgaaaaaatgctcaccatcactggccatcagagaaatgcaaatcaaaaccacaatgagataccatctcacaccagttagaatggcaatcattaaaagtcaggaaacaacaggtgctggagaggatgtggagaaataggaacacttttacactgttgatgggactgtaaactagttcaaccattgtggaagtcagtgtggcgattcttcagggatctagaactagaaataccatctgacccagccatcccattactgggtatatacccaaaggactataaatcatgctgctataaagacacatgcacatgtatgtttattgcggcactattcagaatagcaaagacttggaaccaactcaaatgtccaacaatgatagactggattaagaaaatgtggtacatatacaccatggaatactatgcagccataaaaatgatgagttcatgtcctttggtgggacatggatgaaattggaaatcatcattctcagtaaactatcgcaagaacaaaaaaccaaataccgcatattctcactcataggtgggaattgaacaatgaggacacatggacaccggaaggggaacatcacactctggggactgttgtggggttgggggagggaggagggatagttttaggagatatacctaatgctaaatgacgagttaatgggtgcagcacaccagcatggcacatgtatacatatgtaactaacctgcacattgtgcacatgtaccctaaaacttaaagtataataataatgaaataaaataaaataaacataaaaataaaaaaataataaaaaaattaaaataaaataaaaaaccattttttaatacaaatgttttgaggatagtgtgatgttaatcagatgcatttatggtagtgtatttttagacactctacagatgactgtaaaataaattgtatgtatttggaggtagaggggggaaaaaagaagtattacttgcccctagaattttataataaaaactaatgtttattttctatttcactgtctctagaaagagttctattttattgtaaattataagagcagtttaataataaagtcttctaaataaaacatttccactaaatttatagcatcttctatctctgctcaagattcccaattttgcataaatattccttcagtttaaatttatatttgtcgtgattcttaaatcttgataaaagagaaaaagtactcctttagaactaagtgatatgtaacagctctctcatataataaattaacttcagaataaccttcacataatgcattcattttgtttttcctttgtttataaaaaaaagtgctcttgggaaatggacaagtttctgaaacactcagttcacagcattcacttttttagcattaaacatcaggtattttatgacccaactggcacataatgcaaaaatatatgtatatatatcttttctagtggaggattaatgaggtggatgtttattttgtggttatttttagtgaagaattagtagagtggctgtttaaagaaaacacactaacacatcaacaatatggaatgatatattctattataaagatacatggacatatatgttcattgcagcactatttacaatagcaaagacatggaatcaacccaaatgcccatcaatgatagactgaataaagaaaatgtggtacagagataccatggaatactatgcagccataaaaggaacaagatcatgtcctttgcagggacatggatggagctggaagccattatcctcaccaaactaacacaggaacagaataccaaataccgcatgttctcacttctaaatgggaactgaacaatgagaacacatggatgcagggaggggaacaacacacactggggcctgtcaggggggcagggggagggagagcatcaggataaatagctaatgcatgtggggcttaatacctaggtgatggtttgataggtgcagcaaaccaccgtgacacgattacctatgtcacaaacctgcacatcctccacatgtatcctggaatttaaaataaaattaaaaatatatatggagagaatgatatttaagacaaaaagatgttctttctacctatttagattgtttaatcttcaattagcgtgtttggaaaagcacataagcatgatgatatgaggtgctgaagtaaacatgtagataaatataactaaactctaaaaatgccacctcctccacaaaaatcttcatcagcaccctagaaagaggtgtgattcttttcacttgcaatccattacatgttcaaacatgtaagcaatagtcacctaggctctgagcctcattcattgagtatgagggcaccattttaaaataaatttgggtggaacagagtcatagtccatacacttacagttcattcattgattaattcatgcattgaacaaatatctagtaagtgcataccctgagccaagtcctatcttagatgctaagaacactatagtgaacaaggtacagtccctgccctgatagagcttatatcttggttgaatgacaggggaagaaatgcaataaattgaagacaagtagatacagatggtggtgtgtgctatagagaagaaaaggagtggagtaaaagagacagacagctggttgggaggagagtgctctctggcataggatggatacaaaggcctccctggtctgctgatgttaggacagaagcatggagaacacaaggaagacagttctggattactggagggaatggatccaaacagaagtgatgcaaaagccctggtgcaggtagaaattttagtatttttaagggccagctcaagttaactagcttctctgagttgcaatttcctctgttgtaaaaatggggataataatagtactatgaaggacagtttgtgaagatttaataaaatagtgtgtgcaaaatacctagcgcagtgagtgttctgtgaaaatcttaggtgcatttcttctgtaaatatctactcacgtcagtgtttctgtaaatatgaactcatgttggtgtgtgtgttagtatgtgtcattatggtctctcttctttgacagcaatgtgccttttgaacagtaagcccaaggtaattaccagattgtgttccagaaaacactaaggcagcccctgcctgtgttaaacatttcatgaaccactttatgaagcttgtttccacctccacttacctttcttgagtcctgccaccattggtctacccagagccccctgctgctgaggccttctcctagaaatggaaggtttttgggtgggagatgcccaggatagctcaggaccagctctcctccatgtgtgttactcactccacccatgggaaatgcatgcacccatagtgaggggtggggcagatttctttccatccctcctctaaaccctgatatctctccagttccctcttttccaagcttagacaggcaaaggagctaaggcagctgaaatgctctgcataaaataatgggagaaatttaggatcagagtgggtgtttgcccttgagaggaatagctgagagaaaagaggtgaaaaacaccttttcaagcatcacggttatgtggctgagaagctttcaagaacagaaaaggccactaagtatttttaaggagtttgccctgttgcactgtaaattctctccatcttttcaaacttttaataaagtctgtcaaaaaccaggtctttgtatgtggcttttttttttttttttttttggtagcaaccaaggaaaggggctaagttctattttgtggtaaacagagctgaaatcaatgcaaagccccatgaccaacagtgggcgagtaagaatttagcagaggaaggaagcaggaaccagccatcaccatccctccatctcctagagttcctcagaagtgtttcgagggcgttggatgtttcaaggcagtagtatacctatcttaatgagcaggatggccttagctgacatgtgcatgtatgtgagacttgctttgggcagcaccccagacaaagataggcactgaattctctggataacaacatgaaagtgaggttgaagctgcagatctgggagggactctaggcctgcctgaaagtgtgtacaatagacaggggttgtccacatttgtcagtttcctcgagtagacccatgcttgtatctatcatcagtatggactcaagctgcattattgaggtcccaagaacacatccagtagtgggcacagtgggagtggctttgttaacctcaatggtttactagttggttcttgagttgacacctttgattccttagaacagaaaggaaataagtcagaggaacttgtcttgggctgcttccagggctgtacataggtagaaataatatcaaagctaacatttattgagtacttagtctacataaaggattatgtgggaactttatatgtactcactcacctagttcccccaacaactctttgagataagtacttcctaatattcttccaaaacaagtgggcatactttgacccagctacaggttttgcaaaactggagcacgtggaatgaataggagtgctgaggggaaattttgtgagaagtaggagttggtgaagcaaccaattcagcaattctttaatagcagataggcagttagctttatccagatacccagtgtctttgtcaggtttataggatgatgttgtaatttcatttacatttgtctgaggtttcctttgagaccataaagtttcccaggccaagtcttcccaggtcccagatcttactctgcttttgcaacttcactctgcagaggaggggatgtggcccatggcaagcaagaggggatggcgatgatgatgaaagttaggaaaaaattggacttcaaggagaaattaaggagggtggtcgaatgtagatcaaattaaggtcaacaaaaaggagagtgtgggcaaggttaaagactttgtgctaaaagcaagagttgtatgtatgcttagtcataaaatgtagctctggagatccagttcagggtctggttctgtgcacataaatcccttttggaatttacactttcccccatgcaagtgcactcatccttggagcactaagcgacccattactgccctgggcagggccagtcaggagtgggtggaagtgatgcgtaattcacctcttggaaaccccatctttggggaaagtgaatttactgcacatttaaatgtttgtctctcagtgaccattaacttaagcctggctcaccagagtatctcgcttttaatgaagaattgctttcctgcaagaaaaattcttgaaattgttggaaaaagaaaaagtaaatcctgagggattgttagaactggtagatgtgacatattcactagcctgactggatttcctttaaatgctgagatgaaagtcattcagcatggagctctcatcagtgaggatttaagaggttttgtttttgttctgtactactgccaggaactgtaattaacaggtaaatgtaagagatggaaatgtatgttgttcatctgatttaaataatactcctcctttaaaaagcaacatccatcataaccaaagtggacctgaacagtagaagtccagatgtacagaggtcttccagaaagccacaaaaatagtgcaatggttagtttttcttttggcctgagcattgataaagggccttaggctagttttagttttccattaatctctcatctttctttttttttttcttgcagtaatcttacctaaaaaatgctttaactggtatattagaaatcttttatttttagacgtattcactttgaattctttcctttttccttacttggtaaatatttatcacactcccaggcaactcaacatttctcttatagaaagaagtgtcccataaaagaaatgtgaaaaacgagccttgcgaaaacacaggtgccctgagagacatatttctgcaaggacttgtactgaaagagcactagtgacatataatcatgaacacttgccagcctttgaatatgaagatgtcactatcatcattcttcaggcatgttttgaaagttttgttttgttttggctcagtttggttgatttggtgtgtggtttttgtttgtttgcttgcttgcgttttccatgaactttcatggatttgtattgacccatccacatttactttgtcctctttagaccaaaaatgggctttagtgtgggatcatcaatgaaaaatgtgtattaattataatttgtctgttcaatatgtgccactaagtcttttataaagaagaagttatattgccagaaaggcaatgaatgaatcttgaatttcttttgtccttgtcctgttctgacatctgcaactctcatggcagaattcggtaaaactgaattcagagtcctaaccagagcgtcagtagatcagatggagtcaaagagacaaggaaagaattgggaagcaatgctgtggtcagttgggaaatgggcaactccagtcacactcagaaaatggaagtgaaaattggggccaggatcatcttagaagcaccaacaaaagcatattggtaaaatacccaacaataaagatcacaaaaattagccacacatgggataatcatgacacaataaagttatgaatcacctctacattagggtatgtgagcaattctgtagctattgggaaacatccctctgttttcttgagtcttactccctgagactagtctcataacacttcaaaatgaaattgtctgagccaagaaggaacagagtcgaatagaatagacaggtgtattttggtgtcaatgattataccattaaagttttcataaatatctttttactattatcattattttctcctcagcagacagcaccagttccagaagttgtgtgatataattgaaattgatttttctttttaagcagtgtatttgacatttcttcagcgaggctccagctctcttccttatgctcacccccaaatctgtggtgaagaaaatatgacttcagtccatctcatccttaatatagctttggccttcctcatcacaaaacccttacagcctaaaaggtcatgggcagcatttacgaagcctgggatatgctacaggagaggcagtcatgcttatgttctcacagtcgtgataaaacatggggtggcccaactcaggactaatttggggtagttttctctggatttagcttttgaatgttttttgggacctgagaaggccccaaaaagaaagaaagaaggtagttttctttctttccttcattacctatagttttctgttaccacttgaaacaatacatccaatacaacctattacagattaagattaaaatatcttttctatggcactatctgaaacttatgctttagctgcttttcaaatgcctctagttcatgaaatgggaaagaaacattttccatgacacgacggtatcaccatctgttttcaaggaggacgactgcacgcctacacagcagattttctctgtgttgtattcatgcagcgaagagctgcacttctgagtggtttcttgtgtaagctcattcatgcttcttaccttggagacttcatcagactctcagccaagtcaaggtcaggaagcacctgtcctgatgcttcttttctgtatatgtttctctggggttctccacagcctcatggaacatattccttttaatctctatcggaatcatgtatgtttcattatttgcagatgaaaagaaaaccatcttcacaaacagagaaggacctttttatttaataaggctctgatcgcctgattgattctgaagtgcttgctctgggctctatctgaatgagtcttacatagagaataagaatctttcctatcattttctcccttattttctaccttccttttatttttcctttctctctttcattttctcctttccctgctttcttattctgtctgttttacagccagtccttcccgccccagattacccattcatcctcatgatgaaaccttttcatccttgtgactctcagatttgttccaagtcactgttaatgcatttatcacttctgacataaggtggtagacttttttagcttatactttcctcccctttgcaactcccttcactaatggcaaagagtgacaactagtgattacagaaatcttgaaaatgccactgggaactcagcaacaagaggtgcctcatcaagactaagacgtagatttaagattggatccccagcggctcccctccccatcccttttatccccactttactagcaaaacctaagtaacctctttttacttcctgacctggaggttctaaactgaaatcttcaaccagcccaagggtgcacgtggccctgctcagtgcttttacgccatcctcccacagtctgtctattttgaagtgagcgctatgttatttctgtaccaggcaaaaacctttttgtataaatggagatataaaatttgtaggtgctacataatatgcttaaaaaaaagcttcaatatgtttttactttaccatcctgctccctctgcctcgtccttcctctgtccttttatgcattgtgttgccctgtgtctctttcttcatttttggacttgcttcagtgtgtggctgcattcagagtggagcttagggaatgactgatcacctcagaccttcagggtctgcctgtccagcagagctcagctttcactagatctcaagagtccaggggtgaccatagagcaggattatgctgggcaaaatagctaatggcttttattttgcatggtaaagaattacaaaggtaggtccatatcttaactagtttgtgactcattcagcaaatgtttcttttgtatctcgtatgtacctggctgttctagttctcaagatatacagagaataaaacagacaagtgtcccttcacacacaccttcacactttagaacatattttcataatctctaaggcatcagcagtttttataagcaactgtagcatcttttggaaataaaattcccaaattttaattactgtaagcatcttactcagttttatgaggctttttaaaaagaaatgggtgctgtaaaaactgagttgtaactttttatgtgagtggaacagcatttctctccgcatttgctttctcctatcaagagagagagaaggaaagaaagaaagagagagagagagaaagaaaatgaaacgtgtttggatttttgccacctggttatggttagttctttattttaaaatcactttcaaaacagatcagacattacattgttaaaaacaattttcactgtaggtattgaatatcatactgcgcttgtagtaataactgatagatatctagaataatcttcattgtggactgaaactagaaagaactgtcaatcactgagtttaactttaaacacagatgatttgaattcatgttagcagcgtgaggaagccgagaagatggaacagtgctgcttggagaaaagatgataggattacctctgcagtttgccgttcttgctagttgtttgagtcactaaatcaaggcaaagtttgtgaaaagcctgtggctggggtctccaactcttcattcctgctgagattttcctattataaatctgctgtcagaaataagtgctttacttgtgacttaattctatgcaggcacaaacaccttggttcaacactttgaccagacggccctgactgtcttgagagaaacagagatctcattaatatgggctgctacaaagaaaaggggttcccatgctctccggtcgtcattcactgctctggaaacagccctgtgaacgctgaaagaaaacatgaactccaaggcagcagtagggccgggatattgagggagggaaggatattagggaaaagggagtataggccttgtggattcaaaagcattgtcattctcaaaacaggcaattccgtgttttaatacttcccatgtcacctggttttaaaaattggttatttaaaaatctgctattatcataattagctagatccacactatctagtatgggagccactggccacatgaggctatttaaagacaattaaggtcaaataaaatttcaaacccaggtcctcagtttacgctagcctcacttcaagtgcccagttgccacgtgtgcttcatgcaactgtattggacaacatggagcatttccattgacacagaaagttctcttgggcagtgctggtgtagacagtgcttatagaatctcttggtctttggccactcatcacttttacaatgatcaggcatttaagggcataagcaataaaagctgaatgctaaaactcaatgacatttccatttttaatattctgactttatgttaaatgtcttcttgtttaaagatgtatggacaatgggccgggcatggtggctcacgccttaatcccaggactttgggagtctgaggcaggcggatcacgaggtcaggagattgagatcatcctggctaacacggtgaaaccccatctctactaaaaaaatacaaaataattagccaggcgtggtggcgggcgcctgtagtcccagctactcaggaggctgaggcaggagaatggcgtgaacccgggaggcggagcttgcagtgagccgagatcgcaccactgcactccagcctgggcaacagagcaagactctgtctcaaaaaaaaaaaaaaaaaaaaaaagatatatggacaatgactttttttgccttcttttaatatgtcttttgaatatcatatgtcagtgctatgcaacatgtgctccccggaatgggtccagtccacaaactattagttatcagtctatagtgaagcaaataaatcaagagtaagcctttacaaatttttatagggatttaacattgctgtgacttccaggcattcgtgctggttttgataagtatgtgaggtgatggatatgtgaattagcttggtttggtcattccacaatatgtacttgtatgaaaataccatgttgcccacgataaaaatacacactttgtcatttttccattaaaaaataatttttaaaacaatttgcaacagattggaaattttgatttattttatgaatttttttttttaaagacaagatcccactctgtcacccatgctggagtacaaaaatgcagtcgtagctcgctgcagccttgacctcctgggtgcaagcaattctcccacctctccggagttagctgggactacacacttagctgatttttaatttttaatttattttatttattatttttagagacagggtctcgctgtgttgcccaggctggttttcaaactcctggcctcgagcaatcctcctgacccagcctcctaagtggtggcaatttaaaacaagaaataaacttgcccttcaccacagagaggtgagaagcaaagatgtatgaaaatgttcactttcggaaacacattaaccagctcacgtaaaaatttcaaacaggaccagcttacgtgcaaggaacgaaagctcaattcaggaaaaagctatattaaatgtataattacttgacatgactgtgaacatagcctacagtagttttctcattcactcttaatgcatgttaaggatgttaatgccaggtgctctttcctataaatctggctccacttttatgtaacattctttatcttagggatctttgaccagagtgggaggaacaggtgcctgttactgagagtaacatggtgtttgtttattacacttggctaagtttggaaggtttgtgctttagcttataaaagtagctactacttgcagagtactacagtatttgaattgaaaagtgttatgctttactgtatctccatacaaagaagaggtttccctgtgatgtgattgacagtctataacaggagtattcctagccatgttccagtttcttctctgggtacctggccacatttcaatgcactcagcccacagagaccagaggctatgtggcacgtgtatgtggagttgctacataaataatacgtagtattaagtgcttatttgctagcttctctgactaaactcagagctctgcagagaaggtggctgtacttagccacctttgctatctccctcgacttacacaacaggtgctcaataagacccttctttttttctcttttttttttttttttattatactttaagttctgggatacatgtgcagaatgtgcaagtttgttacataggtatacatgtgccatggctgtttgctgcacccattaaccggtcatctacattagttatttctcctaatgctatccctcctcttgccccccacccccgacaggccccagtgtgtgatgttcccctccctgtgtccatatgttctcattgttcagctcccacttatgagtgagaacatgcagtgtttggttttctgttcctgtgttagtttgctaagaatgatggtttccagcttcatccatgtccctgcagatgacatgaactcattcttttttatggctgcatagtattcaatggtgtatatgtgccacaattcctttatccagtctatcattgatgggcatttgggttggttccaagtctttgctattgtgagtggtgctgcaataaacacacgtgtgcatgtgtcttcatttaattggctattggaactacatgatgcagttaaaaacatagttaataatcaagtccatcattcagttcatttaacacgataccaaatcactgctttgacatcattattttgcttcatctggtagttgtgtagccctggacatgctgagtttaaacttcagcttggtcaatggcttgttgaataatcaggaaactctgattccaaattattgatatttcttagctctaaaaacataatcttggtttgcaataggggcaatataatgaataaatgattgtaaaatacttcactatgaaatgaggctaaaatattccttatgtgaaatattactaccagaaattccccagcactcattggaactttctgtaagacatctctctgtcagaggaagttgtgagttgctgcttagaaattcagtatcagtggcatttttgtaaacctggcatttggaaagtgaatttcagaacaatcttcttcctccaccccaccccaaccctccatttatttgtatcacaaaactgcccctaaagtcaatatccccctccctaaaatgaatacattgtccaagatctttatcccctcctcctcctcctgctgctgctgctgctgtttgctcatcaatgcaggatttcagagttgttcgtcctccagaagctcccactcccttggtcttgtctgagaagttcttgattgggctcccatccatcagaagaaggaggaatttctggccctatagacatgcaggtgctcttgcagcccatgatcttgcatgaactggagatgtcaggattggggaagtgactcctgcagcctgaagcctttgttgggaggagcagtcggagccaggaagcacatctgcagcaggaaagtgtttgctgattgtgggatttataagaaaggacacacccgggagtaggctctgaaaggggtgaagagctccatccccaggatcacagaacttgtccttctggctttgatctttaagccacatttaaactcacaggaaataccaccactcacgagagccttcactgggagaaagtataggctgggtgttatccagctcgtcacaattgcaggtgtatgtcttcagtgagtgagtggttctatatgtcataggtcagagtttcctaatcttggcattattggtattttgggctggttaagcctttgctgccagagctgtcctgtgcattgtaggatatttagcagcatctctggcctctacccatgagataccagtagcaaccacctacagatgtgacaaccagaacatctccagattgaacattgccaaatgtctggttgagaaccagaaccatagaaagactctcaaaggattctagatgtgccattatttctcagaaaaatctagtaactttcttctatgattaagaaaattatatgattaagaaaggtaaatgattaagaaaggtatgctttacagccagatgcaatagctcacaagtgtactcctagcgttttaagaggctgaggcaggaggatcatttgaagtcaagagttcaagaccagcctgggcaacacagtgagactctgtctctacaaatgttttttttaaaacattggcccggaaagctaaagaagaaggatggcttgagcccaggagatcaaggctgcagtgagctgtggtcatgccactatactctggcctgggtgacagagtgagacccaatctcttaaaaaaaaagaaaagaaaaggaaatgtatactttatgttgtaaccaaaaagtatgtttaagcacccacttgtttgagacactcagttgagttctaaacaaatcaatcaaaaattgtatctctaaacatgaattttctaagctaattgacaaatttttgccttgtagagaatctgaagataaatcatattcagaatacattgacaaaaagttgacattgattctgtcccaaaatatgccttaatgaacttgtctgttaattccatgtgcagaaattgagtatctactattttccaggcatttgaccaggaaggaagaaataaaacacgattatggcccttgaggagttttaagcatagcgaatgctatcatttggcatacaaatgacaaatgggtgggctggtctacatagaggagaagcagctaaatcaaactgaggggtcagggtaaatgttctggggaggtaaacttgaagctatgctttgaaggatgaataggagttaagtgaataaagaagcaaaatcaagggcactgcaggtagacggagcagtgggtaccaaggctcagaggaaggaagtggcacaatgtggagatctgtgagaggctatgaatgcttgagtgaaggcgtcatgtggggctggggtagggagtgaggggcagatcttgcaaagctttgggttctgagcctgaaggcacagtggagatgcaatggcagaattttagcaggggcacaacagggccttttagcaacttcttccagcaacattggaagggttcagaccagcaagctaggaggcagcagcagtaattcatgtgataattgacaaagacctaaatcaaggccatgtcagtaggttaaggaggagaacggggaaggaaatctttcagagattaagaaggtcaaatctataaactgattgaatgtggtgacttgacatagaggagacatttctgacagatcccaggattctagcttagatgacagtgactggttctcaatcccaaagttaggatccaggaagaagattagtttggggaagagaacaatgagacagtatggtggagtagttaaaaccttcaattgtaaaattaaattagacctgggtttacataccggttctattctttacaactacatgaactttcttggactcatttaactttgctaagccttgatttcctcacctgttaaatggtgctattaatagaacttactcatatattattataagaattcaatgagagaatcattgagaagaacaatgcttaacacctagtaagtccttaacacatgttagccaagttagcagcatccccgagcccaggaagtccaactgcaaagttgatattcctaaccattttaatacactacctccttggggcaattgcatgtagattaaatggttgaaatatagattcccctaagcggacttgtgcagtgtaaggataaaaaactaggcaaaggttagatcacaggagatcatatattgtaagctagggactttggcctttatgttgtttgtgaaatgagaaaatgctggaatgtttttgttttgtttttttgagacggagttttgctctagtcacctaggctagagtgcagtggtgctatttcagctcactgcaacctccgcctcctgggtttaagctattcaactgcctcagcctcccgagtagctgggattacaggcggacaccaccactcctggctaatttttgtatttttagtagagatggagtttcatcttgttggataggctggtctcaaactcctaatcttaaatgatccacctgcctcagcctcccaaagtgctgggattacaggcttgagccaccacgcccggccaaatgctggaattttaagcagggagatggcatgtcccaatttttatttcagaatgctgacatcaacagacagggatgacctaccagtgtaggaaggcaatggccagaaagacccaccagccttctttttcttgttttcctcctagtgtatagaacacttagttgacaaacttgatttgtctacttccgagtaaaagagaaggaaaagagtgatagaaacttgaggtgtttcaagtatgtcagcatggaatatcctttcactcggttggcctcacagctgcagataatgtggatccagaaagtttgactcctccttaaaaggacaatagttgataccgtgcagagcaggtaaggaagctcctttgcagatgaatacaagcagccaagcctgtgggaccagagcaggcaccaatccagataataaaccctgttcagcatcgtctagacctgtttgagtgatttggtttaattagcctttccaagaaagaatcttcaagttttaatggtgcatagttatgcttgtaaacgtctccgccaagcatgggctctagaagtgaggatttgatgggtcacagtggcttggctggaagccacagggtagctttaataactttgtataatctaatgatgtcatgcaaacagaaaaatttggattagaaggggaataagtaaatgaggtagtagcatgctcgacaggtgaagatggctgagagtgtgtcaggtaatcctctgcctagacatatttctccttcaaatctcattggaattggggcttctcttggtctctatgacaatattactaccacagcatgggtagtggagagagcactggagagagagtcagcaggtctgatttctaatctgagctcttccatcagctggctgtgcaagtttaggggcccttcaacttcatggatggcaatggctcatccattcagtgaaaaaactaaccaaggtaattaagaaggaggatggagaaaagaagaagaaaataataatttccacttacctagttttttatttaatttgctgaacaacatgctatgtggtttgcacacttgatccttccatctcatgacaataacttccatagccatctctctggatttttttcagctatttgttttcatgattctgcatttatgtgaaggcactgggaacaatatagaatggcagaagttgaatacaaatcctccctgtatagtaggaggtaatattttgaaaccttgaaggttcaaacagtggccagggacagaggatgaggttggcacatatggtagaaaacacgaatctggttctgtttcctttctcctctgtccatccacctgaagactgcattatggccagggctaaagctgtagcctgttgggaatatagctaccagagcatacttattttaaatgtagttgtttccttgctctcactgcgccatcaaaactgaaggccttagcctagcttccatgcttccatctagcttcctgcctttccttcccttgctccctctccacatggtttgtcttcccttgaccttgaatgtgtgctgactctctcctgacttcacaccctccttcatgatgtgcccaggttggctgaacccacaagtaagcagtctgttttggggccagacattggtctgagagctgagagtagagagaaaattcagtactcaattttattcactatgtttattggcctttaaagagagaagcgtgatgggagaccagagcatctaacctaaaggatgtagctaggaatgccctttactctgcccatcctacccttacctgcccttaaagctaagctcatgcttgcagcaagcccagctccatctgactgcccattctgatgacccatagcttacaccctctttctagtctcaacaggtctaggagactgtctcacacaacttggaaccttatttcatattttgttgtttgaactatgtttagatgctttatgctcctcattcccaaatcctattgcaactaaataatagctgcttctgtgggtctttctagccctttgtttctgtgattattattaactgaaataccttccttctctttcctattgcataactttcttcctaccttgcacatttttgtggctgggtgggccactggacaccaagaagcagtaattattatcacaattaccctgccttaataactaacacgttatagccttttaccctgacaaagcagctctgtatccattatctcattgtttcacacaacaattctgttatgtaaggagcacagaaattagcatccctcatttacaggtaataaagtagatcttaaagaagctgaagaacttattgtttacatgccacataacaaaatgtagtgaataagaccatactttcctgtgctgtctctggggaaaaaaataggtagataatttacctactacaaaatgtgtgatgggaaactatcctcctgggtcatggcactactaattacccaggaatccttagaaccctcttttgacatcagttgaaacactattgacttataatgctgcttctcaacagagttgagtggatcaaatagcaaatgtgaatgactctatttaacttggtatttatcttggcatttcaggccttccattatttcctctctgatctacctgccattcactgtttacatctttgcactgctatatatttgtacatgcttctttctcttcctgaaatgaaactctgcattctcctctctacgtccttatttaggtcccaccattcttcaaaatccaactcgaattgaactccataaaaaatccacttccctttcttccctctgcccttgtcctatctccaccacttgttaacctcacccctatttaattttcagagcacatctccaggcattctctcttctgatgtagatatttacatacatttgtcgtttccctgcatgaatgccaaattctttggcttcaagcttttttcttgattcatttgtgtggccatcataaagtttagcctatgccttcaatataccgcgttttgaagaacatgtgttcaattataatgaatagaagaattattgttaaagggggcaatttaggttggattgaggacacccagcatgaaactgaaatgactgagaacaggcaaaaaattcatgactgcatgctctaaccactagactattttccattctgaataggacaatagtggtcattattttgttgccacagtttcattctcacactcacactgagcctttgaagtgaaatctctcctagcaccactgaggttgggaggattgctcactatttggagggattgtcagtagaaagttatgaactctctggtgaaatgctgctcagtttattctctagagattcagattcttttgaccaacctgatgtttcaacagcttgaaaaacgaaggaaagaaccatgtctgtctagactgaccagaaagcaaaaacaagggatactttgaaatctgaccacaactgagagttgtacttagtccaagtaactggaaaatcagtttcttggattagacaaatgcttcccttaagactctcaaactactagctttcttcttttataattaatagaaaattattacactgacagacaagagacttcatatttgagccaatgggaaaacttgacgttgaaaccaggggaaataatttagcctcaaatagagttgttaatgccaggataaaagcaaacaaatgtgctaatgatcttccttgagaatctgactgtgatgaattttgatgaattcccagatggaaaatatatcagttctccctgggctgggaattggacactagaatgagaaaatggtgaaatgggagtcagcaaaaagcactccgaagatcttatttccattttctagagaacaagaattctaaagagatagataattcccacttcaaagaaccagatctgtgtggttgtaagcatctatgacaaagttggtggtgggcatgaggcagggggatgtcctgatttccatcatagaatctgccattgctctgctggcctatagaattgatgagaggggagagtttgatacagcagctgccttgatattctcctgtgcagtcatgttatcacccaacaaacattcattgccatctcccatatgcccagccctttcctaggcatatggcaaagaagagagacagtctttgctattgtggaattctcattctagtgggtctagaattctcattcaattcccaccactaaaatatgaacagacaataaatacatgcataaataaatgtagaaggtcagatagtagtcagtactatgcaattaaaaaacaagtgaaggtgaagggaaaacaagtgccatgtgccagggcacaatggatggtggtatgttgctatattaactggggttggaagaggggaggcctcacagatgatgtgacatttgaataaggaccctaaagacatcatggagaaagatgaatatttggataaagagtattccaggtacagggaataccaatgcaaaagctgtgaggtgtgagttcttgacaacatcaataaatgtccaagaagttagcttgattgaagtagagtcagcaaaccaaagagtggtagcccatgcattatgagatagagctggacacatggcgtggtcttgtgctggggaacacaaaactctccaaggaagactccatgcagtagatgagaggatggctacacgtacacatggattgtgaagcagctgactggccatgttgaaactataatagacaactgaaactggaataggcaaggaaaaagaagctggagtcagtttgacaggatacagctagcagctttgttttcaactgtgctccaaatattgttgcaacttccacaacttttcctttccactggacgtgcttactttcacctccaaacccattaatatatcttcatccttcacagcctagttcaggcagtctggcaccagtgtggacacagttgaaacagaatggaatgtggagcttcaaaaactggagttcaaaaatctgcctttgtaatttagtagttgtctgagcaacgtatataacctctttgagcctcaattttgtcatcaataataacaaaatgttttaaatgtataaagtgtttaaagtattgccattatccaaggagagtaattctgttatttacagcagaggaaactgaggggcaagggttaagtaaataacccatgattatttctaaattgtagaaatgtgaaaatgctagcacttgcaggatttgaactcgagcaatatggcaactcatgtatttaaccccacataccttgcaggatggtgggcttgctgaaagggattatcaagaaaaaaataacaaagaagatactcagtcattgttagttcttggccactcacacatttttgattgcaagtgactgaggaatcaacccaaaattacttatgccaaaagaaagtttgttggcttttataaataaaaattggccctaggcactagggtcatgctagcttcagctactgctcaatttaggttccaagttgctatcatgatcccatctcttagccctgctttatctattccttctttttcatgttccatgtggtgagccatggcagcttcagttccacagcaatacaacacccaatccagtagaggagaggagttcactttcctgatgggtgaccatgtgttctggtttagctggaacagtcacccagtccaatagaaaagaggagtctacttctataataggagatacatccagaatttcccaagacagtcacctagtccaaaggaggtggactgatggacaggatgaccataggtctggttttcccaggcactctttattcacatctgtcattgcagcttgattattaattgtacctccattctctctcagaagtgtcccaatttatggtagatgtatatggtcattttactgatagtacaaagaaaaatagtctcattaatctttgcctcagatacaaagtcttcctctaaatcttaagtagtatttacttagaggagagagggagaatgtgtccaccaaagaataatagagggcctgttatcccaagaagtggggtggtggttctggatggccaaaaccacaaatgtagattacagttccccttttctcttcatactgttcggtactgtttagctgtagaaatggtttgggagttggaaaaacatgggtttgactcttgactctactgctgcgtgtagctcattcaccttagtggaagcatcttccctttctaaagcctcggttttctcatacatagagaaagctcatcatgtttgcctcagtgagttattatgaggagtgaatagactgatagacatgaaggattcaataaatcaatagctactgtttttccatagtgcctggaatacatcttaccacacaatatgtggtcagtaagtacctggtgaccggtgactaggacaggaaacaaacaagaaaggaccgtgaacctcatagtgggtgcagggaggcacggggtgagtgtagacaagagttgctgtcagtggtggtggggcttagtgatcaaggaaaggaaaacactttgatgctgagtgaggagattcatgatccaactgaaacattggggaaaccactgagaaaacgtcctttttagaactactggggaaattagaaattattaaaatttaaaacagtaaaaatatttactagacacccacattggggcatacagatatgaataattaatggagcctactcccaagaatttgggaggaaaaaactcataaatatacagaattatgttctacttacaatttatatatcatagctagagaatgataaatgccataatcttaaacataatagttctttgattggatgaacaaaaggttgtaggaaatacccaactgaagtgctatgagaggttaaaggaagaagaaatcccgccaacaggtagagcaggaacaatttggggaactggggggttcttagaatcaggtcatcagtgtagctggatttacatgtagggaagatcagaaagtattggaggccttggacactccaggtgcactcttacccttgtgcttttgtttcctttgcctaggttgctctcccacaggggtccataagacctgatccctcacttccttgagtgtattgccaaatgccacctctcagtaaggacctcccttgctctctgtgtaaaattgtgacacctactactgtgtttttgttgttagtgattgcagctctctaacctgccatatacttcaactgtttatcttgtttattctccatcttgctgctagaatgccagctccatgagggcaggaatttttacctgttttgttcactgctgcatctccaatacgtagaatatacccagcacatagtaggtgctcatattttgtaacaggaaaagaagaagggagtctgactgaggggaagcatgaaccaaggtacagatggaatgtggaactgtgtgcagcagatactgtgttagtgcaggcagactggagtatgcatgtgtgtatgtgcatgcttgtgcgggggtgaacacagtagaggacatttaaacaggaagcacatattggggccagaccttagaggacttgaagactaggccaaggaactcagcttttagtctgcatgtcatagaaactatcaaatgtttccaccaggaaattgatatgaacaagttgtttgaagaggattgatcagacagtgttgtttgtagcaagagtaggcgtggaaagaggttagaggtagggaacaatgaccaggtgcttcataaaaagccaaggtggccttaaccgaaaaaaaaaaaggaggtgggaaatggagagaataaagggagatgtgcaaaagaagggtatacaaagagatagaattaacaatatttgatcctgttaataaaaggaatgctagagaacatgtactaatattagtgggatgacctatatatgcagtgattgatgtgacaacagctctaacattaatagtcagagatgatgactcttaggtatggaaggtaccactctgtccttaggaacaatttccttacagcgaaaatagtgcttctaaatggtttctatttattttactcttttttaaactagttaacataacacaataacaattctagtatgtgaagaccttgagtgtctgccttcctttgggacagatctacagtcactcctaaaagttaaatatcatgacatctctatctctgtgactctgattttctttttcacaagcaaggttcccaccaaaggaaactgcagatttgcacattgggaagacttaatagagaaagcagaagaatagagaatggaattgtctaaaagcggaagtagatagcagaagggatttgagtctgaaaaacagaggagtccctccttattttccaagcagccaagaattgcatcttcaattgttctgaattttttgctctgtgtgttgtgtgtgtgtgtgtgtgtgtgtgtgtgtgtgtgtgtgtaggcatgtgcatgcatatgtggacagctacacatatagggctgccaaggatggccataaaggctgtgtcttacacgcctcaaggaggctctattcacataggccataatggcaatgctgctttctggagttgtgcaatgggatggccctgcttacgagaatgtagagaagagaactaacttgagaagtggctgtgctctttcaaagtatctcaccttcccacatcccataaaatctgcaatttgccattacaggttaatttatttggattatcattatgtagtctatcagtttgagttagttcatccaactattctcttcagtggctaaagaatccatgactttctgagaaatcttggataacaagggcctgaaagatctaagactgaagataaggaagatggtggaggggtgggttctgacaacaaacttggcctattttacacacaattgagtcaaaggctgctctgctctgagcaatactggagaattaagttagggtcagatggtagtgggtcttaaatgctgagctaatctaggaaatagggagccattaaaggtttttaggaagaaaaatgcatggaaacaccgatcagtcaagcctccttgtctccaaacatcaaactgctgaaggtatccacagactcccacctgagtatctctgagaaggtccttgttctcttcctcatctctgtccttccatgcaagctgactgatccacatcaactcaattcaatacatatttactatgcatatattacatatcagtgctcttacaagtttcagaaacagctgcttaaacagtactattctctgacttcccctctcattttgaatattttctttcatttcctcccatttgcaatgccttgggtgacattccttcaggaagtaaactttccaagtactgtcatgttagagccttaggagagatctgatgtggcctagagtgttaacaggagtgctctgtacgatgagaaatgtatgttttctttactctggccagatgtttctagaccagaaagtgaaggttttttcaatattagcatgtagtatatttaacaaagtgcttactgaaaatcccacaaaatatgtctttcctgcatatttttaaagcgtagaggcgctcaccttggtttgtgtaagcattcagtggtgcatgttatactttatcttggctgctgtgatacatattgggagggtggctctctctggactcccggcgaagttggcaagctgtatccaaagttggtccaaggatagggtggcttgagtgagttatgtgcgagagccctcactgtctgctatacaaatacatgtctaaattcacagtctgattcatcacacccgctggcaactgcgccgaccaaagtcaggttctcaactgctgcttggactatggctatggcctaccttcttactgtgccctggctttagtcttgccaccctcctgcagcctccacgttgctgccatatccttaaacaaaatcagaatttgactcttgtgttttttaaaacctccagtttctctgcagggtagattgacagcagtgattttcattgagggtcaagccatccccagagagatatatccgaatctgcacaaagggtgtgctggggaagagagaagtgtggctttaaaagccatatctagcatcagcagtgccttggatttcttttgaaattgttaataatatttatggactgaatgtgattaatatttatttaaagtgggctactgatctctaggaagaagtccacacttcttgttctgccattcaaggccctacgtgatgtagtaccattagtaatttccagaacagtctcctgttttcatattaccagtctctgtacttaacgttgataatattaagaagagtaggtctttgagggacatttactctggttgtagagatagatgcaaaaaactaattttacacggtatgagatgtgttattgtagagatatttacaaggtgggtggcagaataatggaggggattcacaaatctgtttcagaggaagagttaaagctgctggagttgcatcataaaggctgtaaagacaggcagattcaagacagatgctggaggtggaattgacaggactgagacccccctcttactagtccctgatggaaaaggggaattgagggcagtgctcaggtatccagctgggattccatatgaacagtggcaccattaagcaggtcagagctctgctgtggacatgtcaggtgtgaggtgcccctgagatgatcacgttgtaatgtccactacagagtctggaacctagaagggatatcttggctggagaaatcaacttataggtgatagtggaagatacaggtgtaagagctaaccagagtgagcatataatattagaaaagataaaatgagacaaaaggcattacgcaaaaagatgaaaccaaagccagaactgcaaagaatatcttccaatatattttttaaaactttaatagaacttgaaggggttaagcctttttctattaaaaatttaaaaatatgttataagaagaatcaccatctgaatatccatacatggaattatataaaagtggccagggcatttgttcttaagttgaaaagaacatatccaaaaaaacaaacaaacaaaacaaaacagaaaaactcaggtctttatatctctccaagtctattctccaataatagtatactagtaagcttgatttagaattgcctctgtgtccttgccagtttacatcttggaagcttgtttctattcatttcataagccacaacgtatttgatcatttctaacattcacaattttcacattaaaattgatgatgtgttatagtttaatagcagtaatcgtctttctcagtggtatataaaataattgtgcatcttgcagtcattggcccattcaattcaaagtcaaagtggtaattgctttgtgccttctgctatgggcagcaggaggatgccctttggagctgagaaggatggagtgaaatggtcctgtccactccctgccttcactctccacccgagccagccttagcggtcttcctgaggtggcagatggaggagccacagtcctctcatgaaatgtcaggagcagagcatcaagggctctggcaggagctcagatcctcttatcccaaagttttgcaagccctaagagggctgaggaaagcaagaacccagtggactcgtaaaacacaaacccctctcttcacagagggtcgccttgtgtcgttgagggttctggttgcatgcagcaggcatcatctctggtgggacttactggaaggaaatctggtgctgacaacgcctctagtgggatttattggaaggaaatctggtactcacagaatcaacaggaggcagaaggaacaggtttgaaaaagcgtggggaccgagggagctctggaacactgggcctctggaacaatcttgccaggatgttgggcgtcactgctgctactgcgttttcctccaaaatgaatcctaacttttttctcagctctgactccaaggatccaaagacaaagcctgagttaggagcgaccagtctgactccccagatcctgtctgtgccctggccaccaggagatgaacagcaggaaactctttccccctgggcttcgagagaggaaagtaggatccagcatatcaccaatccggattgctgcaaagggaatatgccccagacagaaaggggttttgcattatactgtattgccaaacactgacaaatgttccactgcactccccttcaaatacctcacatttgtaaggctatcaaaacaagtcagcgagcagaggactgctgcatactaaaactgtctacgtcggcttcattcagagccatggactagtggaggaaacgaactcttctggagctcaggcaaagggtcgagcctcgtgctgagtgtgttatctgtgattgctgcataatatgtagttactcattcttagacctctgaaaatcttaagggaggaagacagtggttaccaaagatttttccaaccaggaggaatgaatgtggcaactggagacagcagaatatgggtattaaataaaataatgtatctaaaagatgccattgtttagaaattagccccttggattgacaggtaattaacttctgccactagtttaatttcttgtgtggacctggataagggaagccatacatgggtggtaattttattccctccaatctcaaaggaaacgtaactgggtatgaagtagtggcacaactcatatatcagtagtctgtagcaggtctacataaatccttttctttaaagttatttaactgttttgaaaatggtttcaacagaagtaattccaactgcaccagaaaggaaaccagagttttaaagaaaaatatactctctttgctgagcaaggcaaacatatcagtatgcagagaaacaaaccagtctcttgtgttttatttcctttgcaaatccaccaaaacacttactttatgtctttaaaaggctgatagacaaagaattctgtgaccactaaaaattaatacctacaactggtttgtagacactttaaaagggcaggtactattttttaaatttctctgtttttcacagtttctcattatgggactttgtacatactataaacacaatacatatttgttgtgagtgtttttttagaccgatcaaaaacatattctctggggaagcattttccattcaaggaattagataacctgctatttcctcacatgcttctatgcataaacctagacattgtatcacaaacctagtcctttttatagccaagcccttcacagaataatatttttccaataagctcgtagtggcatttttggtcatggtgtttcttttttgactcttctgagaattaatgtttaaaataaacacccttatagctgtgaaagatgagaacttgttactatttaagctgactaattcaaagtcatttggtaaaactactttcagttttaagaactagaagatttaagtgctcaaactagatggctctaataaatgcacaattattatctatagtcagtataactaattatcagtgaatccagaccttgatccattactcccctcacgtccatggattgagaagcaagaatctatttgttattagtcttatttcctccaaggtcttcacacaactcactcccttaactccattaagtttttgctcacatgtcacctcattgtggccttggtggaccttttcactctgttttaaattgagactctcccactcttgaccagaatgcctaatctctctttcctattttgtattttcccccatagcatttgtctgacacagtatatattttgtttttttatttgtttttggtttctctccactggaatggaagctccatgagcacagagattattttgtctgtcttgttccctggtgtgtgcccagcacctggcacatagtaagtgctcagtcaatatttgttagactctaaggcaatgtttgttttgaagatttatgcttaagtatgttcccaatgaccttgatggtttaaaaagcaattttgtattggttattttacttagttattcttacaacaacgtgttttaaggaaggattattatcccactccagcagatgagaaatgggggctcagagagttcctatgaattggataaaacccaggggccagcaagtggtggactccagcctggaacaagatcaaatacttcctttagggtgctgctctcacctaagctgtgaatctttctggctgggggaattaacacttcatattaagcattgccggccaggtctcaaagcagtggattccagaatgaaaattagaacagaatgtggttgtagaatacctgataaataaaataatccattatgtacagctctcaagggtgagaagcataccttctcagctacaacttgtatttgttcacctcctgagtgtggaagaacaatccatgttgaggccatgcaagtccacctcaaaaagtccctgcaaagcctccttaccttgcaatagaacattgcagctgcttgtatttcagtcctttctccatggcatttctatttcacatcatgctgtggttcaggaggcagtttgcatagtggttaaagatcacagaccccaaaacaggcagagccagacagaacttgaagcgggatgtggttgcagttccttcgggggaaattattctgtcttctcatctgtaaaactgggctaatggtactaagttctgataaataaattagattatacaagtgatgcactcatcactgccttaagtgttagtgaatatctcctgtatcccttctactaaattgtaagattgtagaaggaaatgcacttactggctttattagttttcaagttttgctataacaaaataccacaaactggctgtttaaacaacagaaatgtaatgcctcacagttctggaggctaggatctgagatcaagaagtctgtgggcttggttccttctgaggactgtgaggaagaatctgttctcctaacttccggtggttttctggcactctttggtgttccttggcttgtaaaagcatcaggccgatctttgccttcatctccacatggtgttcttcctatgtttgtgtgtctgcatccaatttcccctttttataatggcaccagtcatgttggattaggtgccctactccattataacctcatttgaactaattatatctgcagtgaccctattttcaaataaggccacattctgaggtactggggtttattacttcaacatatgaattttggggacacagttcaacccatagttctggccttatcacctttgttttttgttgtatttgccctgtacttaataagtggcagggcatggctgctgaatctgttaaagaaatgtctccagaaggttcagaaataaagccacttaccaacagctgagaggccttttgaaaactgcctcttcatccaaggattactgaaagaggaaacttctctctagctagttcttcactagactttgtgtttagtccttgggtcaggaagatacgtcatgtcgagatggatattttgattaggactttccaaatggaattttgtgtgtgtgtgtgaagagatagcattaatatgttcacatacggataaggacatagatatgctatttataacttaacttttaaaagatttatttgtttaaaagtctaggtaacagtgttcttttcaaaattttaggtgcgacttttcatctcataactgtgacctcaggtttgtgtgaataataaatgtcagttctttaaaatgttttacatcctttcttatatatgtataatgtggttataaagtagtgagcttggctccacagtctacctgcatgcctatagagtatgatatttcaattaaaattcatgttttcaaaattctaatatctaaattgcaatgctatattttacatatctgtatttttaaaattgatattcctaccacaaatcacttgcttaatattagttagaattctgtaagttgcttacttagaattttgtaagttacttatttatttgagcatttaagtgtgcatttataatgtattctaagtgattggtgctgaaattttgagttgataaatctcaggatttattgtgatggaaacgggactatctacagagcttgagattttataggtctgtaaatatttgttgaatgagcgaacatatggggtggaggaagaagcaaagtcatttcttttcaactctctttgaaccaatgaaatcaataacctacatggagtacaataccatatttaaagactgaaagcaaattttaattttttatgtcgttttattttctataatttggattttcttgtgacaccttgacactcccttaaaccttctacactgtgcctgatgctttcaaacactatataatggaaggggcctctaggaaaggcaagttgagagtagaggaaaaatgagcatacatttgcatagggcaggaagggcactgtaacatctggcaggggtagccaactcagtcgacttgttagtctcattaaattcacattaatgcatgaactgctctgaatgtgtaaataccattttgagttgttttctcccagaccaatggcattgactttgggggcccttcccttggttgtttacttgccaatggcatttgacctggggtcagacctgtatttaaccctttcctgtaggtcaaaaacaaattaatttggtgagaattaaattggaaatgagtcatctgtacaacaggtgttccctgtgggaaatgtgctccaggtggaaacattttaaaatctgttcctgggccatcttcgaagaagcttcagaggtcagggaggcaattccaagacatcccacgtggtgagggcctggagctggatgtacaggtgcccattcagtatggttttctcaacagcttggggaaattttcaaagaggccccttttggagataatttattcataaattcatgaacatttatcttgggcattcattgtggactgatttacttagatgttgccctaaatgattggaactttaccctttacccctacctcccactatcaaccaaagactttgatttggaggaaagaaaatattgtatttttctctttcttttttctagaggatgaggaagatgaggaaatggtggaatctaaagttggccaggactcagaactggaaaatcaggacaaaaaacaggaagtgaaggaaggtatgatatggaaaataaactgagtaatcattttattgttttgttttgtttgcctttactaatataagagactatagagctaagtaaaaattgaatttgcatcccctatatggaagattttctatgattgttcaatacattacatttagcaacataaactgtaatctccaaagcaagagtcatttatttcttgactgataaaggcaaataaagtgcaaaacgtccacaatttcagtaacaattttagtcacaattccagaacacttgttaccaattgccatgttatctcattcacagaaccatatattcccaatgataacagtaaagcaaaggactagatataattattttgtgaataaattctaaagtgttttcatgtgatctacatagaaacattaatagtgatcaacgctagtaactctgctattaaaatttttcttctgcaactctgcctgtataaggaggaacaacctcttacatgttctggtgataataataactaacatttattaagggctcactatgcccttggctctcttctaagcactccacagatattactcactccttacaacatcattttgaagcagatactgttattacccctatttataggcagagaactaggaagagagaggtctaaaactttatccaaggatacataatgtacaagtacatgagccaagatttagagttaaatccaaagtttacattttaccctgttgccctcctcataatagcactgtgcctgtaagtagaaagaaagaaaaaagaaaagaaaaggagggacatgaaatactgcaggtgacatttccttacaaacccaattttgtattactttgagattctcagcccatggagacagaagagaattttgaacttgtcttacttgctggcaaataaatgaagagcgggacctaagaactgtgtagattaaaaaggttcttccatatttcctaatgagtgtcccaagtatagatcaatataactctgattagaagctcatttgatctgtaaattttaaagatggttgtggctctggcacagtgtggcagatgttcagcactggggtctttgtaggaattgatacctactgatcccaagtactcacttcaacaccttgtgctctcatgagaaaattagagaagcccaaatgcctattacaaatgacatccatatcatatggagttaaatgggacaatttttttttttttgagacagagtctcactctgtcccaggctgcagtgcagcgacgtgatctcagctcactgcaacctctgcctcccaggttcaagctattctcctgccttagcatcccgagtagctgagattacaggtgtgtgccaccatgcctggctaatttttgtatttgtagtagagacggggtttcaccatactggccaggctggtctcgaactcctgacctcgtgatccacccgccttagcctcccaaagtgctgggattataggcgtgaaccaccacgcccagccacaattttagaaaattattaaaaatcacttcatattgaggctcatttgaagtgtgtctgagtgtaggtgtttaatttagttttggtttgttttttgcaatctcaggtatctaaaggccagtgcaagatagtaatgaaaaagcatagcctctggagccacactacctgggataaaatcttgtctctgtcaattattagctgagtgatcactacagactaagttagtttaacctttttttgcctcagtttccccatctggcaaacaggtttttaaaaaactcaacagggctagtatggaacaatacttggcacaaagtaagtgctgtataaaagtttgctaaattatcattagtagtcttgccttgcagtgcctgggtctataactggtttctaccctgatgggatggatgcccttgggggccccagctctctgtgctcagctttgccatagcccatagctttgaaatgagaacatggttacaggggccccagctagctagtacatttaaaaaatgtggaactttcaatagagatgcaagcaaagtcctttaaacttgttggagaactatcattaaaggtcttatttctgttactgtgctaggtctcagacattgagaagttcaatcgttgtcaagttctagggtgtgactaaggtttaggagaagattcagcattttaacagtggcatccacagaagacacaaggcttactctttctgagagtctaaatgaatttgatcgaagagatctcacatttaaacttatactaaaaacgtcttttaaaaaaaaagttggtgagtagaatatcatgattacaggtgtagtgaggtacaaaataagtcaggatctattaaagtactcctttaccctttgcaaaatattcttaaaatacacctggtgataaggagccagggtatattttgtgtgtcttggcatggattccccatcaccaccaccccagccccaatctccaagtcgtcttctccagcaaagcaaagcaacctccttcttaagttccaagcgaaaacacccttcagttttaactgttactcgtgcttcatggaattgattaaagtcatgttaaaagtcaaaaagaagtttgaaagaacatttcctgttcctgctgcactgtatgccttattctccattaatggcttttctgcaaattaacacataatgggttaaaaggatgtttatgttggcatcaaactctggctttttttttttttaaagcaagacagtattttgcaaacttttgaaagaatctctagcagatataatcgtggcgccattcacacgactgcatagtagttagggctgtgtcagcacttccattacgaaccttgcgtttcaaggatttattactcagccataaagatttgctctgggctgaaacttgacatacacagtttcaaaccagggaacacatttttgagaaatctggcttttttttttttttttttttttttttggagtgaaaaggaagaaaaaggtggtgagggggacatggggaaaataatcagtactcactaacttttgacatttttgcccacgtgacatcaaagtgcattaaacactaaagaaatgcagtcttgatttattactgtttcacttttttctgccatagagtaggaaaaaaatcaggtatattttagcttataatcaaagtttagaaaacttctatatgtcagtgtcctcatgtcttcatgtttagaaattcaaaacaatacaactgggaacctaacatttttgtaaatacaaatcaactcataaacctcacattgacgtcaaagaaagatgtccttcacttttagtttggtttggtttcttgctgctgtttatgaactgatttcactgtaaaattcccatgagagccactgtccttatttaatctaatgtttttcctggctacatgggttttattttttatctcttagagatccttgaaaaatatttttgaataatttttatattgaaatttaaagcagcatcactgaaacaagtcaggacatatttgtagtagatatttttaaaatatcttttaacagaaatgagatactaaaaaactcagtataagttgtgaacttcattataaattgtacatttttatagagggaaaaaaatcacaagaaggcagaacccaaaagatatagtttaaagtagtataaattaattaaagagaaactgacaaagtatacattgaggatagcaggaaaggtcaagaaaacacggcaaatgaaatacaatcatgcttgaaagatttatttaaaagtattttcatataaaaaataagaaaaattaacatttctacaataaaaagtggaccctaagtgaaatttatattctattgtaattttgcaggccacaaatttgtagaattaggctgtcttctgaatttcatgtattctgtaaaatttctttcatacatgttattcaaattcaatataactggttaaattttggtaactttgaaaattgtcttatcatttggattacatgtaagttacatccatgcattctacttttcatagtgtagaatctacttcttcttaaagagctctttaaatgcacaaagtattgttagctgccagttcttggcagaaacactccatgttttgtgttgtgaaaacaaagaaaaaaaatctgctataatagtattttctgcttaacctataagaaaaactattatccatgcccacattttgttttggtatgccctttgctattaaatcctatctttttaatgccatgaacttgttaaaaataatttattagattccagggatagggaaaagctgtagaaacagatacttgaggtagaatatggcatctatcttggagtaaaacaattctgattctatttgtttattcctgtattttgaactttgtggaatccattaatcaaccaattttctttcatgaaatatgatgcctggagaggtttttatctctgaatacaccttttggttgtggttcctggatactccattatgttttcatgatattgaacaacacttatcaatttaaagatctttgagtatgggtggttttgtttatttaatcaaaaattactatggccctatttaattaagttgaatattgtttatgacttttaaaaagtactcatctgcacatgcatctgattattttgtgctaacaaatcatgtcatttgatccctgtttgacatcaaagcttaatataaaatgtatcttttgtttgcttctgtagcattttaatttcaagccaaatattgtattgtcaatcataatatctggagaggctagtgctccacctacctgaacttggcctctgcaagcacactttgatcagccatttatgtttctgttagagaagaagttgtgtgtcttgaaagctgagatcaaagtgacaataagctacagggaagaaaaaaattacagaaaattacatagataccattttttattcaaggtaatggacctgtaaggaaagatacaggtgaaatagaagtggctcaaaaagataaacagagactagaaagattttttaatatcttaaaaaataaaggagaaaaattcctactactttgtttaatttcaagtgtgtctcaagtcatctattaacagtgaccaaggccaagtgagtctttttgaataagacattcttcttggcctatagtattcttgtttagtcaggtttattcatttatgtaacagcattaaccaaaacaaaatggacttagtagggtttgttccccttttgcctagttccattttgtagttttattatattctggagtgaaataattcaaatgtctcatttacaggagttttagaaagcagactagtaaattgctacttcattagtaattattgaagcccagcatatttagctttaattcttaaaccagacttaaagtttaggtatcatccccatttcatagataaaactactgctcaaagagcttcagtgcattgattaactaatcaaatctagcatatggcagggtgcttgattgcaggttggtgtcgtagagttctttgtgttatttatgacctccacctatttccccactacctagcctaagtctgagtgtgcatattgtctgattcagcatttcacaaactagtgtctcagcagcactgctcagtagaagttaatggggtccttggaaagtctcagtacacactggaatatttagggctctggagacctagacagcaaagaaatatttctaattttatttagggctgctagaaactatgaggtggggtgtgttaggagaaattcttctgctataatggatgaatcacgtgttgccctaatattacctggagagcatttcttaaggtgtgaaccaactacatcaggatcattctagtttcttgtacaaatagagattctcgtgtttctccagaccccctgcctcatggtctggggcagggaaggggaggctagaaagagggagatgttacgaacattggatccactgccatgacttgactctgtagaagggcttcttgacactacagatttcttaggcttcaagatacaattagtccaattatgtaacactttcataaaatattgtgctacaggtgatagtacctaaaagattcttctgaccatgtggccaggtggaaatcgattttgttgttaggatggttgtggaagtgcttggaaaaccctgtaggtgagtgattccaccagaggctccacctgtgattgtaatgcactaccctcctcctgtaagtttaacttcaggagcttctgtactacttactgaaagagtaaccaatgaaaggtttattgtaggctctctccaccagagttgaactagggttcctgaagaaccacaaaggttcagctgacagtttctgcccttgatggttttttggtctggggagttcctaatcccttccctaaggttttatgtaaaactctcaattgaaggaatggtttatgtaaccaaatggtgactctaaggtgagctcactttcagaaactatgacatgctactagttatttgatctctttgtctcattttttatcttcaaatttagtttgataagattaatcataccagaaaagtaaggcagaaaaacaattgtgggttgttttatagaagcatgtatttgttccatgtgtttgtttaaaagcagaagatcttgagtgaaagcaggtttggaatgatatatctctgcttttgaatataatttatataacaatcagtcagccttaccaactaaccatttaaaataaaatgaatttatgaatttactcagtagaaaaaggaaaggtactatgaggatcatattatagagtgttcctaattatttaatattgccagcttgacaatagtacaatagcataatagcatatataaatacatagttttgtgaatttatctattatgccatatttaagctgtttttcaagttaaaaaaaacatttagaactgattgctaaaaacacaccaatctatttttatttgtaatcttcttcaactcttcaaaataataattagaccaaatatgcaatctttttgtggggacatctgcagaagcctttggtgtgaatttgtaaataatttagaatcaatattagcaatgatttgtttcactgtgtcttgccactcgtttgataagcagtctctctcaagaattgggttcctcttgataagttttaattgtcactttttcttccctaacaatctcttttacaaaaaaataaataaataaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatgggttagtctcttgtgtgcattctttaaaaaatagcgtaagttatctgttaattctaatttatttatgttctgactaggaaaattccaaattaagaaatcagaggagggtgaaattttggaattgatcttgctgaacagctttgactatgggctttggtgataacttctggcttagagcgtccttgtaattatcatgtgcttctgtgaaatgcttttgaacttggtatctggggaacagtccaggtgatagagactggcagagtcacatgcattatcctctgagaaaacattcttttgagcagcaaaggagattcatgttgtatctactagatttattcctgatgtccaagcaaataggaaattgaagaaaataaacatgaggtgtgggagaagttaactgatgtgtgtaatgatgaacagagactggaaaatgtttcctttttttggtatcatgaaagtatgcatatgtgtatatgccttttaggaaacatattaatatatgtaagaatatatttccaggcaaaacaaaactaatcaataaaagcaagtgtccctaaatgacttcctctgtgactgtagcataggtattagaaaaggccatgactgtcaaccatcatcctggggagaataggagggactatatgagccttataaacataaatatagctgttcttagccacagatctcttttggccaagaatgatatgtgaaggtagggtcacttgcctttttcatcaggcctgattttttttgccatttctaaaatccaaatacattcttaaaggacgatatcttatcatcattgaggatgctcaagggaatgtaacagaggcatgaaaaccaatttcaaaagggagtcctgtacatgttctcaacagtaggcagcatctttagactaccttgaagaaacaacagtattttgaatatagatgctctacaatctttgtgtttttttgaaaagccatttttctatgactttcttgattttgttggtcctatttccctctgtgtgcctggctcagtattatcctaggctcctggcaggacgtgtgtgtgtgtgtgtgtgtgtgtgtgtgtgtgtgtgtgtatctcctgagtttgcaatggcggagctgaggaagggttaacagaaaaaaaaatgtcatattaggtttactaattagagcccaaataacttgttggaagccaggtcacccagtctgaacaagagccatataagttaagtgatgcagggcgcaagccagcagttgaagcaaatgaacagaggaaaggtgggtgtagaagaatttctgaaccaaagcccaagcaacttaggcagctttttatgcagatcccgtagttcctggtccagaacaaacattactcgatgtaaatactcagcttgtggagcagctgcataaccagcactgagttccttgaaggaggtgttatggccagttgagtgtcagccaagtaaacactggctaaagtgtaatcctcctagattcagatgctgttttggtccatggcagaagtgataagtatctggaacatatctggtgaatcctccactgtctaccacgcctgtctcatggtagaaattatcacttactattgagtgaggaggctactgctacagcctgtcagcatttacaagtaaataaaaacatgcatatcatttccggtctaaggacaaataaggtagtatcgatatcaaagaatcctctggtgtgctgtgctcccttgatagcagagatttctaataagccctgcttcaggccagagcctttcagggagaggctctggcctgaaccagggttggagaaagcttgggactggtcaagatgggaacttgaaacaaatctgacatttcataacagtcttggaacgacatggaaacccttgccaggtcaggttagaaagagcttttcataaagaagaccatctttagttcattaattttgatcagggtatgtagtctagattaacattttggcctcagagagtattgtgtgccaggcttttgccatatcagtgcttctatatgagcagcatagagaaagagctccatatttatctctgatgtttaaatcctcctagggatgttcaggctggagccaatctttctttcaatcgtcagttctatgatgaacattggtccaagcatcgagtggtcacttgtatggactggtccctccaggtaagaattattgctgggctgggacaaactgggcttgtgttctcgtggcatttgtataaaaaaataagagatttgtttacttgcctacgatttcctctctatgcctgttggtttttttcccctcattttattgaggtttcagtttcaattctctactcagttatttgtatttattgagtacctactatgtgctaggtaccaaacaagaagccagattgttctgtccatgaaactattccattaagattaccactgatttcctacttgtcaaatcctgtggatatttttaatcccacatctgtcctgacctttctttgtcaagcagcttagtcagcttccttgtgcctatagaaacatcctctttccattgaattctcactactcctctctactgtctcctagttctctgacttctccaggatttctttttcctctgaccatccttgaggtccctgtggtcatgctctcaacccctgctcttcttcctgaggtgctctctgcaggagatctcttccactgctaaggattcaaccacgaacagcctatttatatctcccgcccaatctccctgctgaatttcactttgtacaccagacagagccactattctaggtgtcccatagaatcttaaatgaattagtaactcattattttcatatatcccaaatccttttttacctgttatatgatctgtatgttaaaggcaccacaatatacccaaaagcctaaagcagaactttcatcaacattgccaacttcctcttctcttccagacccagtctgtcacgaagactttccatgtcttcactcatgtattcatcatctaatactattcttaaccttcaaactgatatttctaccttcatgcttgtccacatacagttttcccctggagaaatctacccaaacaatctttctaaaataaaaatctgatcactcggctgggtgaggtggctcaagcctgtaatcccagcactttgggaggccaaggcgggtggatcgcttgaggtctggagtttgagaccagcctggataacatggtgaaaccccttctctactaaaaatgcaaaaagtagccgagtgtggtggcaaatgcctgtaatcccagctattcgggaggctgaggcaggagaattgcttgaacccaagaggcagaggttgccactgcactccagtctgggtgatgcagtgagactccatctcaaaaaacaaaaaacaaaaacctgatctcttcattccctagaccaaaactccccattgcccgtagaaaagaagtctaagcccatcagtgtggcattcagagtgaaagcaggcaaatttaccaaaagccaatttgctgaatggccaactcaactagttgacaatataccgggcactgagtaggtaagtaacatgcaaaggcacacagcctagtgtggtgacatcagaatttgaacctaagcatctgatgcctgagcccacattcttaacaacaatgttccttcctgcaataacactgacataagaacagtgagagaagcaggaatgattactcctaagcatttatgcacagcacagtttctgctttcttgttgtcaatgcttttattgggaataatagtcatagctagcttttaatttatttttcttatatacaaagcaccatgatagctgctatgaaggctttcttatttccccctcacaacaatcatatgaggcagccacccttactatttccatgacatatttgaagaagttgaggctcagagaagctaagtaacttgctgaaaaatcactcaactagggtatggtatagtggggatttataccaaagtattttagcatcccgtggcatatgctcttaaccactgcctctcacaaagagcttctggatctgaaactaaaagagcttgtaaaggtgcagaatgatatggggcagatagcaagtgctctcaaagttcagtggaggttggaatctgtctctggtcagacagagcttctcagaagactgggatttagacaaatggaggggagaagagggtgttctaggcagagctataaaatggtaagtcccaattaatcctattggagaacaggggaacaaaagaggggtgtaattccccacaactagaccctcatcagcaataaagtgggtgaatgttctctcctcttgaattcctttttgtatccaaacaacaaagcacacagtgagtgatcttgcagagacgaagacaagcagggtttgcccaaccactttccaccagtgtgtgggtggtctctgagcatgcttgagtgtgtgcacagaaatcagatccaagcctgaggaaacacttagctcagcttgttcacttgttcagagttggggaattacacaggaaccttatctgacacattcctcaaaggcaactacaaccttgttcccgggtcagctgataacactccctgaggaggcacggggtggggctggtcccgccttgcctcagtaggtgatgggccacattgcctgtggaggtgtttccacacagggtctcgcatgatgtttgtgttggaggaagtgaagttggaaataacagaaactctaccatggagagaccacatttattttcccctatttttgtgtgacctgcttacctacgctgtggggaagaggtttgcaattttgaaaaatgtgttgtatatgaggcgtaagaaaaagagattagaaccctcacctcctgcatcacaacactgttgaggggttcaaaggaccaggattacatacttatgggataaagagactttttgatggatttagatgcaatcgaatgatattaagaaagaagagagatagaggaacagtcttggtgtgcagtggtggcgtgtgtgtctaggatgatttcctgaatgtaacagaatagaactgagaggagaaaaagaaagaaattataaggtttcagcatagctttcctttgatctcctgggcttcttaaaccagaacactttaactttgaaatatttacaaaatatcatcaaacatcattccttggaagaaatctgggaagctggaggattatgtcaactttgtcacccattgaacattatttaacacagtcagtcaataatactatcacataccacgtgacagttttcagatgtgtgcagaatcagactcatgatcttactcccaccatgtatactcactcctctcacatgtacattgcatcttccactcctgcagtcatccaggatgcaaacctgagtaatctttggcaactcagttagttgctaaatccaatcaaatttacaacagcaaaaagattactattgacaccagtgccaatccacgaacatggatttgacacctactttatgtcatgccctctacttcttgcttatgttaggaaacagcgtcttactggtctccctactgtcagtctctataaggttaagtcagtataagtacttttacctggttaatctttgtaaagattacttatacactctgtatcaacttgggcaaattgcctaacttctcttggcttaagtttcttcattcatgaaatgataataatacctagctcacacacttattgtgagtgttaaatgaattaatgcatataaaggaatgataatttggctggacacagtggctcacacctgtaatcccaacactttgggaggccacagcaggaggatcacttgagcccaggagttcaagaccagcctgggcaacatggcaaaaccccatctctacaaaaaatacaaaaattggccaggcatggtggtgcatgcctgcagccccagctatgtgggaggctgaggtgggaggattgcttgagcctggaggcagaggttgcagtgagctaaggtctcatcactgcattcaaggctgggagacagatcaagaccctgtctttaaaataaaataaaataaaataaaataaaataaaataaaaataaaggactaataattttaaaagtgtctggtgcataagaagtacttgataaatgtgacatagtagtgagaagagcagtagcagtattatcattagttgcaaagtgtgacttctattgtcccccagaataaaatctaaaatcattagcctgtgttcagtgacttccgtgatgatgccctgaggcatttccaggcctttcttcttttatacatcttgatatagcctgcctcctagccacatattaatactacaacctgatgtctattggacatattcttcttcactgtattggtcaaaaagacttcacctttggctaggttaagtagacagaggaatttactggggagccattatagtagttagggaattcatgaaaaagatgaagaactaaaacttagaaatattaggaatctgggcagcccgagggacctcaccaacaggctgctgtccttatccagacccctttgccagctcccaggtcctgtgtctcagttcaaagtttacaatattctggttagagaacgcctttggctcagctgggtcaagtatcaaccctgcaattaattaattatccctgggaagttaggcttctgttgactggggtaatctccaaagagagagattcacatgaaccaggcagataccaagaggggtctcctgcacccctctttggactcttgtccctgctgtcatctgtcctaataacctacccacttgacaaggctcaaggtctcatttcttctgagaaatccctttcaatttctcttcctgccacaccccacaccagcttccatgcttatttatttatttattttgagatggagtctcactctgtcaccctagctggagtgcagtggcatgatctccccttactgcaacctctgccttctgggttcaagcgttctcgtgcctccccatcccgagtagctgggattacaggagcaagccaccagggctggttaatttttgtatttttagtagagacggggtttcaccgtgttagccaggctggtcttgaactcctgacctcaggtgatccaccctcctcggcctcccaaagtgctgggattacaggcatgagctagcatacctggccccatgcttctacagaaccttgcttctgcctctgtcttagcacttgtcatggtctgcttttttatttgtcttgtagttacttctacgtgtgtcttacctccctccatctaatgataagttcctatagagaagagcctattattcagggcattcatgtcacatattttacctgtcatggtgccttacatatttataggggacacttgaggcatgccacagcagacaggaaaggagaaggcttttgaagcccaacagactttaagtggggttcttgctttatcacttattagcaacatagcatggaatatgttatttaacccaggactctgggtttctttgtctgtggaaatgagtaaaccattgcctaccttagagggttatgaggaccaaatgaattaacatatcagtgtctggttcataacgggcacttaaaacatgatggttccttcctctccagtaaatgctaggttcttttttttttgacggagtcttactgtgtcacccagactggagtgcagtggtgcactcttagctcactgcaaccttcacctcctgggttcaagcaattctcctgcctcagcctcccgagtagctgggattacaggcacacacaacctggctaatttttgtatttttagtagagaaggggtttcaccatgttggcaaggctggtctcgaactcctgacctcaagtgatctgctggcctcaacctctgtgttggaggcctcaacctctgccggcctcagccactgcgccccaactaggtttcatttatttgttagaaaaaaaatggggttgagagcatatctggtaatttccaggtaaaattctcctagggtaagtattggataattcagctctatgagtaaccaaatgatcatgaatttcataattctttatattctctttaaaaacataacttcgaacaacacttaagattaaataattgtttagagattttttattggaaaaagaaaatatgactagtcatgttcaaacaaacagtggaaaaagacatactagagggcaccttgaaatcccaaaaacttgcgtgagataaaatttaaatcagtatctttaggccttatgatctcagttatagaaattatgccaatgacatttcactggtaattttactaaagcactccctgttttctaaaggagttttaaagctaaataattttaaatatttttaaatggaaaaagaaaagctgcaagtgggtaccaacaatgagacccagctgggtgatattattgcagaaacatctagctgctccttagcccctgtggtagtggtgttgatgtttatagagttgccttttcacatgtgacatagttaaacttcagatggacagtctggagacttctgtgtttatctggatgttagtttctttgaatgggctttgaatcaaaggctttcttaataggcctttgattcatccgctgcagagtgttttttaataaagaatgattacttcccctggtggccacatacatgtgtgtcactgtacgcttatacttcctctgcacaaccagcacattgtaactctctgcagatttctttagttgaggctgctggaagaatgaataagacttagatgtagttatttttaatagaaaaaaaagatctgtgttcaaattcataaaggcaatcttccattaaatatatgtatagaataatgaaaaaggaggaaaaaattaaattataagaagagagtgatacggtctgccataatcctgatactatttttaataggactgccttttgagactcctatgtaggaatgacattttcatgaaatgtgtcctaactcataagtacttcctatgagatttatcctcagtttatttagtaacactcaggacagagtttttgtagggtgagtaggtctttctaatacctagaatcactatagagtccttcttgttattttactggttatgtttctggcatttaagcctttaattattagcattgtttgacaacaaaggatgatatataaagcctttctattgagcacagaattactaaaattaaaaattttaaataattaaagaaattttggcacaagtttattatatgctaggaattgaccctggattcagaggtcaacaaaaaccagtccctactctcaaagagcttgcaatcgagtgaaagacacaggtgtagaaaaaaaattataatgcatttgacaagggctttaattggcaggacagacacatgatacaaagggagctgataacaggcaaggaaggaagtggttggttaagtcaggattgtctggaggacttgatgcctgtgttgagtcttaaaggatgagttaattatgtaaacaacaccaaagggtcatcccagtgagagtgagtatgagactcataggtacagagatgtacctgtgtgcctcaaaactaggccagtgaggctgggtcatagggtgtgggaggtggggagaaagagggaaggttgtgggagagtaagcaggaaaggcaaaaaatgacagattattaaggatcctctgtgacctgcattttgccttgaaagtaatgatgagccattaaagtattttaagctgaggaatgacttagccaaatacatattttgtaaagtcttcctgataaaggatggagaatggagtaggtcagtataggaagccatttatgaagctgctgccttcatccagataagaaattaatttagcaggctctgaccttaaagatagaaagaaaatattcatttgaaaggtattgaggaaatagggaaatttagtgtgtgggagtgagagagagaaagaagtaaaaataaatgggccaggcatggtggctcacgcctgtaatcccggcactttgggaggccgaggctggtggatcacgaggtcaggagatcgagaccatcctggctaacacggtgaaaccccgtctctactaaaaatacaaaaaattagccaggcgtggtggccggcgcctgtagtcccagctactcaggaggctgaggcaggagaatggcgtgaacccctgaggtggagcttgtagtgagccaagatcaggccactgcactccagcctgggcaacagagcgagactccatctcaaaaaataaataaataaataaataaataaataaataaataaataaataatgtagaatggctggcctgggccaggcgaatgttagtgcaagaccctaaaatagggaacatggaggagcagtaggttttgtgtggaagtcaatgagatcatttttctatgtgttacaattgatgggtctatggacagccctgagaaatccccagtaggcagtcagatataaagacctgcatctcagagagaaattaagcctagagatatagatttgaaaattaccagcatgttaagcttattaaagccactggagtagatgaacttactcagcgagaatagccctccttggaatttatgtaatagaaggagaacctgcaggaactgaaaagagaagtcagggaagaaaatcaggagagaaagatgtaatggaagccaatacaggagaggaagggagtagcacaaagtgtcaaataatacggagaggtaaagcgatgtttgtagtttgatagttaccggtgagtatgacaagcgcatacagagtgttggaggcagaaacaagattgcaggaggttgcagcagtaagctgatagtaggtatgccacaacataacagaaagcaccatttacactgtgtagtataccacgtgtatgtaggaataacaaagttttccttgtgttgtcatcttagcataattcatccttgtgacctcttccatttagtaccctgagctgatggtggcttcttacaacaacaatgaagatgctccccatgaaccagatggagtggccttggtttggaacatgaagtttaagaaaaccacaccagaatacgtcttccactgtcaggtaggagtcagcgtagtaaaaataacttacatctcctgctagaccaaatatagtttgtgctgcattgcatctgtcttatgctgagaggaagaactcagtttaaaaatgaaattgttgacaattttggaaaattcccccacagtaacctaatgttttgggaaagtggcaaccctccccaaacagttaggaagcttggttagggactgtgtgtcattttctttctatttaaaacagcccccatgaggatgagtttataaagacctcgcacttatgaagaaatcgtggtgtaccacttcctctgcttaaaagcaacatatgcttgcccacccacgtggacatcctcagagcactaccatttcaagtctcctactctcttggaaatgcagttcaatggattttgctgactttaagtttatgggcgccatactacttaacagataatacttttgtagctggcatggggcaagacttaccactcgtatttcttgagttgctgggaaatatagatgctgtttctggtttgaaaatgcagagataatttcaaatatgtttgtatttttcattccttctctctgcggacacgtcttctcttccccttgacacaatacaggctgaaattatggtacccttgtacacgttcagcattgctctgttgccatgactctgcctaaataataggcctcagcataggccaatacaccaacccctttattaatgctcctatcctgtgattatgcacaggcaaatgaaaaacaaacatttcagctcaaaattgcagttcctcaaatgttaacaattcagaggtactgagtggcagattactctgaatacaaagacatcatttgaagagggtgggtaaacctgttgatttttggaagcttagtgccattttctatctaagagccaagtatctttttgaactaaaatatgtttagactttagagcattatcagatataatttggggaataggagctgctggaatagagtcccagcctcaacctgattgagtaacctctaactctggccatgtttttctaatttgctgtctcaaaaacaacttaacaagaagtctagttctgtatggtaaataacctttattttcttagcctttgaaataagaacggttctttctttttttcttttattttttttaagattttcaagtcagcttgatatgctccttctgtaaacatagaagcacaaaatcctaattttgttcagttttacaaggtttgccgaattcccaggaaaatactgtaaggattaagaaataaagagaagcacatttttgaaaaacagtgccttttaaattattttgatattacagaaagtctttgattttaaaaatccaacaataatacattattataatcaatatgtatgatctttatcatgatttttaaattttaattatattaactgactacaggtttctggaatcaactgtaaattacttgttttaccacacaacaatagttaatactagtattaattgaaaagggcattcttgtgtgtgtgtgtgtgtgtgtgtgtgtgtgtgtgtgtgtgtatctttgggatcattgactaaacatttctccaacaaacattttttttagtttctcccttaatgatccaatatatgtcattgagaagaaaatatactcgtgattttaaaaaaaaagcaagaggtaccctaaatatagtaacaagatagtcataccagagttaccaaaagatgctgagtaaaatagttgattccaaaaacttgtagtcagcactttgatacaggtgatactcatgaagttgggataaaggtcaggtaaatatcactggctgccaaagaaaaacaaaattgctatgatatttagtatttctgaactgttgggagacaaaatcaggaaactttcagcagccagggaagtcctagatgaaatagtgatggaggttaggtagacagataacataataaaggcaatttggttacctttgtactaaagtgtaatacctgtagcaatatctacgtgtttctgtattttaaattttcccaacacttctgccttcatgatctcattgattgtacaacagggaggtaagaaaaatgttattattctctttttccagttgagagattttatactttagaggttacccagctagtgagcagtagagccaatcctggaactgaggcttattctatcgcatacatcgtgccatcacctaggctgcattctaaaaatgtgggcagacatgggacttgatagcaaaggctgtacagcccattcaaggtatatttttggccacctacccttataaggtatcgattagacatggttctagacgtggctatctttaccaccttctaaccctaaatggaaatttagagatcccacagaattaaaatatatatgtggaaaaaccaaagccttcactcactgacctataacttttcttctatcctatctgatctttgctaaatcttatttattacaactggtcatttctagacactaactcagggaaatcacgtcgtttgaatgtgcttccgcattctcctgtgatgttctgataatttcaaaattagacaattcattacttagaaaaagggcagaggtagagagtagcaagagtaccttatgatgactgtacttttataattttggagtaattgcgtagctattcatttcctgctgatctctgctgattcttcatattttttaaaagtgtataattgtaaacaaaaccaatggatcagagaagcattgtgtcagtcagtggaaagcaaatgcacaagaaacagacatcagctccatggtgttttgtaaagactgacaagcttttagcctactcataaaaagattttagtatatagtttcatttctctctgttatggatagcaaggccaaaaagtatcttctactgtcacaggcagtttttgtgtctttactaaactgaatttttagtgtgatctctggtcctgcattttctatttttatttcaataaaagctgtctgtacttggaaaatattggtggaccctgcatagaaatcagccactcagccccataacacactctggcagtgctcctgctgtcttctgtagtggcttccacacactgtcattagattatgtgtctgaccaccctgcattgcttaccctggtgtggtctttctcttttaaatggaatgaatagaatcagaaatatataccttagaattatctgcgttgaggtaaatgtaaaagctatgtttagagtcttagcttggtcagaggtttttatttttacttttactttttggtgatttggtttctttgttcttggcaatctcttttagaggtggacctgacaatgacctgaagctgacaatcacctgaaaccctcactatgtcagggcaaagcagagtgtgaagtggggtaatatcagctaacctcgtttgtgtcagtgtttaaagccctcagtctttattccttcatgggctttgcttcccgttaagattctataaagggtacagatgtcattgctgcacacggcctcagctgcccagtgtttgattctgtatgacgttcctgctaacctcaaagagagttccgcctgtgaagagtgatggtaacagaggagggagtgtgggctggtggttaggacagggacagaaagttaggactcggagttccattcctagctgactgcactgctgagtgaccctgggtgagtcatgggggctttattgttgtgtttcctgatcccatgcaaagaagactttctctagtctctggttcaattgtaaagtttatttcagtaaacctcatttcttcctccatcaatttttgtccctcccccaacccagattgtggtctgtaatccaaatctacaaaacggctgtggacacagagatataaattaattgacattaactttgtaaagtatattttgaccagagaagtgttagaatctccttaaggatttttatttatttttttaaatgaaaagaatagtaacttgcttatggcccatctgataaaaagaaaagggcatcttctaagcttttctcttggctaggctaagaagtggttattacaggtcaaaaaagaaaaacagataaaagaacagaaagttctttgacaattactgcttcatatttagtatgaattcctgggattcaaaatgaaagcacatagtaggtgctttataattgccaaataaactccatggctaagaatatgaaaaccagagtgagacccaaacagttttcaaatgtgatattcaaagtgcctcaggatgggaaaacagaagaggaaacctcaaccagtgttacattgattatcatacacattttgaagaataaaatcatggaaaatttaaacttaacttttgacataaaggtaaaattaaactcttacataaaagatacaacttacatggatcagaccagagaaatagtgccacaacattgctactttgtgcctttcggaaaaggcataagggaataccagtatacatggtgaaatgaaatgcagacatcccaaaacacttcttttctgccaattgagaatgaccgatccgatgagctagacagtgattcttattaaatcaaacagcaggaatttcattttgctttgcccaggaagctggaagcagaaaacctgcccctccagctttcattctttatctaccctcctctagagtcttctccaaaaagcaactcatgaagaagcagaagtgatcactgggacacatctggggaagttagaattatcagctggattctagcaaagagattgtattgtaggtgattcctcatctgaaaacagcaatgaaggagattatttctatacctcatggagtatgcgagggaccaagtgagctatttgatgaagaggataccatgagaatacacctttaaacaagttgttttaaaatcgttttatttgtcttgccatgacacattgcaagtgatcaagctaaagtttcatatcattacaaaaactagcctcttactagcatttgctgcatcccgttaatgtgcacacatgttgtcaacacagaactccagctgattctatccagttccctaaatgcccttcccttctctccccatccactgtgctacaaccatctgaaccaggctttctccactgtgcttcattcaggaagtatcctgggaattatggatgctgtgcagtgagagccagattgcaatatgagcacgtttgctgtcttgtccctcccttccctgcaatacccacccacctccagccattcactgaggtgagagaagccttggtctcaggaagatgggtgttctgaggggtctgggttgaagatggatgggattctaactacctcttaagattataataaggataatagaaacaatatagttatattagcctgctcaggctgctacaacaaaataacattgactgggcggtttataaacaacagaaatttatttttcactgttttggagtctgagaagtccacagtcaaggaggcagcaaatactgagctaaaatgagatcagtattttaataactggtaaggttatactgtgtgcgtagccttacacataatgtaatctgtgagagctctcttcttggcttgcagatggccactgtcttgttgtgtcttcacatggtggatggagacagtgagctctctgatgtctcttataaggacactaatcctatcctatcaggtccctaccgttatgacctcataaccttcattacctccttctggtccctatttccaaatacagtcacattgagggtgggggcttcaacatatgaatttggtcgtggtgggggaagtacaattcagtccatagtaattggtgaacttgctttgaaatgataaaagtattctctttacatctgtttgttttactattattgcatgatagtcacgtgggaagaagcttaaaccttggcatttttatttttcttgctaggatatattcctgaagaaatttcacctaacttagattcattcattgacccattcatttgttcattcattcaacaattattttggaggtacccaccatggccaggccctcacagcagtgataggctggaggtgagaccctctccacaagagcccttcagttttccccaaccccaaccatgcttaattttccatcacctgactggctcctctcaattatttctattgcctaggccctgttcacattggtcaaatttatatgtgtgttctttatattaaaatgccagttgatagagggaaactgagacaattccaaagttctctcatcccaactatttaaccatttgttttctaactaaatgatgatgaggtattttctgagttctgggaggaagttaagtacatagtggttaagagtgagctataaggccacacagcctggaattataatttggattctaccacttagaatctctgtgaccttgagcaagtcaaatggttgttatgaaactataataaataaataaatgtgatgtatttagtgacaggcccatagtaagtacccagtgagtgtcagcaataattattattgaatatacaagaatgaaattcaaaatatgtagcaatctttgtgtattgtccaaatagcatggatgtgacctccctccttagttgctgaatggggggttgtgactgaggggttctccagggaggtaccaattcattcaggcaacaggagagtgctggggacaggtagagaagggcatcttaccaatgagtacaaaataagctcagcattttttttttggttttggtttttttttgggttttttttgtgttttttttgtttgtttgtttttgagacagaatcttgctctgtcatgaggctggcgtacagcagcacgatctcagctcactgcaacctcagactcccaggttcaagcgattctcctgcctcagcctcccaagtagctgggattacaggcgcacaccaccacgcccagcaaagttttgtattttttggtagagacaggatttcaccatgttggccaggctggtcttgatctcctgaccttgtgatcctcctgcctcagccttccaaaatgctgggattacaggcgtgagccattgtacccggctgaactcagcattttaataacccataaggttatactatgtgtatggcttgaatatcatcctgttattgtgcttttgccacttgcgaggtacagatgcattggcttccttggctagactactcacactgatggccccatgccccagcttcataaatgaaccctcttgtacctacgtagctcacatggctacaatgaattatttagagactaactggccatttgccgtgcttaacacactctgtaggctatgaagcaagaataaggatgatggggctgaccaatgttttctactttcatttaataccagtttagcatatctgttaaaagctgtccctcttagagatatgtatgacccaaggacccctttggtagggcttccattctctggactatcagattatgcattttctttatcctacaacattttcatataggcaagagcaggtttaaaagaataccaggtggtctgaaaggaaagagaagtctcagaagggcaacaccctccctcagagatatgtgcatgggggccctcctttcaggaaaggaaccagtacagagcaggagtgggctgtagttgccccaggccagatgagtccccaccaagagtggacagaggccactaccacccccgagagggatacttgtatattgctttgtcttgtttatattctagggatggaaccacttctagactccagaccatctattttttaaaaatatagctttttctccctctgcaaactaggtccacactttctgatttgtgtgtgtctttaagttgcctaatattgttggatgaatggggctttttgaacacactgtgttattaataaatacagagactcctggaataaataaataatgtgattctccaagagtcacattcttattgtaatacattttagacagtgactttgagcaaaacttaatttttggaattatttgaaaacatttactattgtagagaatttcttcaaatataattatctttacttcccggggaagttttctaacctctattgtaacaaatagtctatactttgctttttccgtttttatatccgattgtttacttttaaatggtatgttcattatttgccaaagacttgagcaagatgttgcttttattaggtgaaagatttatcttcgttaatttttaactctaatctccttgaaaatatattgagtttatgccttatatgctacaaattattgtatccataatcattttataacttcactgttttttgttctctaaagccattatgtttttttccttttgagtttttaaaaagtatttccagcacctatgaacaataagttatgttatgcagcattacatctttgcttcttcaataactttgtctagtgttatgttgagtagttgaaattaaattaaaatctttatttctttaaaatgttcatgataaatatagtcttctgaaaactaaagaaaacaggagcaaaaaattgtacccaagtgctcatgctcacataaatgcatgcacacacacacacacacacacacacacacacaaccaagactctcaaatcctagtcaaaagctatatttcacaaaagagaattatagtaacattgatggtttgccaaaacctcaagcagtgacaaaatccacagtgtcctgtaggggatgcctttgcaaaaccatgcctctccagatggtttagattagagatgtttaaaaacacatggcagcattagcttggtttagaattcatagttaattcagtagataaaataatgcaaatttgaaaccctatcctgtctatcagaaaaatcatcaaatcttatgattgctcttaggagaggttggtatgtgatgtgttgatttttaaattatctaattgaaataataaaattaaccaagaaaaagtaaaaagaggattaaaatataagagtatgagtaaaaactttcttctctgcagaatatttcttcctttaagctgtcatatccaatcagtttgtatgggattcgacagccaattgtcatttcctgagatatactctgtaaagaggttgtgttacagagacggcatgaaaaaatggaaaaaataattccagagcatcatgccaagagaagccaaaatgtccttaaagaccacaaagtgttgccaggatcccttcaccttgctaataatagcagataagcagcttacacacaaatttttcctttggcttatttagctttccctcctagacactttctaaaagagagtgctcccagtccacattttagtaaattattttgccttctctgtgatttttcatcttgggtgggcgctctttgtgaacagcgatgttgcatattgcgttatctgacacgagacgtatagtagttcccccaggaccctaaaaggcttcatcactaaaagcttggctcccactgtccccttccttatgtctaaaatcaacagtatcccatcctctgatcccacagctggacagccagcaaacaactcctggaaaagaactgctgtatgggaacagtattaatttaatgatgtatattatcgtgtatcctaccagcagcataaatgaaaacattcggcagatatgttgaaattgccactggaagaacgctcactcaaggactcaaagcctttcagaaaatccacacggggaaaatatgggacaaagattctacaaaaatagaatcagaagttttcaaaacgccgttgctaggctttgaagggcttgactcaaagtggcccagtatttacttccccctgaaagtaacacattttgagcatttttccaaatataaaaagtagaactgtagcttttaatggctaaaggagctccactatcaaagtaaatgtgcttctctggcagcaaggacacatgtgcgtgaagaaaacaaggggggagcaggaagagtaggaaggtccctgtcacaggaatttgtgtggattcatgagtatttcaactgtagatttcattttgttttaaacatggagaaaatgtgttagccaaccttaacaactgatcaatagttctgcatatatccccacttaatatgtgtaatgggagatatattttgttgtttcatctaataatcaattttttaaataaatgggaatggatgatgacttggcaggggaagatgcgagcattcgagagaatccaggcgcttcatcacaggcataaatgacaccatgccaaaagacttcacttttggagcaggtgctcagaggagagaaaaccccacctgagcctttctccccctccccagtcacactcctcatgatgacccttacatgttttattgcatcttctcttgtgtgctttgtcaaatttgtgaatatttagctaattttcagaacaggatttcactggattatcacttctctatattgaaaactgctttacataaatttcctgcctttagaacattccaatgtgttcttccctttgtatgagggattttgagccaagttctgtaaaacatcacaaatttggacaacatggacagagaaggccaattctcaaatcagatatgatttactaaagaagatcaggataattaaatgattctttttgaaaaacaaatcatcacagtctccaaactatcctttgtgcaaatagaaattttcactatatcaggtcctctgatatgacagctgctgatttgggacattgttacagaagtgaaacagaacaccaatgctatgttataactcaaacttgtaattaaacatctgggacctgcctgctttaatgaagagataagaatatttggttggttgtgtatcatatctctaaactgatactactgtgattcaatcattacacattgtgtacatgtatcaaaatatcacatgtacccccaaaatatgtacaactatgatgtatcaataaaaaatgcaaaacaaaagcaaatacaaagattgaaggacttagaaactatttattttttcacattattcttttagttagcaagtactctttttttcatacacagtgcaaagagaaaaaaattaccctttattgttctgttaaaatttcactagttagctagtacttgtgttacaggaataatggcaaaataaatgggaagtggactctgtgagcctctcagacctgtattattccaaaactaaatgtaaaatattttttctcaaaaacctttacaaattcttaaacaatgtctgtatcatggatacttatcctgagggatccaacagtgttgaatcttgcctagcaatggaatgaattcaagccataaatatattacatgactgttctccacctcaaaactcttctaaagcaagggaggacagaaatggaaaagtaaataatatagttcctgttttatattctacatagttcctgatgaaaacccttggtgagttgtatgtgtgactagttcatatcaatgatgtttgggtgcaaaattcggagatagcaaagagctgcaaaatatgatacatcaggagaaatgaaagtgtagaggtagggcaaggcttttcattgttacctacataacacaatttgccatatccttaggttgatggcagatcaacccagcgaaaaaacactctaagcctctgtacagcatttttaaaagaaggctaatggatttttactgcctagttcacacatatcaaagtaagaaagatgacaccttgggaaacaggcaatatcagttgaagcaaagcatattataaatgccaagacctatattagaatttatatatgcccaaagcctgtttatttggggactgaattctcactggctctgagcctgaggggccacagtccatttctctggttaagctaggtcagtaccacctgtgttcctacggtgaagtaagagctgctgagacccatataccctccagccactgtatttattattgcacttgggaatgctctgctcttgaaggctgatctgacgagggtgggatcacaggcagcaggtatgccatgaacaacaaacccatattcttaacatatgtttaatttgagtaactctcctcctttaaaatacctcttgattctgaatccacatcctgatttgcccactcttgttaccattttctgctgcctgttctgaattaatcctttgaggtggtcattccccggaaagaaaaaaggaaaatgagaagagagatgcaaagttgggaatgtgaatgaaagagaatgggagagagcagagggaagggggtcattaactagagtctgctttcatgagctagattttctttgagctgtataagaaaggagaggtagaggaagaagagaaatacaaaaaaaaaggcacttgaaaggttatccattaatacccctactgaagaatgaaaatcattttttgcaatagagctcaatttacagattattttcatttctctgtcgtacttcatctcaaagaattgatataatctaaaaagtggttaaaattattaaaatagtttccatagtagaaaattaaatgattttactaactgtcaaagtcagtgtttaaactgagataatttgaattatatttcatatagtgatcatgtcactaggatgtctaaacattctttggaaaagtaataatccctgattctgatttctcatcaacagaaaactgactaaaggttaagaatattagccaccaattgctgttatttgcaaaaacctaaagagaaggctggttttcatgaggaattttgaatttaaatatattctccaccttggaacaattaaccctttaggagactttctgcatttttcttaggtgtattttctgctcagagggtcatgaaactgcttcaaatacttgatttaaaatatatttgaaagttaaatagcaatatattatgctattaaatataagatggcaaaatattatgttgcttcataacatcaaatttgttttccatctatttatctatctgtttatctgtctatctagcaatcaatcaaatacaggttttcctaggccacagcacactggtttttaaatgaagtcatattaacagagtaaaacatatttctctggtcctcacctcatttgcaacttaggccctctggggtcttcacattctcccacttttttcccgggagttctcagaggatattgcaaatgtgttcatgaataaggttccaatgactgcccgtgaagctaaaagcagcttgcaatgactccagcactcaagccccaaggccttgccctctgccctgtccccattagcatctgagggctggcctcacccactccagagcaagctccaccactaggtgctggtttccattgctgcagtgccattgttgctgatgatgctctagacccctgagtagccctgggccttccagaactgaagccagcagagtcagggcatattccatgaagaaggagacaaaaatgattctctcccccaaagtgtgtattctttgtctcaaggaagcctaaacacacaggctggatactccacttgttcataacaaatacagtcttttctgttgttccagtagcacccttttgcaaatagagctctgcagacctctcccactgatctgctattcatgccttctacactgtgaacactacttaaactcaaacctgaccacctgtttaattatatttcaagtttgaaatgtaatgctgtttacctcatcactggggcagatgacttcttttttttttttaagacggagtttgactctttgttatccaggctggagttcagtggcacgatctcggctcaccacaacctccgcctctcgggttcaagcgattctcctgcctcagcctcccaagtagctggaattatagccatgagccaccacacccggcaaattttgtatttttagtaaagatgaggtttctccatgttggtcaggctgatctcaaactcccgacctcaggtgatccacccgtctcggcctccccagacgacattttattcagaacaattcaagatatttattgaacctagcactgtgctaggtactgaagctacaatgataaatacgacctgttccttgtctttgaggaatctgtccctgccccactaggtcaaaagcaagaataggtgatctgaggtagaatgcatggtacaaaacaaataactagtgcgtggttgacccggaacaccccagccgccgcattgtcacctgacttaaggtggtcagtggagtggaggcgggaatggttaggttcgtttgtggaaaagggctttggaagtccgagctagctcgcattaggagggaggcgacctcacatgaagaatacctacctcctacctcaagatcctgcaaatgtttggggatggctggtgaaccacaggtattcctaagcctggttcttattaggcagggaaaactagaagcctcgcttttcctcatccttgctgtggaatgaaaccaataaagtccattactatttagacaagtgagtgaatgctgtttgtttgagaaatactgttcctggggagggtctgaccaatagaagcctctgaagggctttttgggggtggagagaaagcccagctagagggtggttctagtaatataagaatcaatggcaactctgttaatgtcattaggttaaatctacctaatcaaaatcataaggaaagccttacctttgcatacatatttttgttgttgtacaaataaaatgagtagctcaaaatctagcacaatgactgtctatacagggctgaatatctgtaaaagaaaaacacctaaagaagtttgcattgccagatgcttggcatcatgtaatcaaaacattttgaatgtattttaaaatagtcttccagatgtgtgacaactttgagcttagctacagccattatctacattttggaaggggagtggaaaactgagttcattatttaaattatacgggaaaattgaattcttattgccttcctggcctgattgcctcgggaaaaggtagttttattttattttttgcctttctaccaatttcttcaacactgtatttgacctgacgaatgtaaacacagtagaactttccacagtaccttgcatttgccataagaaagatgttattgccaccaaggggtgacatttcttgactgtggaagtagtctagttatttagaattcaacttttattttgtgcttactttccctagttcttgatattaactatacttaatatgtaccaatctgcccagtttcttttcattttagggctcatgctcaagaacatggaattaactaaggaaaaaaataagttaaataaagtagaggggttttttgcctttggactagattttcccatagaaattcacgttcttcagtgagagttatgtgctatgttaaacccactgtaggatatttatctgtgctcaaagtaggtgccaaatattaaataacctactagaactataggaaaaattgctcaggagaattttcaccttgtgaaatttgcagttatttcctccaagcccacacagaaatattctatttgtacttaagtccatcaataagtaaatctgtgaattttgtcattgatatggtatcactgccaattttaaaagaagagaacaactcacatagaaaatttcgaagtggtggtgtgtgtcaatctagttctcaagacatatctttctgtcaacatacttgagtgtactgttcaattaactttcaattattcctaattagtctttgacaccagttatatatatgatacattggtataactggcatttggcaaatataatagattggcgtgtctttctgaagctacggttaatttaaagataagacgggatccctgtaattgtactggtagaaaactggtagaagttttcccaagtgacacataccgatcagcataaaatgttaactgcttcaaaacaattgaaaaacttaaaaaatgaaaatatgttcctatggtctgccaaaactatcctgaaattttatctgcgttggtgggaggagggttggggacagtggcaggaagcttattgttacatttttttcatgccatgagaacaaatttgaaaaagttttgacagaaggtatatggattgtgattgatgtgatggttgatagcacctctactgagagagtagttccactaatgtaacttaggcttgaaagatttattttgaaggaagagggtatatgcactcatgggttgcaaataacagcagagtttgggtttttgctagtaggtctacagtatgctctgtgcgtctctgcttctgtctgaagattaccatcctttcttttttgttggttgttctgtttgaaatggcaattgggaaaggagtttagtaagagataggaagtagaaaggagttttaaatctctattctgcctggaactttagctgtctcaatatgggagtaaacaattcaaattaacctttttaggaaaatctcacaacagattatattctatcaggtgaaagaaagtgaaatagaactagggtacatttttaaagccaaaacataaactcaggtgaacatgagctcgagtgagtatgaaggttgtttgtctgggagtgtacaatatatatgtgaccatgactttagctagtgatgggctgtgggaatcagctgaatttacatatactttgaagtgcttaatttatcattttctcaaaatatttacaagtttatcaagtatttgttgaccacgctgatagaataatggccacccaaagacatctctattcttataccaggaacctgtgaatgttacctcaagtggcaaaagggactttgcaaataggattaaattaaggatctttttttattatttttttaaattttttccataggttattagggtacaggtggtgtttgcttacatgagtaagttccttagtggtgacttggggaagggtggatgggggtgagggataaaagactacaaatagggtatagtgtacactgctcaggtgatgggtaccctaaaatctcacaaattgaggatcttgaaatggggaggttatcctggattatgtgggtcggcccagtgtaatcacaagggatctcataagtgaaagagagagagagaggcaaagagggtcagactcagagaaggagatgggatgatggaagcagaatcagaaggtgtgatgtgagagagagacttgaccaacccttgctggctttgagggtgaaaggtggcatgatgcaagaaatgagggtggcctctagaagttggaaagaaggccaagaaattgattctcccctttaccctccaaaaagaaacgtagcactgtctacccctcgattttagtccttccaacctccagagctgtaagataataaatttatgttgttttaagccactaagtgtgtcataatttgtttttgttttgttttgttttgttttgtttgagacagggtcttactctgtcacccaggctggagtgcagtggcatgatctcagctcactgaagcctcaaccttctgggctctagtgatcctcttgcctccgtctcccaggtagctgggactacaggcatgtaccaccacgcctggctaatttttgtattttttgtagggacaggtttttgccatgttgcccaggctggtcttgaactcctgggctcaagtgatcctctggccttggcctcccaaagtgctgggattagcaggtaatttgttactgcagcaagagcaaattaatgctaatgcctaccaaatcttaggaactggctgaggcacaaagaacaacacagagagaagagaagcccatctcctgcccttctgaggcttccaactccaaaggatccattttattgtacccatgaagaaattaagcccaacagaattaacatgattttcacatagaaaatcagtcttgagtaccagttcatggatctttccactacgtctgtatcctatgattaggatgaaggggaaaaaatcacatcctgtcccttccccacaacctttgtgtgttaccgtaagggctgctgtcctctgaccagagcaggaaacaaacagcttaatgacattcaaatcattttttacttaggaggactcatctatagaacagagtcatgcttttgcattctgaagagctggaactccctacagccattaaagaaagggaagatggcctgttctctcaggcagtggcccttaacttaattgaagaaactacgtcctaaaggagttaagtcccatgaacaaagtgacacagctatagaaagagagtctttccagaacgtgagtctcctgactcccttttcggtttttgccccttctcccagcagacatgtaaggttccagctgctttttcggaatctgaaataggaacccagtgcctttcactaacctacttcccagcacaccgtgtggattacaaagggaaattaacatgtaaagaaaccctttggaaactaaaggagccatgttagttctcttgctatattatttggctggtctcactgttggtgtcattttcaagtgtggggcttgatttaatagagacagccaacaactgtggatctaatcaaatggggctcaaagcacataactttctgtgtggggaactataagaaatattttcaagttttggaatgttctgacaggaatagggcagaaaatattcaaaggaagctggaaaatcaagctacggatcttgtttttcaggtctgttatagtcactttgtgaagtactgcagacaattcattataatttatcacactgatattcatagattggatgaagcccaaacacaactgagttagatgcatattaaattacctcttacttaaaaggagggtggtcttaccagggcaggatggagttcattagcagtcttagaagctttccttaactcttcattatctggtttcatattattcctggctccacaggatcattgaacaccttcctttttttcaactcctggagaattgcacaaggcactttgtgaatctcaccaatcaacaattccaaagataaaagacacatcatcacaagtctatgcacaaagcagaaattactgggaaatctgttcctattctttgtataaaatcatttttttcttttttagggaaaagaaaaaaatactgcccttgtgcattttaatttagatttatatgaagcaaaatgttgctttttattatgataattgactgacacatacattgggtgtactctaacatatgtttaggaatttattatcacatttattctagctgacccataatatctcccatataaattcaatgaagaacatggttcagaatagaatcctacagacagatggtctttaatatgcctctagactctttttcctgaactggaaatttcagcctctatgtaaatgccccttaatgtgtacatcctacgtcttatgattgaaaatagtatttcccttgtggactgagaaaaatccctgaagtgttgtaaatttaatcatttgatccccccccagaatttttattcacatatttttctttatctcttggtttgttattttgtccttttaaaaaccagctcaagttgaactctggggaatttgattcccatttgtctgttgaatttccaagtacacataaatgttccggtaagagggaattgccttcagcttagaaatgaacccacaaggacacatttctggtattttctatgctgcagccattctcagtctatgggtctcttgcaaaacttcagactcttcggtggacacgacaatggtgtagaaattgagggctcagtgagatttgggattggttaacaatttaaaacataagtttacccttgtctcttccatatatcttatagtaagcacttaaatccagtttttccaagttctttttagtacttcaaagtagcagtttatcaatagaaccaccaaggtagacatagtcctagaggtcacctggttcatctttgtgccttagacataagcatatctaagtcattctaggcagatagaaaaagacaaatcttcactaagactgtttctacctttggcctcattgctttgttgggcgtaggtcttcacttcttattgtcttgcccaaggtttatattcaccacatagttttaatatgaagaaagacctattcgtgccaaattattttattttcttgctaaatttagaatgatccaactgattctgtgtactgtcacagctggcaaaaccaccacagttattcagaaaaaccatgtgaagatgctgtgcttagtagaacactttaggtttttttttttttttttaatggtctctctataatttctgacctaagtgccttggtaatgatctaatgtgggctagtccatgactctttgggtggatcctccaaatgtagatttattttaccagcaagggattgagtgacatatggagactggatgtttttctttctttctcagcctcctcaaacaacaaaccgtgaatcctacaaattcaaaaagaaattgtccaaagcaggacacacatatcatgcaattgtttttagacactcttgccaatacaacagctctgaatctggttagcttatttttttgtattgtgctggtaaaaaataatacctgataactgaattcttctcttggattctgtagctgatgaacgttattgcttcttttatatggcccaggaagggaacacagattaagaagctggctctttttttacatgcttgctctgtcaagaaagagaaggaagtaccatatttttgaatgctatattttccccctttgcaaggagttagtactttttcaataaaaataaatttaatttgtggctacacttcaagtaagatggtttgatgtcaatgtacagcagtctcagctctgaatttagagaagtcgtgtggctgactcccttagtgtcactttcatgtggttgggtgagccattctcagaaaccccaaacatttctgaagatcctaaactggagacattcacaagtcttccctccctttttgctactaatccttcatattttaacaagcaccgaagttaatgctgcctacactttttcctgtcaaattggaactctttcttctgtcttgagtaatctgttctctctagttcatactttcataaatcaaagaggtggatgtcaacacacaccatatccaaatatcaacttcctttcttttaattaagcaggatttagacatttgatttaaagaaaactgttgctttttaacatacaaaggcaaccatatattcatcttcatctcttcctgttattttttatctctataaataaaacaaagtttgccttcgccttgtaccacatcgctattccagtctaggcctagcaacttgggttttatattttctaaaaaagagacaagaaactttagtgaactgttggcagtcagtactgaaaaagccacctttgttctgaacgtgcttcagtgagcattattgtcagatattgatattttttaactttttcctaaatgcaagccatccttttatttctaaaatatgaccattttgctgaagatgattctctctctcaatgagacaactgtgaaaaaagtatgcatattatttcatatcatgtgagttcagaagaatgttcctcaggtcctgtgtttatgtctgtaagtaagaagttccactttttgttaaagcacacaatagtggccctattcacttttcataataataaataataattcatataattattttgaggaatagacacactcaatttcaaaagaacttgttggattgtaatggcatttttcctttggttatatagtgacaagatgaaaacaaagcattttctcccaaagtggcagtcaatgcagagcttgtcaggagtgatccaactggtttccaagctgctagctgttcattagactctcttgaaatgattaattggtctcaatcagttcccagcaggaagtacccacctcatagtaaatatcaccacaattggtactaattaactctgttatcacctgtcgcaactgatagtctgggagctgagtgaggtgagcgatctctacaccagcagcagaaacccaactggagagaggtcagagactcactgccaaggccactgtaacaggcagggagcccacaagccctctctgccatctgggtatgcatgaggcttagcctgtggctaccagtcccacagaggtgaggaagtaagaaatgtagtgctcaggcgggacccatgtctcaaagagaaaaggcacctgcattcaaccgatgcaagttttcacagtatattggtgtcaaagtcagccaagctgtggttcaaatctggactttgccacttactattaatttgatcttaagccagtggcttacttctctgagcctgggtttcctaatccaaaaaatatatataggcaaaattacccacctagtaagactgatacagcgatgtgtagtatatgcttgacactcatttagtaactgcacaaaaattttggaatgctggccgcaagtaaatagccatgtagccggggatgacagtgataatgttcattagcattcctgacaataaacaagaaaactcctagtgtctacatggagagtgatgctgaagagaagttgggacctaaaccttcatttcatttttatttatcattttctaagagcctcattatttctgtggggaggagaaacaaggagagatgtaaaaactaacaaataaccttgaaggaaattaaggaatggtattctagcagagggaaatatcataagtttctcagttgggctggttgtgaaaatgacacgattccataagggaaatatccagacctacattgatgcggaaggaaacttatcccacaatgatactgggtcatgctccatgaattaattgtttcagaactgtgttttccatttttctccatgatatgaagcacctagatgtgtttgttaaatacacagatcactagatgtctaccttggaaattctgattaagtatatcacagtgaggactcaggagtttgtgttttttgtttcttcattttaattaacaagcaaaattgtatatatctatggtatacaacatgatgatttgtttgatatgtatacattgtggaagggctaaatcaagctatttaatatacacatcattctttgtagtgagaacacataaaatctgctctctgcaatttttaaatatataatacattgttattaattgtagtcaccatgttgtacagtagatctcttgaatttattccttctatctaactgaaattttatatcctttgactaatatctccccagtccttctattccagcctctggtaaccaatgtgggtttttaatgaactctccaagtgcttttttttttttattcagataagcttaggaaccattaatttgaaacagtacttttcacatttgacggcaaaatactaatgccccagtcgcacccccagaaattctgactaaattggtataggatgtggcctgagcatttgagattttttaaagcagcccaactgatgctaaggtacaggcgaatttggagtagtactgatttagaaaatagtctgaagggtacctgtaaatgatgaataagtaataactagatgtaaagtcacatcacagatcaatagagtccagctctaattcaaggtgtgaaagaactgtcaagaataaggacttaaaatagttaaaccacgtaagaaatgatgtagtaacatgtgttactagatcatcaggacaacctccatcaacaggacaggaccaagaattactactgaaattattggagaaagatttgttgagcaagaagagtcctctggaccacttacagtgtttagagatttttcttcgaatcaggaggtagtaatttctaattctatatgggaatatattgtttatctgtctttaaactacattacctaattcaaatcttccaacagccccagggaaaataggcaaagaaaatgcctgttccataggtagggcaagaactgtcatgctcctattataaaaaaaaaaataaggcttagatacctcatatccattagaatggctagtactaaaaagaaagccaaaaaaaaaaaaaaagacagaaaatagcaagtgttggtgggggacatggagaaattgaaacccttatgtattgtgggtggaatgtaaaatggtgcggctgcttgcattagtctgttttcacactgttgataaaaacatacccgagactgggaaatttactagagaaagaggtttaatatggacttacagttccacatggttggggaagcctcacaatcatagtggaaggcaaggaggagtaagtcatgtcttacatggatggcagcaggcaaaaataaaaataaaaaataaaaataaaagctcgtgcagggaaactcccccttataataccatcagatcttgtgagacccacccgccagcgcaagaacaccatgggaaagacctgcccccatgatccagttacctcccactgggtccctcccacaacacgtggaaactcaagatgagatttgagtggggacacagtcaaaccatatcactgctatagaaaacagtgtgatggtttgtcaaaaaatcaaaaatagaactacattatgatcttgcatttccacttacaagtatgtacccaaaataattgaaagcaggatctcaaagagttagttgtgcacccatattcttagcagcattattcacaatagccagaaagtgtccattgatgaatgaatcgataaaaccagatgtggtttatgcatgcaatggaatattattcagccttaaaaaggaaagaaattttgacacatgctacaacatagataaaccatggggacattatgctaagtgaaatagccaatcacaaaaggataaatattatatgataatacttatatgaggtacctcaagtagtcaaatttgtagagtcagaaagtagaatggtggttaccagagcctggtgaagagtgatgagggatgggggatgggggaggaatgaggagttagtgtttaacgggtaccaagtttcaattggagaagatcgaaaagttctggagatggatgatggtgatggttgcaaaacaatgtgaatgtgtttaatgtcactgaaccgtacacttgaaaatggttaagatgataacaaattttatgagtatttcaccacaattttaaaaataaataatttgaaaatgtgtccctcaaatatgcaaacaaacaacttaaggcttaaaggagtcacacagctagtaaggtgtcagagcagaaagtcagttcttgggactctgggtctgccaatcctccctttctacctccctgcctctcaggaagtagaaattgaagatgatgctcaggaagaaggaaagagggagaaatagttgtttgaggaaagagtgatccacggggtccagacacagttgtcttgaagataacaaataaggttggtaagtttcatgaggtcagaaacatgtctgcacaattttaacaattaagatatattttacatgccacaaatttacccttttaaaacatacaattttgtgtttttttagtatattcacaaagttggacaattagcattgtctaattccagaacatttttatcatcacataaagaaaccccatatttagtagtcattcctcattccttccaagcccagccctaggcaaccacgactcagctttctgactcaatggatttgcctattctggacattttatgtaaatggaatcatacaataagtggccttttatgagctgtttcagttagcgtaatgatttcaaggttcatccatgctataccatgcatcagtactttattctttttattgccaaacattccattgtatggatttaccacatttcgtttattcattcctcagttgagggacatttgagttgtttccactttttaacaattatgaataatgccgctgtggacattagtgcacaagttttttgtgtagacatattttttcaattatcttgggtatatacctaggagtggaattggtgggacatatgataattctatgtttaactttttggggaactgccagactgttctccagagtggctgcaccattgtacattcccacaagcattgtaatgagtgttcccatctctccacatcgtcaccaacacttatttccatttttaaaaaattatagccaacctagtggatgttaaatggtatgtcattgtggtttgcacactacctttgtattctcagcataaaagccaggacaaggcacgtgatagggtctaaatactgaaagccatgaaaattccaaggaattctcagaaaggttatcaggatgatgggtttctaatctatgggaaatcaaattttagaatcagctgctttttatttcttagtataaagagtgtcaagaaggagcaggtaactaactcaaactttgctccagggcacccccacattaatggggtgataacttttgattgatgtttactcctcttagaatttagaagaatagcctgtgcaccccaggacagagacttagagagaggaagggagagttttagaagaaaaaagaggctggatatgttggctcatacctgtaatcccagcactttgggaggttgaggcaggaagattgcttgagcccaggagtttgagaccagccatggcaacatagcaagaccccatctctacaaaaaaattttaaaaattacctcggtgtggttgcatgtgcctgtaatcccagctactcaggaggctgagacaggaggatcacttgagcctgggagctcaagtgagctatgacttgagctatgactgtgccattgcattccagcctgggtgacagagcaagaccttgtctcaataataataataataataatataaagaaaaaaagaccctttcccttcatctcaattaaagttaagtgcctgacccatgactcatgtcgtcttgaccagcttcacaccttccatgttgccaaatgcctggtgctacatgattgcctataggaggggttttcaacagcagtcttctccaaatacacttttccattaacaaaagaaatatctttgtgggtttcttaggtactcgcagaaatagctactagttcactagtagctagaagcatctgatctgtctgcctcaaagccctctgacagtgaagcatttgtttttaggcaaataaaacgtcagccaccatttaacagcatatggcaacaatacgaccagtccctccctgaggaccatcctctccccagaagagatggtacttgaaataggcgatgcttttgagagcagaacccttatttctcccacccaggcatgatggctggggagtgggcagagtgccacgcacggaaggtcacaggcaaccagatcaaatgggagcctagagggtaggcttcccagccaggaatgaccaaaggttgttcaccctgggcatctgggtctgtggttaaggggaagtaccatctctaagctggcctggattagctccacaaaatagaaaacagcctccacagccacttaaagacgggtctgggctaacttgaattgaatgtagtgatggtgtgcggtgagtgcagggagacattccaagctgaatctcaccctcatctctgtggaattccctgtgaatggtgtaaaataaactgacttctctttaaatagatgatgaagaggtggaactctgtttagtgggtcagctcgtgtgcaagtgaacatgtggctatatggataaggaggtggtctgtctttgcaggggtggccagtaactgggccatctgctcaggattaaaaaacaaactgttttctcaggagcctctgggctaaggcatctgctaaaaacattggaaactgtcaacagagatggcttggtcttcgaaatatagtctcaaaattttgcttgtccgaacttgggaggaacatattgtgcaaataatcaaaatgtgatgcttgccctcttagaaattgtggttcctaacgtaacactgtctttgtgttatgtgtgttggaatattgacagtcagtcttaccagtttttcatcaagcttgttacatatgagctcatcgtatttctgagcccctgatttgaccaacaatgtggccacatcaatgaaatcaatagccttgtgaaaatagagttcaaccgtagcctcaggaaaaattactttgattagttaacattattgaaagatcctcaccaactttataattattttccacttacgtaaactacttgattggtttttcttttttaaatattttgtagagatggggtttcaccatgttgctcatgctagtctcgaactcctaggctcaaccaatcctcccaccttggcctcccaaagttctgagattacaggtgtgagcctctgcgcccagcttgatttgaatttttaaaggccatacgttatttttcaaagtaattctaagacattaacattttaaggaataaaataaaataggaaataattaagactataaaaatatctatacacatatatattcttacagtataacaaggcaaggaaactttttgtttccagttaatttcgtttgtctgcattttattagtctccatttaataatgctttattataacactgaataacaatataaaatttcaactgcatagggaagtaatgaaattttttaaaataaaatggtgttactaataatttttttagattttatctccagaaaaatgtactgttaaaaatgaaggacaaaaaaaccccacatttattagtagtgtcaaccaatttttctgaaatgttttttacttttaaccaaatagaggtaattgacaggatgatatcatttgctctttttattcacagtcagtaaattctatgacaatcagcagcaacagtaatgactagataggtagctgtgtgaacagcagggggttgcaacagtaaaaggtttctgagaccttttactctgaggattgttgatgtagactttccaaattaaaagaggagccctcattgtccaaactgtagttaagactataaatatatctatacacatatattcttatagaataacaaggcaaggaaacttttggatgaaaaataaaaaattaactcactcatccaaatgttggccaccattacatcaaacatcagggtatgtaaagacatcttgtgaaatgactgaattctcaagtttacatctaagcaattgaaatcttactacgttagcatttttacatgaatgatagtgcatagtgtggtgtaccctggagacctgtgttgaacacaggatatgtaaatatatctgtatttattttaacatatatgtcatgtaatacatatatgtcatgtaatacatataacatgtaattaatatgttgagcttaagatataagtgaaattgatgaacataactatacctcatcttccaaacagaaaatgaaaaaaaaaagtctaatcttatttatcatggttatattgtaaaaataggtttgcagcaaaacaaagtagactctggaagcagaactctggtgctgcaaggtggtgttactcttttttagcattaacttgactttttatcaaatttaaatagaattctgaatttgagatgggggcttttgtgacatttaaaattttttgaaatggtttagtagtcctttgttggtggtaagtgttggatgaatgaatgaatgaagaatgaacaaattaatgaatgaacaaataggtattggagttctcactctatggggttgggttctagttgattgccaactatgtgtttcagttttatataaatacctccactgctggttttcctctggtttagtctcaacaaacagtacaagcttgcgggggggggatatttgcttggatttagctgaaacacagaagcaatcaagtggttgaattctgcattttaaaaaattgaatgacattcctttatccatatcgatttgagctttggtaaattcaattgtcgataccacctggataattttaaatctttctgaagctttaaaaaaaagtttccaacgtagctccagcaacataagaatttcatcaattgaaagctaagaatcatttctgtgggatgtgtaaaacaagaagccgaccagcattattttctttttctttaattcagtatcattattgagagttattcttgaactttatgaaaaccagattggggcatgagcatgttctccattgaatcatgttcaaggaattgaaactgaaaatcattcaaagtagggaaacatgacattgaaaaatagtctacattctttattctccctcagagtatctgaggctgtttctaactaggaagccttaggctgataggagatctgggtttggtttcttgttttttgtcttgttctgttttattttttttaatagatgtttagtttactagtcaaaaagaggtcataggtttttttttggggtttttttgttactactttgctggtgtatcagttatgatgttggatcctcttactcatttgctccaaaagttgtgatttctcaccattgtccacagaaaaaaattccaaataatgtcattcaaggctttctgctgtctagcccaggcaatctcttagtcagacttcctactatctgattcttccatgcaatccccttcccaaccaaaaaagactatgagctgctcacaagtctcattttgctgcctctagtccttttccttcattatcctatccttcaggaatgcctgttgcttctctccactgtttgaatgttccatatatacttcaaggtgtgattcatcctcttccatgagttctttccaaccatctcaccatttccagcctcctctccccctccctaactaaaacaaatcttccccttccatctatccccctcacacacagagacacacccacacactccacatgctcctacaatttagtcatagcatgtatcacattcaaggctgctacttgggtgtgcaagttgtgctctgcacaagaacatcaggccaaagggacacgtggggatgaaaatccatcttactctccatttgccaaggcatgcacctgcccatacgactgtgtttctgcagaggatacctttttctgttttccacaaaggcaccgtatggactggtagcccatctgttcatctgcatccatgttttttagttccctttcccagagcacaaatttgctgagggcagtgactacccttttattcctaccattcctggtacagtgccttccttatacatggtaagttctcagtgacttcatttaatttaattaaggcatgaaatgtattgactaaaaacaattactttagcttataaatgcaaatatgaaaagtaccgtaggaatcaaaatggtcttagcagatgcaaaacagttacttctctgactttaagtgcattatggttctatctcagctaagtaatttcctacaaaatgtactgcccagtagtcttttatggagcttcagaaaccacatttgtgacagactatgacagaccatggcagagctggactgagatccatttctggttgtttgttaaaataggcaaggaataacattaagaattttctgaagtgggcagaattaagatcaggaagaatgcccatgggaggtgagggaattttaggaggagccaattggatcagtctgaggtcagtatacttcctggaagtctacattaagggaaaaacaaaaagaagacctcatcttaaaggccttgaatctagaattactctgcctttaccaacactgcaaattgtgtaacttgatgtggccatgctctcaaagtaaagaattgcttagtaaaggctttagtggagaattaatattagttctgttgcaattctatgtgacaaatgggaaatgtccataaagcaagatttacagaccacaaaacaatgatgtacttaagataggtttcatacctatttgataaaatggacaggacttcaaatttcagatttcaagcagtaaccattggtcagcctctccaaagaaagtcctgtgcctatgtacaaaatttcttagtaactatgcacttttacagtcccagctttaaattatttttttgttttccaggatgtgttgagtttatgtgatgaactgttttcaggaagaaacaagtcacctacaaccatttcacattgcatctctctctctctctccttttccctgacagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacggtaatgcaaacttttgccatatccctgtgagccgccaggccctgaaagagaaaataactctactcaaaaaagtatggatgttttcagtaatgccaagttaggaggatctactttattatgattgaatcctgaccagctaaaagttgagtgaaaagtagatgaaggaagcactggctttagggatgtctcttaataacctacatgtgctagcatgtagggaggatctccttggctctcccaaaggccaccagtgaagagaaaccttggaagaggcatctgtggaattgttttcccaaagaaaccctatgcatttacattataaggtggaaacacgtattttcaaatagatcctgaagagtaaggatttcacatcaagggatgatatatgggacttttgccaactggccttttccatgtgtgatttgagagagtactttgactttaaattctggaatgtgtggtgtaagtctcaacataaagtctacagtgacaatataatccctggggttaaaagtcaacatctcaaaaccattacccataatttagtagaagaggttcagtatagtgttcataagacaactactctgtcatttcctttaaaagaatgacaggtgtgtacagcaattgttcagaggaatgagaagacaggcgtgtctccatcaatccttgctaccttgacactcagggtaactgatgttctttctctgaaatgcccaaattatgcccaaggatacagctttactcttgttttcaatttccttaatgtgcttgctgcatttgtttcatatgctggactcaaaagcactctggcatgaaaaaggactgccagctgtttagctaagtccatgaggaggaaaaatctcctactcttgtaagattatcaatgggaaatgacaaataccaagtcagccccaattctgattgactggggccaaagacacttgcaggtgaaactagttcttgggaatcttgggaaattgctcttgcctgccccatttccccaaactaataacagaaaattgtggcccaggagaaggtgggcttgatgcaggtgtttggtgaagtagtgtgaaaccatgccttggccctgtttggatggctggtgtatttctgaacataccttctgaaatttccaaaattgtaaatccaaatgttagaacatttagcagtaagcttttggggaaaattcaaaaccaggagctcttccaaaaaattaacatttcttttgtgagtaacttagagtgtgatcatcacaactaaaatactattattatcaaacttactgatgttatttctgttagaaaataaaataggccaggcatggtggctcacacctctaatgccagcattttgggaggccaagacaggtggatcacttgaggggttcgagaccaggctggccaacatggagaaacgctgtctctactaaaaatacaaaaagtagctgggtgtggtggtgcacgcctgtaatcctagcttcttgggaggctaaggcataagaatcgcttgaaaccaggaggcagaggtaggagtgtgccaagattttaccactgcactgcagcctgggcaacagagggagacttcctctaaaaaaaaaaaaagaaagaaaaagaaaggaaaaagaaacaaaacttgtccacttttcgcttttgctgttttgttgttgttgttgttgttgttttggtttttttcagggggattttgtttgtttgttttctctaatctatagctaaaagtgaacagttaattttgtgactgtctttcaactttcactattggctgactgattggtaccaggatcaaaaaggaaaaagaggcccaccacagattactcactaatttcctttcacacccaccacacatatgcatttgagacaacaggaaatcataagtaaaacaaaatccctcaggcacacagtaagtttatttccaagataaataaaaacaatctggcatctatactggaaaaatgggtatactgtagctttcttcttccttaatggtagagttgtgtgtgtgtgtgtgtgtgtgtgtgtgtgtgtgtgtgtgtgtgtgtaggcatgctccagtgtctgcttctgttttggtttcattacacctcttttttctcttaaactgagttttattactcatggaagcacaggccagtagtgctgattaaagcctgggaggggctgccacacacactttctccgggcacatggctctacacattcttctagacttgctttctttctctgctggacctttctgagtcttaatccattagtgtttaatgatttgtgttgatgctcagtggttatcaaagaagccccactggactcttgttgaaaaacaagatggatttcaggttcataacagtatttggaccctgccttcccattcttcagttttactaagtctataccattttcaggtgaaaatttgttacatccaatcttccatttgatttccacacagaggttagcatgctgtgtggctccgggcttgataatacactgcctggggctctacatacaccagagacttgggaaagagcattgcctacaatcccacaaccagtcagccttcctgatacttagagaactgattgggataacatttagcttcagatctctgctgtacttactatgtgcagatccactaaggctgactcatttggaagtttcagtagggacatggtgtgaaagacatagggacttagctgactgtccatcagcacgggggaaagaggtgatataattgtcaaaaaagcagatgtaatcttagcatgcattaaatgcaggcatattttttatcacatgagaagtgataattcaatgctacccaggtttctatattctgctggtcagaatataggtagacagttctgttttattctcagaacctcactggaagaggaatcagacaaaatacagcattttcaaaagagattcaccaggataggaaaggttttgaaaaccaggtacccaaggaacagatgaaggaattagtgacagtctgggtaagaaaagatttggcagggagaggagtaacagggaacaactatctataaatattcaaaaagctgtactgttttgacttgattagtttggtttggtcccacagggcactgcactggaagtatctccttgaactttctttatccccattagtggaagaaaaaactcccccaggatactacgaaaactggctgccctttaaggaaggtgtttaagcagagtttggaccacctcttggttgaggcagatgagtagctacattagatgattattaccactccttctgaccagcagtttatatgataataatagtttgggaaccatcctttatacaatagcaactttccaatattaaatattgtttcattgtagttgtggctaggtattatggacagtaactcaccaagggtaagactgatactgtcagctatttgcacaaagaagcaccaagtaagtgtggtttggccactggtggctgaactgcctgaaatctaacccaaattgctgtaggttctgctcatagtaaccttccattttgtgtttaatacacagctgcaaatgattttagcctaccgtttagaattctgcagagtgggataacccactagagtatgacagagggttacaacatcttgtgtatggttcctgggatgtataaatgacctttctcaatgccctggccaaatctaagcctctatactactgcaaacggtattttgaaaaataaatatattattatcctagattttgcagtaacatagaagaacctaattttatctcaccaggtacattgtgccaataatctcaccactagtatctctcccccagattaaaatggttatgaatattaaccactttttataaagaatgttaacaaatgtttggcattgtgactataatgcattaaactccagatttagtaacatgtattccttccaaaagtcagtagttctacccttttgaagactgtctttttccatcactcttgttgagcttagaagccaaactatgcggtggagacttattcaagtagttcaaattcacctccctgcattgcctctgccccatcaaacctcatttgttctagcgtccttctgttccactgcattgcattctgactgagcaaggtgaagctttataagtatttccactattatgtgttgctgccagagcttttagaaagaaatcaggttcaaatcaaaagcggcaaatgacctgacgcttgtattatagtaggattatgttactctttaatccttgttttagagtaatgtgtttgacactcaaatgtaagcatttcctcttggatctgtctctgatcctctttgtttatgtttttgcagcatcccgtgtactgtgtaaatgttgttgggacccagaatgctcataacctcatcactgtctccactgatggcaaaatgtgttcctggagcctggacatgctctcaactccacaggtgggtttgtttttccctacacataacaccatcctggttaaaagagatacctacttaatggaacatagttcctaaaagccaaaccctcacatcctagaggagctaaaacaaatggatgcacttgaaagagtggggcctgctttcagcaatcttctcttgaagccaaaacccatttcctttaccacaaatcatgtaattattgtaatacattaatccttaggtcagtttcaagtgaaaatgaaataatccattctaaatcatagtaattatggaagttgcctatggtatgaattgcacttaccctacagcattgttgaacagatgcagacgaggttggagctcagcagagcaatcccttatgggtacttgcattggagggaaggtaacccagcaaaacagaaatccaagcccttgcttgtatccgtagcctagacaacagcctgtgtgtatgaagaaaccatctgttttcccctctggaatgttttttagtatggctcctgtcattccttgctcagtaaatgagaagtcaaaaatgaaaaagttccaaagtctgcaaaccaatactgattgcaacagtggggaccaaacaaaggaatagaagtgggagaggctgtcaaagggagacaactaaatgcaacttgcaagatatgcatatgtagacaaacacacaagacatgcgcatacacacatgaacacatacacacacgctttttccatatttctttgtgtgaaaaaacagtattcactatcctccaaccaaaaacaacagagaagtcattgttatagactttgacaaaaatgtaaggaaacatggagaaaactgcaaaacaatatctaggagataattctcaatgttaacattcccatattctttcccaggataaaaaccctagaatgtctctcacacaattttagaagaagttaaagtttcaaaatgtacataaggagacagggcacggtggctcacacttgtaatcccagcactttgggaggccgaggtgagagaatcatttaagcctaggagttcaagaccagcctaggcaacagagcaagaccctttttctactaaaacttaaaaagttagctgggtgtgctagcacatgtctgtagtccatgttccttgggaggctcaggcaggaggattgcttaagcccaggagttcgaggttgcagtgaactattatcacaccactgcactccagtctgggtgacggagtgagactttgtctcttgaaaaaaataattattattattattatacacacacacatgcacacacacaaaaggaaatatggaaactgtgaagaaccaacctcctttaagcctccacaaaatacggatgtaaagaatactacgtttttttaaaataattttagggagaaaaaggagagagtgctaataagctgcttacaattgaagttccactattttcgctgatctttaacattatagagggctggagggattggtattttatggctttgtcttaaaattctcagcaatgttttgttttcttttaaaagcctgaagattataaacagacataagagcaagcccactatttaggaatttttaattgcccattttgctcattacacatatttatttaggttaaaatcagtaatatggtggctctaagtccgtttgtattagttttagcatgctcacagactcctgtgtctatacaaagatggaggatttcgtgacatggcttccatggatggcagggaggaataggggcatccaacagttggcctggtctttctctctcccaaatgggtaaagggacttttccttccttgctgctaattttagtgatgaagcagatcattggatgatccagttatctgtatgacatagtcacagcatcctctcctttatcccagttgctgatgtgcaccctatgtgtggatatcacaaactttgaacacatcacaggatcagaatcagtctgtgttgcttagactgttagcttgcactttcaatttaatggactccttggctgaaatagtttatttgcacaagaaagactaaactctcaagcaactataatgatatgatacctcagaatgattttttaaaaattatttcagatgcacaaaataggctatttgatgtaaatagccagaaatactcagggatattagttataattgattattcttttctgtcattaaacttaactcagcagtatatcttttaagattaggaatctttaattctcaattttaaaaaatcatattataaaataaagactcccatttgctattttaaagacgtatttaaatattgttcttttcaggcttatagcctattcacccaatggctgccctgcatgaaatctagtccctgttgaaatctggtttttatgacctgagtgacaactttctggttttagtccatggaggacacatactcctgctttgacaaatttgcttagtacatctgatattaatacatgtgtattctcacaaacaattgattttgaaaatgtttgtaaatacaagggtattgtgtgttttattaaagcttggagctgacaagtgtaaccattattatctttagtttctgcaccattagtttcaaaattctcacctgtcatctttgcctgacttaagaagcagcagcacatgctgatgaaatccagccggcttgaaaccagagatccacagaagcatgaatgtcaggggcagtaaagcatggtttctggcacagccggggtcttttgtaacgctgtgtgaaaagcaaacacatgatttagccaaatgatttttccgtgctatctttggcatggcaaggagttgacagatggaaatgtaaccacaccgtgttttggtaggagagcatggagctggtgtacaataagtccaagcctgtcgctgttaccggaatggctttcccaacgggagacgtcaataacttcgtggttggcagtgaggaaggtacagtctacacggcttgtcgtcatggaaggtgatttttctgtttctttactgatgacatgttcttcatttccgaaagtctgttatcacattctggattttaaccaccttgcattatgagaaagcatctctggaaaaatggaaagcacgacttcaactcttcattatcttaaagagctgcatctgctctggtcattagctgttcataagactgtggtggttcacactgccttgagggaaaaaagctcgagcttctgagcctatcataacagaccacttgcaccttcccagcatctccgcataccttcagggtctagccatgtgcccatcagagataacaatccccaaatatttcttatccctccatgcctcaatgagtttgcatactcaacttcttttaccagttctagcatttctccctttttggcctggttaattcctcctcatcattcaagagccagcacagagatcattccatgtgaaacattttctgactcttgggcaaagaaaaccactcccacctttaagtcccatagaattttcaattctcttattcattcactcttccaaggaatatttactaagaacctaccatgtgccaggcatcatcaaaaggatacattaaagaacaagacagacctagagttcatattctagttgagggtaaaatactaataagcaaataaatatatagtttaggatggtaagtgcaatggagaaaattaaagtagaataagtgggataggactataggctgtcaagttgacaatttcatatattttccttatgcttctataatagcattaatcgtattttagtttattcattcatctgccatttttctcttactacattatttccatttcatctttgatttcctgcacagtacctaggacatagtaagtgaggagctaaaaatatatattggggataaagaaatgatatataatgtaatccatccaatctaaagaagtgccttaaaagctttcctcccagtcagatgggtcagaacagagtgagtcacacaaaccaccatgcagttcccaggtgataagaactctaccttaactgagagattcacaatgcccctggaaaagagttgtcagtataaagtggaatccaatagtttggactagattgtaaaattgcatgcaaaacttaacaggtggcctcatgtcttttgaaagggtcactatgttcacactggtgcttaatttgtcttttactttagtagttcttattccattgattttttttcatctcttgcactcatccgaggctattaagatttaatgaagaaccacaaattgttccaagttcatatccctgtgtttttgtgatttgtagaaatgacaagcatccatggctcagctatgtgactttttccattcaaactatacaagctgttatgttcctgctgttctgcacgtagaaacaagcagtatttgtcccctcacatgattcaaagatgacttaggaagatatgcctcacagtccattcccaatgatcctccttcataaaccctggctaaaaccacacattaaagctttatcaaagcataaaaatatttgataaagttattcattcataaatatatttgttgtatgcctactttgagcaaagtgcattgttaggttctgcaaggcctgcagacgtcatgtaaacctggtttctctcttcaaaataactgatgacggtgagaaagataaatacacaaatatctggaacatgagtagaatgtcttaagtggcatgagaggcatagagagtatagtaggccagacctggagtcacagctttatctatatgcgtattagaatcaacatggcataggttcagttaacttaacccatggttttacctaggtccttgattatctacgaaggctatagaatacattcattgataatttccagatttttttcattgctataaagtgaataacattttacatgatgaacattcttgttctgtggctactgtactttctaagcactatcagaatatgcactttggttcaaaagaagggtccctatggcacacaccacaaatctttttacaacaagctgaattttgctttacattggtccatccatctgaaatataaaatacagaccttagtaacattgtaacgtagcaggcattggctttgtagtcattctaaatgggtcatataggtctatgggggagaagcaggggattgctatttttcacctaacatagagaaggtgcaaatccacttccataaattaaacaaggtcctcattttgcaccctataaatcctttcaggatgctgttaagagcaagtggagtctcaccaggggccacttcaaagatcagttcctcgggttcattagaacaaatttaaatgatcatgtgtggaactgctcttagcagtttcactgggcataatttttgagtgcctgttacatggaacacgcactgccacactttgctcatgattccaaattttgctaagcacattgacatttattggtgctccagaggcccaaatgttttaataactgagctcgtttttattcttagtgacataatattaggattctacaattcctacatatttgtcatatttataacctcatgcacatgaatattttaaatatagcatttttggtatgttttctcacatcttcctaattgtatatgattgcatgcagaatactatgtgataatagagggctgcaaataataacagcttagttaaataagcaagatatgtctgtgtgtaattttttaaatgtctatcattatttctcaaatgtgcttctgttttaaaaaaggactgagacataagtttgtctctttttcttagctagtttattcaacaaatatttattgagcacttactatatgccagacacttggcaacaagaaagacaagatacttgcccgtatgggatttacagtggatatgtaaatctgtcttctgttttcagtaaagagaaaacattattttctccatattatatttaaattatgtgcattattttgtggtgacaagggtttccacaaagtgttacattttcagctatgttaaagtaatttaagaaatttacttgaaaaaaataaatgattgttccttcaaggatggatggagttttatagtcaataggttccccaaaaggagataaagcagaccatgtgcaaaatgctatctcaagaataaaatagtcttataaatataaaagcttcagagacctaagtgtatttgtttccattaaaatagctgcatcagcaatgataggctttgaggaattctgcaaaaagaattaaataataaatattgatattaaattctgtattttaaaaagatttcattgccctacattgtttttaaataatgaaaaatagggtaacatatttgcaaacaatttctttcaggataactgtaaaaatgatttcattttggtggtgtgtggttgttctaaattatggagatgcagagttgagggttttttgttttgttttgtttttaagcaatcattgcttttcagaggtcactggaattctgctcatgtgtgctcttcctacagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaaggtaagaatatcttgactgaaattctcagataatacataagggcagaggatggtttttcattccctggaaacagttgtccctaaagcctcttccaggcaacctggcattgggaattcatataccttctggtgagctcagtctacctcagagctagttaagtccattttatttacttttacacatataggtaatacttgaaaatattctaactataaaaaattcaaacaattcaaataatgataaagctgcagtcctcctctacctaccccaaccccaaccccatccacaacacccccttcactgcctgcacctcagtcccctccccaggggtaaacttttatcagtttcatgtctatgttctggagcttggtggtatctacttacttacatatgtacctatggaaatatatgatttgggacttgggtttttttttgtttggttcgttgattggttgtttatttttattttgagctattggaagtttttaagctggtaaatggccctatgttatgtttttaaaggtaattctggctgggagctgtggctcacatctgtaatcccagcactttgggaggccgaggtgggtggatcgcttgaggtcaggagtttgagaccagcctggccaacatggtgaagccccatttctactaaaaatagaaaaattagctacatatggtggtacatgcctgtagtcccagctactctcgaggctgaggcaggagaatcacttgaacctgtcaggcagaggttgcagtgagccgagattgggccactgcattccagcctgggtgacagagccagactccatctcaaaattaaaataaaataaaataaaataaaatagtaaaataaaatataattctctccatgcttgagagcaagaagaaaagctgagaccacttggaaggaaggcacaataatctaggaaagaaatgacagtgacttaaaccagtagtctgagatggagagaaataaatgcatttgagaaccatttaagagataaaagccacagaaactggtgattgatttgatagaaggaaggtaggagagggagtcatcagcagataacccaggtttaagacctgggcagctggtgagtgtagcactcactgcactggagaacagcaggggaaggacatgctggggcagagctttgcatatgttgagctaaaggtgcccgggagaggcatttcaagatctccattaagcagtttgatatgtgagtcagaagaagagagagccctccaaacagaacgtatgcactagaatagcagtgatcttcacaaatgagtagttttttttttttttcttttttttgaaacatagtctcgctctgtcacccaggctggagtgcaatggcactatcttggctcacggcagcctctgcctcccaggtgcaagtgattctcctgcctcaacctccctagcagctgggattccacagcacacaccaccatgcccacctaatttttgtatttttagtagagatggggtttcgcatgttggccaggctggtcttgaactcccaacctcaaatgatctgcccgccttgtcctgccaaagtgctgggattacaggcatgagccaccacacctggcccagcagtggattttaaaagaaacactaacatgcaatctggagggagagcaatacttaggaaataaatagaaattgaactagaaaagggagatgaaaaagtaacccaggaaatagaagacaaattagaattttctttgcagcttcatgggtattaatggaaaaaaccatgttaagaggacagaatttgcttttaactatatgaaaagataacaacctcatttataagagaaattaaaattaaaaccaagttgagaaacatatttccaactatcagattgacaaaaatctaagttttgcaacatactctgtgatgaggccgaaagaaaccagctgttctcatacatttccattggaaatgcaaaatggctcaacactgtggaagaggatttagcaatatctaaaaataatacatgttttaacagaacaatttccacttctaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatgttctattatggagtgatccctaagatacatttttaaatgagtaaagcaaagtggagagaagtgcaaatagtatattatcattgtttataattatataattagaagttgaaaggataaacaaaaaagttacttatagcaagacaggaagctaaaagaaaaaaataatagctagacttctttgaatataccttatttttacatttgattttggaaccatgtaaatattttacatagttataaaagaaaatgaaataaatttaaaaattgattcctaaaaaatttaaagtaacatgaatcaactttaatgtggttcaaattggtagcaaaatcttacatgaaagaatgatttgaagtgactttaaaactctgtatgtttggtatacattcctaaagggatatattttaaggatttttttaaactaccaaaaaaaatctaaaatctaaactacttctagtactcatattgctggttgtcatattgctactgctatcctgaggccattgtatttatatcataacataagttaaattactatgttggtgtcattgagaactgagattatcagcttggttgaaaggagatacagatgcatgcagttaagtaacaattctgtagtaatcctgaatctgagtgggaagtatactaagaactcatggtgtgtattatctttcaatacaaaagaatacatattcactgctctgttcaccaaaaagacctgggaacggtgaccaattcaatagcaatgacattcctgatgcccagaatgtgctccccaaatacagcttccactcaaggaaaccagggatcccagaagaaattactgattctaagcgcggagcaggaaatttataaaataaactgagattattttattataacaagcaaagatgctaccaaacactacaaagtttttgtcaaaggacttggaaaccaagttgagtaagcttctgttggcccagacaacatcaataagagtaatagattcatgagttcctaacaatactgaagaaaacaaacaaataaaaaacctctttggccacctatggagaatactaggtaaacaaactcattattttgaaaaccagtgagtaaatgaaagaataaaacatgtagtctgtcttttctatatgaattgtatttcagggttactaaatcattgatgaggggactttttctttacagaattccagctaatataggaataaaaaatgggccggggactgtggctcacacctgtgatcccagcactttgggaggctgaggcgggtggatcacgaggtcagaagatcgagaccatcctgcccaacatagtgaatgcttatctttactaaaaatacaaaaattagctgggcgtggtggggtctgcctataatctcagctgctagggaggctcgggaggctgagtcaggagaatcacttgaaccagggattcagaggttgtagtgaaccgagatcgtgccactgcactccaacctggtgacagagtgagactccatctcaaaaaaaaaaaaaaaagaaagaaagaaagaaagaaatgacagaatttgaaaatcaccattttgcaaacaccataatctaggcaatgattattgctgataatattgtaaaaatagaaacaacctttttcataattacagaatacacaataccacctttgaagtaggcttacactcaaaattgaatctgaatcttatcaatcctccagatctctgaatttagaagatacagatgcaaaacattaaataacaccacagggatgcaatcaaccaaacccagaccgctggcatatctacgggacacctgatttagtttctgcaacaaaaccaaaaatttttcctcaagggcaaattggaagtggaaacaatgtattaaaaaaaaaaaaacagaacaaaacaaaacttgggacatttcagtggatcttaaaatatggatcttacatagatcttgattcaaacaagcaaccaggtgaaaaactttacaaggctaccagggaaatgcaaatactaactgtatatttgatgatattcatgcagtactatttttagtaattttttttttttgaaatgtagtctctctctgttgaccacactagagtgcagtggcaccatctcggctcactgcaacctccaccttccagttcaagcaattctcctgccttagccttccgagcagctgggattacaggtgcccgccactacaactggctaatttttgtatttttagtagagatggggtttcaccatgttggccaggctggtctcgaactcctgacctcgtgatccacccgcctcagcctcccaaagtgctgggattacaggtgtgaggcactgtgtctggccaataattgttatgatcactttaaatggtgttaccttttagggatgcatattgaaatacagaacaaattatatgatattagggatttgcttcaaaataagcagttgggaatgggagagcttgtgaatgtaggtgactaacattggtcatgattgctaattattgaagctggatgattgatattagtctctctatctctgaatatgtttaaaattttctataataaagaacctttaaaaggcagaaaaagcaattagtaataatggctaatacttcagagaagaaacatcaggacgggaatatgtccattgtatttagcaactcagaagccactagtgtccatggcaaaagcagtgtctttggagtttgttgagggtgggacaaaaaattacaatacgttaaagaatgagtggaaagcaagaaagcattaaaatcaagatgttttctttcctttttttttttcttcttgagattagagagagctcaaggatgttgctgctgtggaagagcctgtgaaggagagtagaaaatctgtaagtgtaaggtagagaaagggccgtgaaaatgttgccacaaatgaattcatagcatggacagggaagtgaattttaaatctgagcagcaacatctcttctgttgtaacagaagagcaggtaaggatgggatcatgtgtgtgtccgtgtgtagagttagtgaaggaaagcagagcaaactctcctgtgatggctattttcttaatgctgtagggggttaaatactctgctgagtgggaagtggagctactgaagggagcagatttcagctgatcacagaggagaataggaagagctgattagggaatgaaagatggactgtggtcagtgtggtgggtccagttgcggtcagaaaccagaatgttttagcagcttcaatcttcaggactgatttcctccaagaaagggcagcagtggaaatatgggaatgaatgaagggcaaagttagatggatgtgggcaggagccttaccagagtgtgatggaggggcaatagagcaaggaattgggagatatggacaagaaagcttctgatgttataggctaaggatgctaagctggagcagaaaggaaataaaaacagacaggagaaagtaaagagagcaaaggattggatgcccctataagatcaaagaacaaggatgaaggaagtaattgaataagagaattagtaacataagatattactgttagaaagtgagatgtttggatttagtatttcacaactgaaatcattccaagtgatttttttaaaaagtcaaggatgtggtcatgtgtatagctgaagtctagtgagggtggaattcactgcaaatgaggacgtcacaaaaggtcaaggtgctggtgtgttgtgggctttggagtgggccagaaaatagctagactgggatggaaaaggaaacagcgatcacagtaccaaagtcctcagtgaattaggaggagacatcaaaagaggtagagaatgatacagccagatggcctgagcttaaaagaaataggactttttactggaggcctaagaagcggtaaaatagccctgaagagcaagtgagaagctgaccctctcactatcttgaaatagaatacatgataatgaacagcttctacatgaggaaatggcagaagaggtggtgaggttagggcagagctaggattccactgaggcaggcaggagaagtagcttcccatgagaaggctgaggttggaggcaaaggcatgtatcatggaataagagatgtggggcaggggaactgtaggaacatcgggaaagaagagtgcagtgagtgatttgttccggtgaaataagtactaatagagatttctagaaaatgctctgagaccccactgggaatgggaaggggagacggaataaaaggggccaaggattcagaagaggatgctaatcgttacatattctagcacaatgaggttagcatgaagggagagggaattaaaacacattacattgccctccctctactcccacagcacctcctgccgcaccacgtttcatcattaaccactgtcagggaagaccacattgaagcagaaactttgtcggagtggtttacctggcaaacagagaaccaggctgcattccaggcagctgagtcaacaaatgtccaagcagccattttcatccaaatggctggaaggttgggatccatttagggaatgaggctggaaagataggtctatacttgattgtgttgatttatttttattttctaggtggtgacaagtcattttaggagagaattaatcaaaatttgattttaaggagtttgctttggaatactgtggaagatgaatttgtgtggggagccaagatcaacatttatcgaggtcatactatgtactaggcattgtgctaaatatttgaaatacattagttcattaaatgctcacaataaacctgtgagtagatgttagtatcccattttatataagaggaaataggcacaagagagcgtaaataacttgcctgatgttcttagtgaataagtggggaaactgggattcaaattcagatttgggtgaccccaaagactgtgttcttttccacaccatcgtgttaagcctggagacaagaagcccagttgtaagtctggtttggtcatccaggtgagagccagaatttaggcagtgagcttgtggaggagaacaccaatctgagaaataaaatcaaccagatgcagtgaccagcagacctgatttgagaggggagtcagtgatgattctgatatttctgtcgttagcatctgagtgaagaatggtggtgccagtgactgagacaggacatgcaaggggaggagtgggcttgggttagaggtaggaaatcagtggtctgggcatgcttagactgaggtgtctggaaattcccacaatgtaattgaagatatttgtcttagtccattcagggttctataacaaaacaacttagagtgggtaacttataaacaatagtctttattgctcacagttctggaggctgatatgtccaagatcaaggtgccagtagatttggtgtctggtgagtgctcactgcctcatagatggtgctttcttcttgcatcctcacatggaagaaggggctaacaggctccttgaagcctcttttataaggatactaatcccattcatgagggtggagccctcatgacctaatcatctcctaaagttcccaccttttaatactatcacagtagggatcaagtttcaacatatgaattttggagggacacaaatattcaattgacagcgtaatactgaagctcaggggcaaaggatgagttagaaatatagatatgacagtgatccatcatttattccaaaggtgaacattataatagaacatgaattgaagaggctatgaatgcaatcttggacctgctgatgctgcaggtgctgaggcgtgagaacaggatgctcaataaagaatgtgataaagactgttaaacaccagagatatcaagaaatacacagatggcaaggcaagaagagggtcacgtggacctcagtgagaacacttttagtggagcactggagacagattgtgagtggttgcagagtgaaaagggaagacagtagacacagaaaatatagactagtctttcagacatgaggcagtgaacataaggagatagagaggcgactagcagggaaagccaggccaaggaaggattttattattatactctctgagagacctgagtatatttgcggcctgaagaggagccagtgaaaggtgtatggtttaaaaaatggaggaacagaattcaccgctatataactcatccatgtaacaaaaagcgacttgaactccaaaagctattggaataaaaattaaattaaaagaaaaaaccagaggaagattatttcaagtgaccatgtcaggtttaggatagggagaagaggcaggatattggcaagactaaaaaaaggcttacaagtaagtttagctacatggaagtggagggagaaggaggaaagaagagaaggtcccccatttcttcggtggagtcagaggcagttatctgttaacgatgatgggaactgggatgtggtagggagaggaaggaggattagaccaggtcctgtaagagatgggacagggccctgaactgcatagatttgaggaccagctggggctaaatatcacagatgtatttcataggtgatatctaatttaaattttatgaggtgataagaagagtgccaagaattgtgtaaaattgccattgtggaatctcttacaggaatctcctgaatctgacattcaaagctgtccacagtctgtccccaccattactagagcaggtgaacagatccaggtttgggagatgcaccacttctttacaattcttccaagccagtgttctcaaaatgtggccccagatcagaagcaacagcattacctggggcttattagagatgcaaaccgtctgggccccaccccagaccttctgtgtcaaaaactctggggatgggagccaacaatctgtgttttagaagccttccaagtaatccagatgttgctaaaatataaagagccatgccctaaaccaccgtaaagttctatttcaaacatcccatcctacagagctggtggggcagttcagttacattgagggacccttcctttctcccagggttgtgttagagaactggggatctagtttagggttcagacaggagaatgaaaactattgtcccacctgcaacaaggtttcctcatataatgaatatgctacatgttctggccagaggtttgtacggtgaatgtatttgaaaccccaaattaattctaaccctttatgttgtcctaaacagttacgcttgaaacttgacaatatgggctaatggctttctcctcttcttaatctctatgagcgtaaaatttaaaggaagcaatcacatctcttaaaattactaatcacaggccgggcacagtggctcacgcctgtagtcccagcactttgagaggccgaggcaggcagatcacaaggtcaggagattgagaccatcacggctaacacggtgaaaccccgtctctactaaaaatacaaaaattagctgggcatggtggcgggtgcctgtagtcccagctactcgggaggctgaggcaggagaatggcgtgaacccaggaggcagagcttgcagtgagccaagagtgtgccactgcactccagcctgggtgacagagcaagactccatctcaaaaaaaaaaaaaaaaaaaaaaattactaatcacattttgcaggactatggctgaaaataacctttatcttaataaaagaggcaaagtaaaaaaaatactctcttgaaaatattggaaatggagttttttggcctttttccatcttactgacaatgagaattttcatggaagtgtagcggagacaaagatatgagatgggtaattattgtagtcccttttgacaataatgattaccttcataatctttactttaaacttattgggtaacttggagtcatcttatcatttaaacaaggcaaagaagtttataatagagtcttaataggattagtgatagcctcacacttcagcttgtaaattaaataacataaggaaaaatcctccaaatcgtagaaagaattggtgctaagagacaacactatgaaatagaatgaaatcaaattttttaaaagtctgcaatataatactttgttgataaaatacagtatagtggtggggcacagtggctcacacctgtaatcccagcactttgggaagccgaggtgagcggatcacctgagctcaggagtccgagaccagcctgggcaacatggtgaaaccccgtccctactaacaatacaaaaaattagccacgcatgatggctcatgcctgtagtaccagctactcaggaggctgaggcaggagaattgcttgaacctggagggcacaggttgcagtgagccgctgcactccagactggatgacagagagagactccatctcaaaaaaaacaaacaaacaaaaaaaaaaacagtatagctcaaaaagataaccagaaaagatcaaaagcaaacaattcgacaacaagaaaatttggcaacagaaatatgcattttatacactctactgcccaagaattcacatgtctaacataataataaaatattaaaaaaggaagtctgtattcgagggggaatgtcatgctggaattagcacagtgagcaaaatgaatctcaccctgaagcctatagagaagtccatatgaattcactttgcatagctaaatgattgccagagagacaataacacttcacatactgaaagagagaagtgatgattttaaagatccaaatttaaaatgaaacttctctacatgggatcttagaaatactgtagttaaatgaaaaagcatatttagagaaaatgcaatcattgtcaattctctttgtgatttgaatagttaatatttccattaattttatagggttttatttaaactttccatgaggattgaacaggttgagtttttgaagtgggacaaacatgatattacatattttgggggtgctaagttcctaaacaataccctttcccattcggtttatcttgtgcctttttctaccaaactgcagtttcaccctctacagcctgtatttatccccatgattgccactagacctgcttcttcaaaagttgccctgacctgctttcttgcctgttccaggggtcatttttatcattttccttttctttgatgactttgctgctttaataatgttgattagtcccttggaacatccttttttcaatgaggctgcttttagaggatagtaaaaaaactacatattttagtctgtccattatgatcctttaaaaaaaagtactaaaaatgcattgcctgaataaattctgttgagtaccaactcttaccttttactgtatcttagcacattaaatttcctgtccatcaaaacatgctggagctgatgctcagaaataaagtatgtactcttggctggattaagacattcattattccactcagcttgtctgtttgctgaggttttggataattttttttcctgtgctgcagtttagtttagtggctagacaagttctgagtctttggatttttttattaatgcatccagtttggaaagtttcagtggattccagttaaattttgggttaatatttattttggtcctggtacaacttcagggggatttaggttcatgatactgttcatgtatttgccaggtcagtccctttctttagacttcaatgggcttatgtttcttctatttgtattaaatctatcttctaaatcctttctgctctcaacttttgggtcttaaaattcaattccattatgtcgactgatcaggtatatggcctaacttaacccatgtgtttgtatttggtgtggattttggacaccaccctggggtgctgtcatccaagaacctttcgtgatacacatttgattgatggaaatcactgacttcccctgaatatatcttgacattgtagacattgtacaatctttcctagcagttaacatgcatctcaatcctctaatcttttaacagtgactctgctctgagaataaaattttctaagtgactggagaattatgactttgcacaaattagaaagataatctttaattttcaagcaactactgtgaaatcaataaatattacctatttcacttttacatcctctgatggggttaaaatataagatggctgtcttagctgattgttttccctgttagctactagaaaagaataatttgaattttatgaataaaagagacaagaaacattttttcctgaggaagaacatttgttattcctttttaaatatcttcatttaaatgattatgtattacaataaatgttaagtatgggtatattataaataatacaatgattaaaaaatttatctcttgaatcacagtgagtatgcaactgggacagaattgccatcctttccctgtaagactgtgagctccttgagagtaagtccctgtgttttttgtctgtatcccattacctggcatagtgcttgggacctggtaggcactgagtaaatcactgaattaatacatgaataaataaatgctggtttttaaaaagacgtacattgaaagcatactatagcaaatatttagttagcagtagttttgagcagtaaaattcatagccataatttagaaatataataattagaaactgaggttaagctttaaaaatcctactaggaaatatttaagaaaccataacattgaaaaaagaaagcagaagtttgaaggaaatttagttaggtaaagggagaaaggaaagggcattcaagcagaatgaacagagtatggaaaaacacagacacatgagatagttagtactctctagctgtgtgaacctagaaaagttacttaacctctctgtgctgcagtttagtcatctctaaaatggggattaaaatacctcctatttcatgaagttcttgtgaagattaaatgagtgaatagttgtaaagatgttaaaaccatgctaagtatagggtaagaatattaaagatgtagcaatagtaataattaccactattactgttgaatattatggtaattgttgctgttgttatttggatgctaaagtgctttagtaaggctggagcagtgggtacaaggtgactggaacagaataatgaaaggacagctctcgggacaaaatgggatcagatgacaaaaggcaaaaaggcagccttgtgatgccatgcgatggagtgtagactttcttctgaagatgacaaaggtgacagcttatgtgaaagtagggccacatcacctcttgcctgatgtcatgtagactgaaggtgggcagtaaggacatcttaccttctcctcagtattttgaacaacagtgatagtgtaatgtcctacctctgatgactgctctatcaaattaccagcagtatttatgttccagagtaacccctggatacatcacatgcatccctcctatctccacagtagttgattggattatgaatgcacactctcacaattccacctcataaaatgatagcgacttcattgactggagtatttacttttgcaatccttcatgaggctgccccgcccaattcactacatctaagttttcagacgaagccaattatgattacaatagtcataataataattgtagctgcatttaactgaataatcacatgtgactggcattatgccactgatgtcacataattttaagtgtatttctgtaaatacattgccacacgacctcatctggaatggatcactgcagaattatctcatctggcctttctgctagctttatgtttactggcttctatattttatcttcagtttggcttttctttttatcaacttataattgtttttaaatttggggggccaaatatatattcccttcctcatccttcttggttccaacaaactcctgtcactagcacttctaatcctcacccaaaaccccattagtcttttcacacctgctctccaaagtcctgacttcttgaaagggatttaaaagtggcaagacaaaaagacagaggtactttcatttgtcttagatctcaggaaagtatgtgtaggcatatctaggtatattttaatatttcttttatgatatctatgtatttctttaacttgtttcacaatttagtgcatacttacacttttttttagaataggatattgctttgttcatctttatcccgtgtctcacatatgttagtttcctagtattacacacaatgtggcatgagtagaatttgcccattaaaaataattactactttatcaacatgggacaaaaaatattggaagattattctcattcttctggtactttgtaaagaatagatataataagaattttgtagtggaaaaatataattaattttttaagctttctttttttattatacttctgggatacatgtgcagaatatgcaggtttgttacataggtgccataggtttgttatatacacgtgccatggtggtttgctgcacccatcaacccgtcatctacattagatatttctcctaatgctatccctcccctagcccctcaccccgcaacaggccctggtgtgtgatgttcccctttctgtgtccatatgttctcattgttcaacttccacttatgagtgagaacatgcggtgttcggttttctgttcctatgttagtttgctgagaatgatggtttccagcttcatccatgtccctgcaaagggcaggaactcatcctgttttatggctgcatagtattccatggtgtatatgtgccacattttctttatacagtctatcgttgatgggcatttgggttggttccaagtctttgctattgtgaacgatgctgcaataaacatacatgtgcatgtgtcttatagtagaatgatttataatcctttgggtgtatacccagtaatgggattgctgggtcaaatgatatttctggttctagatccttgaggaattgccgcactgtcttccacaatggttgaactaatttacactcccaccaacaatgtaaaagcattcttatttctccacttcctctccagcatctgttgtttcctgactttttaatgatctccattctaactgacagtgaggttttgatttgcatttctctaatgaccagtgatggtgagctttttttcatgtttgttggccacataaatgtcttcttttgagaagtgtctgttcatatcctttgcccactttttgatggggttgtttttttcttgtaaaattgtttaagttccttgtagattctggatattagccctttgtcagatgcatagattgcaaaacttttctcccattctgtaggctgcctgttcactctgatgatagtttctttggctgtgcagaagttctttagttgtattagatctcatttgtcaattttggcttttgttgccattgcttttggtgttttagtcatgaagcctttgcccatgcctgtgtcctgaatggtattgcctaggttttcctctagggtttttatggttttaggtcttacgtttaaatctttaatccatcttgagtggatttctgtataaggtgtaaggaatgggtctaatttcagttttttgcatatggctagctagttttcccaactccatttattaaatatggacacagggaggggaacatcacacactggggtctgtcgggggcttgggggttagaggagggagagcattaggagaaatacctaatgtagatgatgggttggtgggtgcagcaaacaaccatggcatgggtatacctatgtaacaaacctgcatgttctgcatatgtattccagaacttaaagtataataaaaaagaatagttttcaaaaaataattatatttatttttccactgcaaaattcttattatagttattctttacaaagtaccagaagaatgagaataatcttccaatatgttttgtcccatgttgataataaagtagtaattacttctaatgggcaaatcctactcattccatattgtgtgtaatactagcaaactaacatatttagactcaggataaagatgaacaaagcaatatcctattctaaaaaaaaacagtgtaattatgcactaaattgtgaaacaaggtaaagaaatacatagatgttgtaaaagaaatattgaaatatactaagaaaaaaactcttctttttctttccagagtgaagtaactggccctcccataaattctagggaaccaggcctcagtgtttattactggaaatgcaccagctttgtggaagtttctggaaaggaatgttgtggaattggtgattaagtggaatagctttctcttctgtcccctggttcattgacttgatctaagcccaaggcaaaagtaagaggaggtctcttataatctgtcagcttccttctcacttaggaccttccttaaggattaaaaacttaacttttaaaccagagttcctctttacctctctgccagacccaactacattaagggatttgacgggtcaccaatccaggagggttatgcatgagacacttggcttccacccacctatggaatttaatttatgcctggttggtttgattttttttttccctcaatcaccctcctttaacaaaggccagtcaatgagctgagttttgctgtcttctgctattaggaccattttcttaaggtagcaatccatagaccatcacaatgaagtgtgtttgtgtctatgagtgtgtacctgtgtgtgacattctttcttttctttacagtattttatgtttagcttgatctgtaataaattaaagtggtcatgcttttctctaaggatgacctcctccagctccactcaagaaagtctatttattgggaaaatagttccttaacagcagagaaagactatatcttctttatcaagtttgtgacaaaattattaccagtttctctgaggtaggtctctccccatgctcattcttcctacataatccttttagataatctacccaaaatatacttttcattatgccatttccttatactacaacatacagtagtgtttgtattctgtggaactctaacaggcatttctcaaaggcaagagttccatgatttactctctctatatatatctatatctatatatagtatatgcatatagcatatgcaaatgtatatttactatatatatagtgtgtatatatatatgcagaaagttaaagtcaacaagcatctgtagtaagaaggtcttttttaatttattcttcacgaatgagctgcatatatggcatgtgaagtttatcagagtgacctaaatacgggattggtttttaaccaagcataccaaagaatagtagtcctgaaaaacataactctggaaactaactgataattgcattacttgctttcttaatcatttcaaacacctccacctgcatttcatggttcttcacacttttagacaggtgtctaaccattagtctcataaactaggcacataaatgtccaggggcaggtaaagttactggagaagtgtgtggtgctcctgggtgtaggaactccagggagaattaaagaacttgttaaacaaggtggccttaatttgaaccccttaaagtttctgggttttgactggaactggagagatcagaagttgaggagaatgaggaaagtattggaacttttggaaatgggtgtgctcagtctgtgcgagtcagagtccttgaaactgggccttttctacgtctgagtcctaatgaagattccagttttcacagtagaagttaaagaaaaaaaatgtctagaaaggagtgatttagagatctttctaggcccatatttttcccatcttatgttaattgtaattgggtcagttagaatttggtctgttaaataaaatggtttaatattttgaactgtccacctattcttacataccatttagtagtggactcagatgcctaaattatctaccaggttttttctggctcaataatgcaacactcctatagtcagaaaacaattattgtaataattttaatcaatgccagaaaatttaatacctgaatatgatgtaaatgttttttattgcatttatgtgttagttgcttccctcttttccactgagctgtagcttcttaaggtcagtgatcatattttacatctattctatactctccatagctctcagtcagggtactaaatgattaatgtgtcatataggctgattgtcttattgaccaattacatatcaattaaattaagttgccagcagtcatatttctggcaacaattataggacaggataatctctgaggttttatatgtattgtgaatttatttccatcctcatttggacaccctagtgactgaaacacaactgacccccatggacctacaaagacacctcagtccattccttattgatgtctctgactactccattctccatttatcacctttttttcactccattgatctttcctcttctgtccaatcaaatgtacaatgtttacataccaaccaacatgttatcattgcaaaacatgcaagaataacagcacaaatataattgacattctaccatgaagtaagggcaaatattgtcttctctatcctcgtagtcaaaagaatactagatttgttagattttatcaattatttattcattaaaccagcattcatggagaacgtaatgtgtttttaaattcatgctttgtgtttttaactttgataagaatagaaacgtgacacgatctctggtgccaacaggttcatagcctacatcttactactcaaacttgtgtaatcaatagaacttctttaaaaagagatgttttgtccacctttagtattgcctgaagttagtttcatgtaacttaaatacatctagacaaagaacaagttatacattccttatacttattcattcaatacatgaccatttattgagagcttactatagttcagttactgggagtatcacagtgacaagggcagacaaaacccccccgacttcacaaactgtttattctggtgggaagaaacagtgtggaaaccaaagaaacaaatatagttaattatgtttttttgagacggagtctcactctgtcgcccagtttggagtgcagcagtgcgatctcagctcactgcaacctccacctcctgggttcaagcgattctcctgcctcagcctcctgaggcaggaaattacaggcatgtgctaccatgcctggctaattttttttttttttttttttttttggtggagacagggtttcaccatgttggccaggctggtctggaacccctgacctcaggtgatccaccagcctcggcctctcaaagtgctaggattacaggagtgagccaccgcacctggccagttaattcttgttatgtacaacagttgtattctataaagttgccacaaatgccaaactgacaaatactaaatgaaccattgcttctgagggagatactggatttgattcctacgaccttctggttacaacattttcatcagcctatgaatacattatcttattgtatgtgtgtttctgtttaaagacacttgatttaatgtgtattgttggttcattgacattggatccttagccaatagctcatgcctgaaggatgcttgtttaacacatgtatttttccagtagggcacatcacagccttctggcacttaggaacactagacagcacttcagcactatgcttggggccattccaaacagtgaaatcgaaaaaaaaaaatgcaaaaaccatggcaccaaataggcaacaaaaaaaagatatttgtttacaatatgagagctgaaacaagaaaggagtgtagtcttattctgtctgagctgggaacaggtacatcaggggactcaaattttttgccactctttgcttattcatgaatgatctaggaatatttattttggggttacaagtaaatttcagaaagtaagagaatttgcaaccatggaatccataaaaaatgaggactgatttcatataataaatattcagataggaatgaatgttgcaaaaaaaaatgaaacagatctggagagtgatgggggtttggaagaactgtttgagctgggtgactaggacagtctgccctgaggaggggacactttaatagatacgaatcttcaaaagtagttagccctgtgaagatggaggacagagggagcaagtgttaaagtctgtgaatcaggagcaagcttgacttggtttgtgtgaggaacaggacagaggtcttcatgcctgcaacaacaacaacaaaaaactgaaccgacagaagatgagcttgaaaagctaatcagtggtcagataatgtatggtctttttggcctactaagtggcttagactctgttctaaagggtaatgagaagccactgagggttttaaaatatatttgagctatagcttattagataattttacagccttcccccaaagtttacaaatcaaatttacccccaaacaataaccatttaagtgaatcacattaacttaatgtgacaagtggatgcttcactgaaactaaagttctattcacagtatgactatcgggctgacttccctggtgcaggttcttcccagttcagccaccttcgtgaccctgtgtgggtgatggctccaagaaccaccctcctgtggcacaaatccatcattacatattcatggttcctggatgtggtctcttcccccaagtctctcacgactgtagcaaagacactccagcaggcctgaagtccgacatacatggttataaggcagcagcaagcaggtgatccctagcatgctttttgactctcatctaaaggaaaacataaaataaatgtttccattagagaactcatagataccccacaatccctcaagaaggaaacccacagccctgcaaattgtttgaaaaccttgctctcacagaggattattagggcagtgaaagtattctgtatgatgctataatggtggatatatgtcatgataaatatgtccaaacccatagaatgtaccataccaagtgtgaaccctgatgtgaactatggagtgtggatgacaatgatgtgtcagtgtggatccatcagttgtaacaaatgcaccactctggtaggggatatttacaatgggagaggctgtgcatgtgttggggaaaggagcatatgggaaatctctgtatactttctatttaattttgctggaacctaaaactgctctaaaaaataaagtctaaaaaaaaaaacccttgctctacatgcaaaactcaatgacgcttcagtaatgaaggaagagtgtatttaaatactataacagcgtaaggcagacacaaaggcagccccaaaatggaacaccgaaaaagaagtcagaaaacaatggctgaggctggagaaaatgagacatctccctgtgttctgtcagtgtttgagaggggattgtggggtgagggaggactttatctggatggcaagatcagaccctttgcgaggagagagaatagtacattctctaagagcagaaagcagtgtgaacaaaggcttggagaccagaatgcgttcagtgtgtggaggagatggtgaatgcagccgactggctggaacagagggttttaattaaggagcgaaggggaaaacacacttggaacgcctggtcctgccatttcagcacgaatctgcccagtgggatcagatggtggtattcatagccctggactgtcttgtcaaagtgttggctgtggaatctgtagcatggaggtactttctcaatgtagctatttgtactgagcctgtcactagctcgggaagaggtaaaaattacttgacagtgtctctggactctcacccatccaaagcgtaagagaggatggggagtgtcagagtgggtgggcattggggaaagtgagttcttaagaactggagctttcagtgaaagagaataaagggcattaggaggcttacctagagttgggcggcagtcatgccaggcaagcaggcccccacagtggaatctccgaaccctcccacttcccaatagtgagccgttcacccccagagtgcttgatttggtatggaaaaagagtctctctctctcttcctctctctctctccctccctccctccctctctctctctctctctcacacacacacacacacacacacgcacacaaacacacacacacacacactccaatttatcaaaaatcactttggaatttaaaatctcagctaatgacctttctcagaataaaaaagtcacattttcgtcaagttctatgggttccctattaaattgcaaatgtggaccatttggcatatgcagttcacccatttaaacccatttgactttgtaaggcggggtgataacattttggatttcatttttgtttgtcctataagagtcttgagttttagccaaaaacccaggccttggatgaatgtgctttagacctcactttttgtcacaaggccaagtggacttgagagagagggtggagcggtctgttgaaacatgatttttagttttgcccttcgcctctggagccagggccctggcccacgtccagctgcaggaagagaagatgatggtattttctaggtaattttaaggagcacaaacctaaagtaaagtcaggtggtttcaagtctgcactgaatttttcatgttaaggatttatcatgatttgggttttcagcagagctgtattttaaatgatgaagggagctgtattcctgtattcttccggagacagacatgttttggttgtttgctaatgacctctggttttgcttatggggagttttgttaacaaatggaaatttagcaaaatagaatactttccttcttttgtttttttctttttttttttctctctaaacaatgggaacccttgcagtaaactgtcaaaaccaggctatagatatttgttactgtagcatcattaatactgtgtaaatataagttagtcgcttcggcaatcagacatattcttctgatcttctgtctttgcttttaaacagagcctttgccttgctgtttgatagatcctattgttaagagaactgcagaaatgtattcaaaaattcttcaaaatttttccaacctcaggaacctattcaacagtaattagccttgaaggcagctgattaaggactctcccaactcactccccatctcaccctgtagccaccatttctaaaataaaaagaagtctgcagagggtgacaaaattaaaccaaatgaaactttaaactccggtgcagaagacttctgtctcaggaaaaagtagctgtcttcaaggcagaactgactgactggattgaactgaattataatttctggttcaagctgagttgtgtccctggggtggtttgacctgtttgtattagctttccactctccatccatatttgtcccggtggtatcaggaacatcacagaactatgagtatgacttaaagctaagttgaaaagaggctctgctgtcttcagaaaggggaatatatgtgtatgtgtgtgtgtgtgtgtatatatatgtgtgtgtgtgtgtgtgtgtgtgtatgtgtgtgttttctttcattacaggcagcctgcctctttcaatggaggcgcaatatagctgatggttgagccgtagtcattgattgcaaagggatgtgtttaggaaggagagaaatagctgctcagaaattgccttctttctctctcaaattgcactgttgggggaattacataagtgcagaattgtggggaactgtgcgcatgtgtctgtgcattagaggccaagaggaaaaaaaaagtctgccttctcttctcatttgagaattatgttagtttgttagggctgccataacaaactaccacaacctggtttaaacaacagaaatgcatcctctcatagttctggaggctagaagttcaagatcaaggtgtcatcagggttggtttcctctgaagcctctcgctttgacttgtaggtggctgccttctccctgtgtcttcacatgggcttccctttgtacacgtttgtgtcctaatctcctctttttataagaacaccagtcatactggattacagcccgcccatacaacctcatttaatcttaattatttctttaaagaccttacctccacaaacaacagtctcatattccaaggtactggaattaggacatcaccatatgaatttgatgatggagagagagggtgataattccacccataagagctaaagatatttcattatcacaattgatccttggttatggacaaataaagagttaaccataaggcctttcactaccgccacctcctaatccttatattgaagggctccagtctctccaaggctgaatcccagaggcaacagaaccttgaaggacccatggatgtcgagggaaagcagcgggaacagttgatgcaatgtggttagcgggagaggtggcttggctgatgctgaatgcagagaccgttgatcaccatcttcagaatacatttactgactggtgcagggtatttagttgccctgtggtgctggtttggattcaggcttctttagagtcagtgcttgtttctaagcatcattgttcttctccagaccaaacatatcagaatatttcatggaaagaaatattcatatctctctctctctctctctctctctctctctctctctccctctctcagtgtctctccaattgaaatttgtgtgtttcagggacatactgatgctttaagtcaaaggataagtttatttgtttttaatgagatacaattaatcagacatttaatttccattgctttgtccctgtgatccacaggaaatttgtggctagatttcctactatccaactcactagtggcctacctttcattacgatttttcatatagctttcttgctcagtagcagtttcctgatcttttcccgtggtgttcaaacatgctgaaatctttgccatgactgggcagcaaatgtgaccttcatcagaggttacatctcaaggtaccaaagtgaggggaaaggttctgaaccaaggtaacatgctagaagcacaatagttatcccaaggaggatgccaaatcaaaaatccatttgagagagtagaggtttggtcctggggagtctaggaaagcccaagcccagagcatcagaggaaggctgaaggctctgttcacaggtgtcagacaaaataggactgaactcaaggctgcgttcatcacctaattacagtccatcttatctgccttccatttgccagattgtatgccaagtgcttgagacagaaagcaaagtaagaaatggtccaaaaaatcaaggatggtgtatctaaatggacagtgggtggtcttaaggcaaaaaaaaaaaggcagccctagacacacactcatgtagtagtgttatgatttgcttagatattagtggttgatgattagatgggttcgattaaaatatctcaaacatggcctaaaatttgggttagcttgcaaaccacttgaagaatcagcgtgcacccacatggaccattgccacatttgccaaccaccctcaaccaaccatattaatcttccaacacttctcagtttaagaccatcaacgaattcctaattgctacattcaatggtttcttggtattatccacccctcattcctgcagctctctctagcccagttatgttctcctgctttgtctaggtcctctccactggttctctctcttctactctctcagcccaaatgctcaaaatttcctccatagtcctccttcttctccatcctccccactcttttctttttttctttctttctttttttttttttttttgagacagggtctctctccgtggcttaggctggagttcagtggcataatcatggcttactgcagactctatctccaggattcaattgatcctcccacctcagccttccaaatagctgggactacaggcattcatcaccatgcctggctaaatttttggtttgtttgtttgttttgtacagacagggtttcgccatgttgcccaggctggtctcaaactccttggctcaagcaatttgcccgccttggtctcccaaagcgctgagattacaggcgtgagccaccgcgccgagcatcccggctctttcctctcccacagcacctcgtgtgactgattctttagtgtggacttcaggcccactctctctttcaacttcagacctgcacttccactgtcagcctaacctgagtgtctctaccagagactcaaatgcactgtgtttaaaatacagatcagaccttcctctatttctctattttttctattttctactcatttaatggtattcgtcattcagttgactgcactagaaaagctgaaaacactcttgtgaatgttaaacatctctgaatctgtttagcacatagcacatttatcaatgcacatttaatacattaatagctaattgcagcaaaaagttttaactacatacccaagacttttcataacataccccacttttcccctacccaaaccaaaattattttgttttcattatttcttaggacaaatcctcagagttcactcaggctgtccccacctctcatctttatatccgtctgggaataccatactgacttaaccaggtttttgcatgttttgctctcctcttcttgactgttttccttaccatctgtcaaagtctatgtatctttcaaggcaggttccctcacctgtcctagataataccatccttgaccacatcagactctggtaacaccaacacaccactaccacccccaatcttcaaattcctctggcacctaacatctgtaccacagaatttagcacctggctacatacttgttctctttctttggtataaacaaggcagagagccagtctgttttccagtgatttgcagacatggtaaattcctcccagagtttttcccagaattgtgtctttgagggggaatttatattcttcctttcttcagatggtaaaaacctgggtacctccttgtgatatgatgtgttttcccttttgtcttagttatcaggaaatttagagctgttgcagaaccatattgtaataatcagcttatctcaggatcctggtaatagctatgtattctacctcccttctttagaactctgttgtgtgtttgttcttaattttgcagtatatttaacttgtaagactccataaatccttttagaacaaagtgagaaaacagatccccaaataagcaatattcttctcttattatatcataattttcattctcttacctggattgtttgtgcttgagaacaaaatcagttcctgtatttcttttgattacccaaagaagaaagcatatgttaggtccttaataaatcattgctgaaatatgtgccttgttaaagtaagttggattattttaaattgagacagaaacatctcctaaaatgacatcattctaacaaagggaccttaccgtgttttatttctgctaacggcaggagaaataaacatcttctgatattttgaacattttggtaaatgttcaaaatatcagaaaaaacatgtcataaaaataaaaagttgaagttttagctatcaccggcatctagacataagacttaaaacaggcaagaggattaacaaaatcaatagtttactgccagtaacacttaccagataacagagtgcatttttttcccgcaaccccaaagccctgctggctgcctttctaacaaacacaatgttcaggtggtgtctgacttatttttttttcttcccttatccccattttcattcccctttcctaacataagatggcaaacattaaaattggctttcaatgaaactacctgtgccagtcatcaaattcttttctttctttcctttttttttttttttttatttcttcttaaagctcacccagggagaatactttgactttgaaagaaaccacaagaatgtaatcataaagtcacctccagacttggcctgtgttcatacttcctgtccttttacctccacctctaccctacccacccccaaacattcatacatttatccaccaacacatacctatggctgttaaatatttatgcagacgtgtgaataattcataaaggtacaaacacttttgagacttgaaatttattcagctgactgggcttttccattgtccaacaagtaaggacttggtgaatcctttcttttgctcctttaaccagagtggaaatgttttccttttcattttaatgatatattaaacgagttgccttccccaacctcctcctcctaagtaataatgttgcagagagagcatacacacttagaaagagagagagagaatgagagtaacaaatacgactatctacataattatgagatcaaagatatccccaccccacctttctgctctaacctacattttagtctaatgttggaggataaattaaaactcatctttatccccaaagtagctatttttggaccaaaccaatgtgggtccatcttgaccagcctcctgtgacctcaaccttgcaaattgtccaggacccataattaatactagactattttcccactgccacttccagcatcctgaatcacctcacctcacatttagagcatatttgtttcttgaacagaaattgatttccattcggctttagtgaaacagaataaggtaaacaaatctgctacaaagcaggaagcatattaaatatattttacatttgaacaaaatatgttgaacttctgctatttgtgattctccatgctagttctctccaccattaaaataaatacaagtaatatctgtactcatattaaatataatgtaaaatacataacatttaacaatgggagatgtgggagtgcagagctacataaaaaacctctccttgactctttgaaaatgtgtcttttatatatatggtcaattgttgacgcaagaggtagaattaaacgtttagataattttaccattagattttattagacatgtttgataggataaatctgggcacttgggtatacatttcttgaaaaacataaaatcttctaaatgtcatggttactaaatgtagcgagatcactaatgtgagattagctttggaaactagaaaatgtttacctgagcatgtgagaaataaatatgaagggggaatcaaagtgtaatccatagatctgagtttatatctgatatttttatgcctttctttaagaattgtgtgtatatgtacatatgtatatttaatttatttatatataggtgaaatgggttgttagccagatgttagagtaaaaggttggcagtttaagggcgagggtgaaaatattttgctacttaacttatccactagtaaaatgtggttgcacaatttgacattaaataagtaataaataagcaaaataagtcaagcctgcatattctactttatttgctcattcttctaacttttcaaggcttccaggccctgatacaaccacatatctagctgcctctaggtccagtccatcctcatccctgtacaccctcctaatccttaataccaatgtccaccttttccctccagtctcctaataaagtctctaatcaacctgatcatcgtagatatatagaatgcttctttgtctaaataataccatgttggacatgaaaccactcagccatggtaaaaatagagttggagcaaagcaatcaaaggggggctcttttgaacctgcttgcctcctttactgccacatgatctttcagagagcaagactatcagtccagaatgagaatagcaatcaagagaacagctgcctcaattttgctaatgagccagcttggctgaacctggttttggagacatagtgactctgccctcctcgactcaaataagcaagaagccagaatgtcagtggagccataggcattgaattggctgtaagaggtaattcaaaagagcatccttgcttgcttactgttttcacaatggttctatatagatttgtgctattaaaacgccagttttgaatgagaaccttgggtggagctgatattcatgaaaatcatgccagtgtgggaaacactccttttatgaattaagcaaagcttgtagcttttttccatggctttaaacactcaatactagtcaaaacctgtgaatatgtatacattcttttatatggataattagcttctttattggtggcgcctcttggattaggtggattcttccatgcaaataagcagtagagggaagcagtgcaacaaagaacacctttcatgtggcttcagtacttatttagcaaaacttctacatttatagagaagcaaatgctaaattcctgaacttctataaccttctttcaaattgtttcatattaactaattcaggttaaagtccttgcctaattttggtttatgcacacaaaaaacaaatagaccactatacatagtccattgagaatagttcaccaaaattgtttatgtccaattttgaatttctgaccacgatacacacaggtaaagatatcatttagagatcataagtattgtttgaatattagccacagaagttaagataaatataggatactttgtgcattagaaggatctcaaattaagttgcaaataaagtttcccagtgatagtaccaaattcataacacctcccttgggccaagagagttggttttttggtttggtttggtttggtttgcgagttttggtttacttgtttgtttaagcactttctttttatggtggaagcatccatttttgtgtgagcctgaagttttggggtcctttggtggttttttaaaagcgatattgtggtctcacattttaatgtttcctggaagaactagctagctatttattttaactacttcacaggaacccacatgacaatttttgaaggacattttcttattactcattgtttattattttggtcatcatttttcccaacaggatatagtttttaaggtaagattccatgagttttccttttatttcagaatttataacttagaaattttactgttactttatgccccttttcccaccgacccacatggtaccccctaccacctacccacccaaagatattttcatggtttgggtcatttagagacaaatgcagcctcgagaaccacaacatttttaggtgttaggagacattttaatacaaatcttcctattcaccaaaacactaaatcctattgggatgcctagaggcgtgtgataagagaaaagtaaataatacagaggaaaagaaccattatattctctagatttaactttggcatatatctgacatcagaaatagaaactcacctcttgtgaaatcattttgtttacttgatcaggaaaatctgcaggtctattcattttcagacatatatttataaaactaaagctcaattctagagatcaagtcttattgtaaaacactgatgaatgctgtgagtttcattttttaaacagatttcactacttgcctctcctatgtgaatttaatatttttattccttctctaattgatcaaataagaagtttattattacttccataattttaactttttcattaaaaaccaccctggtgcattttatatgtctgttttcatgaaatatagagtaagaaaaaaatcactgtgatatgaactccacaaaacataaaggaagatggctttaatgataatagttacctttggaaaatatttttacatactttttttccattctatccttaccacagggtaacaaagcacgtaataaagcagttgtagaatcacaaagctaataggagcccttgaggtcagtagctgcagctttccatcgtaagatgcgaaaagtaagatccaaggatgttaagttaaatttcccaaggtctgtagttttccagtttctcccattaccttttctgctccatgctacctttgctattcccatctttcagataatataattatagtccctcacccagagtcatacaaaccttcagtgaactgaaacaggtctttaccttctgacatcatttttttccactctccactgcgtagcctgctgttcatctttactgtctaaaggaccattcctgtactttttctagctttcaggagaaaaagattcctgttcatctcacaaggtgctaaagactcttgcaaatatatagataacatcctcaggatcattaacagactcaggaaatgaaataagcatctgactgcattatttttaaactgtttctacaagttacatagtatgtgcttagtaaatattgatggaattgaatgggagagtaaagaatagaggtaacagatctattgtcttttttaaataaggactgaaggtcattgctatgttttatagaaggaccatatagtcccagcaaatagaggatatgcttaacagctaggaaaacctgagaaccaaatccagctttaccacttaacaacctttgtggccttgggaaagttactaactttcctgaactgtaattttcttttctgtaaataccgtctactttacagagattttatgcggattaaattagacaatgtacatatagagtcaggcacacaacgaacacccaaaaatttaccctcccttgcccttcatgtctgcctgggaggtgaccggtagcccgcttctctgctctgtttgagtcagagtattaaaatcaagctgggctgtgcctggatactttaccattattgtaacagccctggaagcacaaggtgtcacaattttatttcattgacatgtaccacacgtgcagtaggccgtgtaacagtgtagttttcctttttcccttttctttaacagtttgctgatactgaacatgacatagaaaaggaaacacaggtgaaggggtttttttttctagtgaaatttgattgttttgaaaaatgttctttacagtaacttgctgtggaacaatatttcatttactaactggccttgagaattttgtagagtaaatctttaaaatcatgaagcttctgtggctttcatatgtacaaatagtattataagattcattctcacaattattggtcaaatttgcccccatcatctccagccttttcaaaacttgcagtattctaaaatgagtggtaaagcacaagcaagctataacatgtttgtggatccagaaatttatgtctcataaattcaaaatctttagaatctttagaacctcatgcttttaacttctttatgaaaattttaatacttcaaaatatacatgagtttatgatatacatgagtttaccagttctaatactttatgatatacatgagtttaccttaaaatattttatgcatgagacagatttttttaatcaggtcttcagattaccctttgagcctgaataaaatagaataataaaatccctttatcaaaaaacacaactaatattcaaagagcactattgtaagtgacattcgcctgtgcccatatgttatgcttgtgctttgcttggcaattagtggttcacagatgtcaacctacatggtactttgataacaagttcaatcaatcctgatcaagactttcccaacctgtgaatttatcaatgttaaacagagcctttgaaaatataagccttcctcccttctcccaaacacacacgtactgtagcctagaattatttgcacagcaacttttataataaaaggctcagtcttggggtgaagggtgataaggaggttggagaaaggctagagagcaatagcatttcaatcaatactattaaatataagaaactgggttttggtaacatgaacaatagcagttatttccagatacttaaaatgtgaagtctccagaatatactacagttttggttacatttctcagagaagaaactactaaaacaaaaaaggaaataaaacactgaagatttacaggataattaaagaattaatgtatcaaataatatcagttccttagaaaatgactgtttaaagctggatggtcttttaattgatcaaaataaggatttgcaattgtgttacgtgtttagtataggtctgtatgagtctatctgtatgaagacctctataccctcagatatactatcagctgagttgatgaggatcctgacaattgactttttaaagcatatataaacctttaacaccctttgactttgagaaaaatttgttattcgtgttctttaacaaatagtgggctggctagctataaaatcaagaatttgcagtgggaataatcttctactgagagttagaatttaatatttacaagtagtcattgaaggtgcagccactccacattgccttttaaaaaatataaataaggaaaaatgatacaattatgctattttcaggtgtcattggacagttaggttttatcgagaaagtagtttgaatcatgtagtccaaacagggagagaaagaaagatgctacagaaatagccaataagcaaataattttggcttcaaatcacactgcaaacatagtacataatacatactttggcataaaagaattatagaatcataaaatttaaaaaactataaggctaatgtccagttgatcattttgttatctcaatgtcatataattcttttcaaatcacaccctctgtcagatattttttgaattaaaaataagacacatctcactatatccacatagtggcccatctaaaatattctgtgttgctttaatgtattaaaagtttgttcaggccgggcgcggtggctcacgcctgtaatcccagcactttgggaggccaagacgggcggatcacgaggtcaggagatcgagaccatcctggctaacacggtgaaaccccatctctactaaaaatacaaaaaaaagtagtcgggcctggtggcgggcacctgtagtcccagctactcgggaggctgaggtaggagaatggcgtgaacccgggaggcggagcttgcaatgagccgagatcgcgccactgcactccagcctgggcgacagagcgagactccgtctcaaaaaaaaaaaaaaaaaaaaaaaagtttcttcagttctaagcggtgatttttaaatgtcaaagaaatacagtccatagaaagagaactcacagttactacactacatttttgtgtgatatttaggttacagttttattgttttcacactgatttttctcactttcatttcagcagagatattttgtgcattttatattaacagttcacttggagaaatcactctaatatttggagccgattccctacagatacattctttaaacattctgtgcagataggatttgattgttcatattgcatgttatcttttcttgatcttattactctggcctgtacaggcattcagtggaacccatgaagagagtacagacagctgactggatgaagaagacattggggaaaaaaactcccattgtttagatttctgtcagaggatataagaatacttaatttcttttatctctagggctttcattatcatttaaatttcattttacattaattgatcagggattagtaaagccattatgcagaaattagaataagacaagccagatggaatgaataattcatgaagtccaattacgttttatttctggtgtactttcaaacttgcctctgacttctgtgctattttgatgtgacaatattcactggaaatcaagagtgccattttaatttattgtatccctctggagtggaagcatttgtatgcactaggggtatgttaacgcatttccacacacacaccccaacacccaaaagtcaattttgggggttttgaaaacactgggtgatctaggaatactgttcattttgtacagaggttcaggggcacttcaatgagccacaccagttcaactgattggggtgagctgaccctatgcagagagactaaaggcgtaggatcgcgaaatgattacctcctggaagagcagtaatcctctttaaaatatttgcacgcattcctctctgcaaaagaacccttaaaatgtgaatttggcctagagttggactggaggtagcagcagctgttgcagctacagacgaggaccacgaggtggcaggggttgccttcaatgaaagggttcggggcggtcgggaccgccggggcttcagaacatccccgcgggtctgagccgggccgaccacggttgggtttaggctccgagcatctcgcaaagcgttgccgggcgagaattccgaactaatggaaagtccggtccacctgtctggaatgtctcatacaactctgttgtctgaaaccgcctccccacccccggtcccagccaccagccccttgagaggccccctctccccccggtatttatttatgccactggacagttctagtcacattaaagctccggttcaccttctcgaggactttcatctcgggaagttttatgacactttgtgaatgtgcaaagtttttaattaggctctctagacagcccgaggcagcagcagcgccacaaagtcttcacggtctctctgctttacagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggtgagcggcggctcaggcgcccgggccggagggctgggaggggggcgcagtcggccactcgcagtctctccctctttctccaaaacggccttttttggacagaccttccaactgcagcagggctgccggcccccattcttgactaccctgaagggaattggcagatgcattggccaaaaatcacttaatctcccttcatccctaaacggtggctgctctcggacaattaacgacccttttttgcaaagagcaaaacgttatgcgttcacacctttccctatgggacaggacacacaggcatttgtcagagccgtgttgaaataactttataggcaaatacttggaaaagaaagcttttgtggacgtcgatttttagattgggcttttaaaaagggctatttgtcagtgtttgctacttgtaccgtttctattttgaatccacaaaagacgattctgttgactattttatgtttagatctctcatccatttgatttgtaccaaggtaaatattccttgtctaagatatcaaattcagaggcagacttttacaacagtctccaactttaaacatgaatatcaaactcagtatttttttaaaaatagattttaacatgtcacatttacagcaagtgaaaatacccatttattttaaaaatcagccagtaataaatactgtttttaaattatgctataaaaatttatgttttaaaaactatgccacatgcattgttcctttttgccagtctagcaaaattactgagttgctaattcagctacttggatttttttttaacataaatattattgtccttcaactttataaaataaaatggtctctgcatcacttcttggtttctgattcaagaaagctctctataaataagaatggacaggtaagaggaacaagtgctgcgaactatatgtcaagtggagaacaacaaaaaggtcttttgaagtgttttgagcaggaaacagctcagcctttttaattaggaagcccacagctggaggatctgaggaggagcacacttccctagtatttgtgtgtgtgtgtgtgtgtgtgtgtgtgtgtgtgtgtgggagggggcagggaaatattcttcaggtgttattattaagtctttgtatcttcaagggtatatacacctataattgctgccaagtagttatcttttaaaaatctttcaatttgagtctatttttgcttttagctacaagaattctgtgacaagaatgagttaggtaatgaagcatctttgaaaataatcaaaaggcatgagtatgtgaaatgtcccatcatttggatgttgaaatgtttataacattattgtttttaatagaaagatgttattaccctacattgtaagggtttcccagagtcttcatcactgtttattaaaatcatattgcttctatttgctaggagaaattcattcatttaaagcaaccaaaaaaactaacattttcctgattgacttaggagaccgctgtagtagaaatccagcttagttgagatgtttaagtgatacccaactacaatgcatatgaagggagtgagtgttctacaaactccttaacaattcctatgtaactgtttttcttttaaattttttttaggtaaaatgaaactaatgtctcaacattgataaatataattttttcccttctctttctctagatatcaagagacaaccacataagagtttcatagctaaacattttttaaaaatcattattggtcatgcaaactgtttagttttgtggtaaacataattctgctttaacaataatagtagagatacattgagtccagctcaaatccagtaatgaaccgaacactttttaaaaccttcaaatcatttttgtcttctggcaagttgaacaagatttttcttaaaaattagatttcttaaaaaaatctgaattatcagtagagcagtatgtttggttgttgtttttattattacatttttggaccaggttattccagctgttcctatgcaaggatagttcatatttcccacctcagtatttctgatttctactgcttaatgtaataatttatgatatataaatcttgcctttgcaattaaaatgattgagccaggaaaactgtggaaatatttgtgaaacaaagtacagtataagagacagagagaacatatgaattgttttttattattcatcaacttttgaaaggtcattactgatcggattaatgcaaatatattttgtcattttcttcatgcatttatgaattttctagcgcataatataggctgtgatcattattttctatcatttgtaatatatatgaaaagaaactatttttaaatgtttaaaatattgtttcactttgttatagtacttatattccaaataaaaattcttgaaaatgtattaggtattattttaaatgtgtcacaatgtcagtttattttcagtgatttttttgttatattcgtattaagattaaacattttattctatttttaagattgttcatagattacctaattctattcaatatcagattgttcatggaattaggtaatagaattaagcaagaatcctgtatgaaccttctaaattatggtattaaaaattaactttgaagagtctatagttgaatcacagatttgttttctgggcagcacagtcataataaagtgtattgacagcattatgatccatctaaattcacattgtttcagcctctgaaagatttggttaaaaattcagactctagcttgcacagcaggtacttttattatagaaattgtgtatttttaaaaaataaatgagccggggacttttggggtttttttttgtttttttgtttttttgctcacaattgacatacagtgatttaagcgggtgaaagaatttttattgatttcaagattaagtttaaacatagattcttatatatgatggagtttttattgctattttaaagataggtattgggtcaataatttcgtataaacagatggtttcaattccctgaataacaaaatgccggtggtgctaagccacagtacatgttgtgtttccattctaatgcgacatgtttattagacacaggtcttaaacagtggcatgagatgatcctagtggcccccttttcactgtattttttctttatgttttaatatttaccttttcctttcttaatggcatgttgtcatttcctattcaacattcttgtaaaaggctcaagagatctgagctttatgtcaattataaacttctaaccttgaagacaagcttttacacaactgataatgggagagaggtagacacactaaaaagtctttccaaatactgaggctcttggaacaaatactacaggttccattgcagcacctccagttcactttaattattattattgttataattatcaatgcttttagatttgaagtgtttattaaaggagatataaggcattttctatgagtgggtggctgtattctatcacgatgtcaccctggagacagtgccaaagttgtggatcgcttattacacttcggtactgccagagggaggaagacagatttaacaaaagagagagaaagagagagagagagaatttgagttttttgaaaaattttttttatctttatgttttccttttttcttctgatcatctcctccctgatgaggtttgagagatcaatacatatgtttactttttccttgaagactcacattaatatgacttttttattccaccatacacctgctttctgcctttttagtatccttaatcttggtaaatcctgagatctgtctctctccatctgtccataaactatgaccctatggggaaggatcccatttagctcctgtattttttgttggatgtacacttgtcataatccaaagaaatattcatgccacttactgcccggtgactatgtaaaaagactctccctccttttcttttttgttaaagtgtctcttctctctaccccttaattcagtggagcatatgatttaagaacaatgagccctttttccccccggcacaagggatgtgtattacttaatgcacatgaaggcagttggtgactcatccagttaaacgtattattgtaaatttgtatatttaaattcatattcagagattcttttattctgttgtgaaccctttggcaggttccaacagcaagtgtggccattgagggggcatccgccctaaaccgtgttcgttgggcccaagctggcaaagaagttgctgttggggactcggaaggccgtatttgggtctatgacgttggagaggtacgtgtgtatttgtgttgttgttactgttttgacttgtgtatctactttagaaacctagtgaaattattagcaagaacttgtaggccacaaggaccctctctaacgtgcttgtaaatttccattgacttcaatgctagtttggcgagacttccttagggcctaatttgatcttctgtctccatgcacagaacacttaagttaacaatctaagctccttttagagtcctgtagaatgtcccatcatcctgtgatggagtgtggcacttcccactaatttcatgagaatgaaaagtttagaggctgggtgcggtgcctcacgcctgtaatcccaacattttgggaggccgtggcaggtggatcacgaggtcaggagttcgagaccaggctggccaacgtagtgaaatcccatctctactaaaaatacaaaaattagccgggcatggtggcaggcacctgtaatcccagctactcaggaggctgaggcaggagaaccacttgaatctgggaggcagaggttgcagtgagccgagattgcaccactgcactccaacctgggtggcagagagactccatctcaaaaaaaaaagaaaaagaaaagaaaagaaaagtttgccaaatatatcatgctaaaattgaaaagttgagttttggttggtatgttcaattaacatatatactatttttctttcattaaagtgtagccaattgagaatgtgattaattagaattttgtgccacttggtggtattcaaatttatcatatgagatatatacctttctagtatgtcttattacatgatacacaaagtattcctgaatgtcatggcatgtaaaaaaggaaaaaaaaaaacaactacaccttttatttcagacaaatctccttgaatttgcatacgatcttaatttaatgttacattatctatcaattgtacttaagattgtgtgtttatttttactgtatgagaaagtgttgaccaaaaccttcatttctggtgaggtaaggaactttttccttaaagaaaaagaaaatattgaactttcaagcaaaacaaaataagagcgttatgtaatgctattttggcataatatgaatctaacattgcattccagggggaaaatataccacatttgtatgcatagcatcctagacctagaaagtactctgtgagtgcctggtggatgggtttagctgatcacactgagaagggttctttatggtttcatcaatcagcattctataaatttggcaatcctaaatggtttgttctacaatggaacttttgatgacatattatatactgctatatggtatagttgattatgtagaaacaagctagacggtgttttttaaaattcagccaggaacaaaaaccgaatgactttagaaatgggagttttctattctggatgcataattctaagtaaaaaaaaaaatctcttgcttttactgcatgttatctatttcatttaacatccccttgactactcctgataccacaagctgagttccaacagtgacaaaaactctgttaatattggccccagtggtgaagatgcaaatggtctggtgactattgatatagtctggagtctttgggaaagagaataccctctgagtcggaaataccgccagtagtgttacagcagtatttttcttaaatgagtattctttatgtttaatgtatctttctcatggccctcatcaaagtaaaactaaacaacaataacaaaaacagatattctttattggtcacttcctaaaaaataaaaaagagcaaaggagaatgttaaaaaaaaaaaaaggcttttctctctctttcttttcttcctttcttcctttcttccttttcctttcctttgtttataacaagtgtaattgtgggagagaaatacacatgaagacatgctcagagatacaatggcagaaaatagataaaatttaaaaactctttgctctatctcctttgcatacacataacgtcccttaactcacttaagattgtatacaatattattttatccctctttgttgtattctaaaaggactgaaaaacagattagtttaacaatctgttttatattttaaaaggccttttgaaaagtctttattttgacttaaatgttatatatatacacactatatatatgcacacacatacattcatacacactgtctctatgcaataaggaaacacaatatgacatatatacagaattttctgcaataaaagtgattttacagcttttggacagaattacttgaatatgacatattttgtgagtaaatatgattttacaaaagttactttggctgatatgtggctgctaaaatttctttctaggatgctatcatcatttctaaattgtaaagtgttgttatactcatatttgtactatcgtactggcaggtcaggctggttttcatttttatgttattgcccttacttttctaagtgatattacagactatagaaatgtctgcaactataggccagtctcgcctattgtctggagtctagacaggctatagaaaaatctctgtgacatataataggccaaacaatttgtagggctgtttatccctacaaattcactaccaagaaaaagaaaggatatactattttattgagagtaggtaatattacaatctctagcccttctctgaatgaccgaaaatcaggataagcttatacacttgaagagttctttaggtattgtttgatcatatacaaagcaatctatagctcagaaaaactcagacttaacaaaataattgccttaactgtggttttataagtatttttataaattatatttatttgggtagaaggggaacttttgtgtttctctttgtcaccacaaagctttattctaaatcgctgaagacctcgtctgtagaggtacaatgtactaaaaggaaaaatgacttccctacatctgaggcttagctgcagcccacttctgaaagaggtagatcccttaagggcaaatgctgccattattgtgattactataggatcgttcaccagcccagaactgacagaacataactgtgcttaaagagaagtgcaccctctagacaagtaccttctcagccttccaaatcacctaaactgcggaaggccagatggaatgcttcatggcagggtggcacatttggaattagaggtctgatctaaggctggtgcatgactgactgcaggaagggtcgtcgagcaaagagctattcaagaagaaacaaataaggtattgaagactaaattgccagtaggctctgccaccactaccaatattcaaaattggttccctggtccctattaaaacgaaactcataaccacagtcatgctggcctttagatagaaaaccttgctttgtagaaccctctagaaagaagacaaaatgctcttagataagctttgtaatacaatctgtattaaaaagtagatggtaggttttttagagcacacaatgttggtccattttcctcagtacgttgaatacatgtctgtgggaagacatctcatattcattctcccagtgttgatttgaggagatttttttttaggctggggagaaaagaggggcctgtaggctagcttttgccaagaccttgttccacaagtgaggctgtcttgaagagtataggacctgtgcaattgcatagggcaccgtgcttaggggagccctgagcttgggtcattgtcttaaaattgttaaaaatttgtcaggaaggaacgccacattttcatttttcactgaaccctgcaaattagccggtcctgtcaactagagtgttactcttaatgccactcatgaggcaaatcagaaaaaaaaaaaaaaataggccttaacctagatcattaggaagaaagagaaatctgtagaaatgtagttaaatggatggacacactacaatcttctcattacctgtttctctttttttttcttttctttttttttttttttttgagacagagttttgctcttgcccaggctggagtgcaatggcacacttctgcctcccaggttcaagcaattctcctgcctcagcctcctaagtatctgggattacaggcgcatgccacaacacccaacaaatttttgtatttttagtagagacaggatttcgccatgttggccaggctggtctcgaactcctgacctcaggtgatccactcgcctcggcctcccaaagtactgagattacagatttgagccactgcaccctgcctcattacctgtttcttaaaactacttaaaaatgtttaatgagaagggccacgactctacattataaacgtcaaggtacatatagagctaaagccgtactggagatcccaattcacctcccacaaccctcttttgatcacatcataattttgcctgaaaatatattaataatataatttggggaaagatctctgagatgcctaccccagttggagtggagcgggacaggctttctctgtccacaccattgttgagaactccctgaagagagactgctgtgagcactgatggaaacatctccattcaagcccaggtagtcttgccttcctgtgagccctggcactccctgattagggcattgcagaaagggactctggtgttaccagtcactgacagtcatctgcctcatctcctgtcccagctgaggctgcagctgctgcagggagccccagctcagtacccccatgaccatgcctttctcttattatgtacaattatcctctatgacttttaagatgatagcagagagcacagtggcttgaatccagatttagtggtgcaatttattatgaacttctgaaggggtaaacacaggattgtgtatgagctcactgaaatcaccagactgagtttgtccatctcccttttttttttctttttgttacatttaaatgacaaagacatgagtaatatcccacagcctatgactcaagaggtaaaatataaaacagcaatgttttcaggtaggtcacatgatgctgtgtttatatagcacacatttttggttgtttgatttcagcattatatctggaaaatacactgtacacatttattttcacagataggggtctattttctttgcagagcaggtgctgaactcccattagcataaatggaagttatgcgaatctgaatctgacaaaagacagagaagacccctttttattatttggctataatttttactctatttgtgccttcaaaagttacttacatagacaggggttgcatgcaccatttaaattttctgagattcaaaattaaaaatgagcctagcttctgaataagttttgagaaatctccaaactatggcttgcaatttgtttgttttggattgtaggaaggattccattcaattaaatgaaacatgggtaggataataagtcaaaaattaactattaatatacctgaaaacagagctattgttggattttttttcaaatgatgtatgaacacacattttaaagaattaaaaataaaaacaactcattgccatgtctccattactgaagagcaagcttttctatgcatatagagctgacttcaacagcacataggccagtatgtatagaattattcacgtgtcctgatgattgatagccagcctatctacctgtctttcttgcagatgtgttttatagaaagcccaccgccattgttaaggcttcagtgctgtcacacagatgcagctgtcataaatatcccctaacaactatgtttgctgcttatctgaattagttagaatgctgtttgcagctccagttttgaaagaagcagtttatcttccacctcctattatttctttttccattaacctcttccagggaagattttgttttcagttgtgataaattcacacaggtttcaaatccctgattatattttacagtagtcaaatgataaaattacagaatcattttcagctcaaagtaggatttgaagaataaaatggaaacttaaaaaccatggtttgagagatggacaaatcttatcctagctttattgatttggtatcctattcactagttacctaagaaaatatgcataaatctttaaatttgaactctgaactttgatagcatttcaaatagcttgtttgatacgactatttgggggccaaaagaatagtattcatttcattacaaatttcaataagtataatacatttgacattggatatatgggctttgaaaaattcttggaaaagaaagatgtgggttaacatgagagatcaaatgtaacactgccaaaaaagtaaaacatgattttaaatgtccatttgaatatattttaaagccaaaacgaaaaatcaagagagaaaagtttatttgtaacgccaacaggaagaatggcctacacaatatattttagaatgatggtcaaggtgttacatgtaagaactgttaacaagtgcctcaaatagtttcatagccagcaagaataagaataaaaaaaagagattcaatgggccatttttttatgctttcaacagtagtttgatgtagtggcatgtgataaactggaagtactgggagctaaaaagggtttgagtaacacaaaataaatacaatacaatgatgatttttaaggggatcacacttaggcaataatagtgtactttgtggaactccttcatgttttccagtaatacagggcctacatcaattctccataagcagcctgtgccttgaatataaataattctcctccttgaggaagtgggcatacgaaacacaaaattgaaaagttaaacttggatttgggaggttaattcaaacaagagtcccttaataaaaagaactgcatttgccatcagccagttttaataaccgtgctttatgaaggcctttgtcccctgagcaaggcaaacctgattgcatggctcggtttttgcagcctccagaagagcacagttggtctcagcttagcaagatccaggtatgatcatctgaatcactggtgtttctcattaaatgagtgtggccattaatttcctagattcttgaaggcctttgcaagtactggcttattcttaggtggataaacaatattattttctttagctgataccaaatacttcctttgattttctctccttgaaaaagaaaagacttaggcgtaaattcttccagtgataccaaacatccagataaaatgtgaaaatccaaatacctggttctgtcgataacatctagatagcagttgatggcataagaacaaagcatcaagcttttcaactggatttttcagtttttacttgaatttttagtgttacagccccaatgctgtgctattaagtcaaggggcaccaagatatatttgcataggcagatttgagatgctaataaatataattatgtaaaataagccactttgaaataatatattaattcatttgtcataacaaattatatgtatttgaaattaaatattttgggtaaaatctatgattgtaattttggtattaactttatttcttctgggaaaagtgcttaatttaaaaaagaaaaggcgcaattaattccaattaatgttgtaagtattcatcttatagtacgtgtaatagctgtggctttcactttgataattatatatgtaaaagaccatgattaaactaattattatataaatagtgtgcttattcaggtagcattagtatatgaaaatggacttataggattaatatcttctcaagcaaatgttttttctgaattgaaaagaaatacttatgacttcatgtattatggagtagttgattcaatgaaaagaaagccctaatatctaatattataaacagcaaattaatgtgtgtatagtaatttcaaaattcaatgaagttcatatattctcattttggtgataaatgatctatgaatataaaccttctgaaagaagaaccagtttgtataactaatcatcttcatgattcttctgtggtttcaaactgtcatcttcaatggcagtttggattatgaagcagttgttaattatagtgttaatttttttatggctgacaaaattgtgtttagttctataatttcaaaattgctaaattttatcttgaaaaattgctgcttagagcagtagcctcaaatcacagctttaaaagctaaatgtgaagtctctccaatcatctgtgaatcgagattaacccgggcctgtacagaatggagttgtttcttacatgtgtatgtgtgctactgttggcatatctaaaatataatacataatcaaatatctgcttattcatgtttcctgtgtaaatatttatacaccacgtaggtcggacttgaaaagcgaggaagtgaatgaatcattatatttcactttcaaggaaagcttacatgaatttttgagaatgtcagctatcagaacatcttttaaattttaaagcatgagttacttatcatttaagaaatatccaaactgctaacattgtaaaagcaatttcatacttttaacctagtagataaatcagtggcccatttctaagctctttctcctaatagccaaccaatagtttctcaattcagattaaattttttatttgtattggtctcagcattaaggtcccttagatagaaagtgaacataaactaatattttcaaagtgaataaataaataagaaagtgaacaccttctagtatgatttaaaaaaaaaaaagttacccttgtgacttaaaaaaaaaaaattcagattgtcagccctcccttgattatcacattcctcagcttctttttttaacctttggaagaccacatccacagaattgtacaaaaagtggttatttgacaattgtctattaaaacacaataacccagtctagcaaagtgcctggcacaaaataggcacacaataaatatttgatgggtgaatgaatgattcacatgtgaaaatttgaggaaaaattaagggaaagcttaattgtttagagcattcaggatgtagcctccaagttggctacagattgatgcacaggaaaaaaattacttaactgtagttgcacagaaaaggatatttagaaaatatctttagaaaagagtacttacccttccccccaatctctttcccagtttccctcccctcctgtgcttttaaaagtgagcagttggccactagtgtaataaaagcataaccgttgattcaaacagttgtcaaaccactggaaaaatgcttccttttcattgtgctttttttggacactatagatatggtaaatcatgaactgcgttataaaaatacctcttttgtgcccaaacattcagtaggagggaatgacatttcttttattaccttggtaaatgtttttaaggtgtttagcaataagccttctttttgtcaaaactgcttagacgcagtggttgctaagaatttattagaaaacctatagttaataatatcaagaaaagaagggatatgtgtttagtagctaatatgacagttgagcttgtgtagcacatgcttttgctttttcctaccattttcttgatcttttgtgttatggaaaacaagttattcatgtttagaaagtttatttttcattattgcccatcaaccagcgtttttagcattttctccatcttttgggcagagaaatagattgttccaaatagtagggaaaaaaataaggcgaaaagatttctgaggaaagaaggatgataagattttaatacaaatgtgaagaagactattcatctttaggtctttgtgaattaactctttcttcggatatttgttgttgttgttgttgttgttttgttgttgtttttcttccacaggtaaaaccttcagaatgttgtcatgcttcctataatgctaaattttaacatgaaaaatattttacatgttactttcttaagatagtgtttaaggagaaggatatatatttccttctatattcgctggcttattgaaattgatagagacccatatttgttactatttacttgacttttatgtcctacttttatttctttccttaattaggtggtaatggattttttaaaaagtgttactgtaaaaaaaaaacgtggtaaaaatagtaaaaataaaccactcctttaaagatacaagggaagagacctttggcagagaggtctgaagcttcatgggtggatgagggttcccttagatgggatttccagatgaaaagaaattaaaaaacaatcaaataccatctgaccaccataggtaagaatgttgcttaattttacagaaatttgtacctattgactggtaatagcagactgtgctgtacagagactaatgtaactcctactttgtcgacttctttgaaactgctctaaataagttacataccatatatctttttgtggtagaacactgtagtatatttacaccctctgtatattgcattctaacttggaattctggtccgtggtttcatccattgttagctgcgatgctagactctcccgggagttaaatacagtggggctgtatttatgtgaagcgggtatgcttggtcgttcagtggctgtttcattgcatattacctcccactttgctcccatctgtgtgtgtggtaaagggaattgtcctaaaaaatacaggcttcctctgaacacagacatgtatttgtataccagtaagtcaacaatctcctgaatttgggtgccattaataattgtcctttttaaaaggcttttagagcttagagggggttagcagtcgttctgtggaaaccgatgtacatttccacattttctgtaaatgcattaaaaaataatgtgtattaaagtgaaaggaaatctgtaagatatctttttaacagaaaactttaatttttagattaatacagagatgaattgtcgtgtatctcttggaaatcaatggttaacatgatagtctcacacactttttaaaattacttcatctaattgaaaaattacaaagaggctgatgagccacacatccatggaatatttatcttgaaacctagagtcctactcacttaatgtcttggccatacttcatgtatctgagaaaccaactgaaatcagagcgcttttctaacgtcttaattatgcaagattttaaaaaaagaaaactaaagtaagcaatacctgagacagatatttttactatgaaaaatattgcactgggatggtgaaagttactgcagataatgcagctatttaaaattattatagctgcaattactaaaaaatgaggaaggtttgactgagaactattcaaaatagttattagccatgtgattataaaaaggaacacatgaatgatatttgcatgtttaaccctggttataaaaagtcatttgatttttttaacagcatgtacagcagttacaaatccttacaactttaggtaaaaatgaagaatcccactgtggaaagtgccacaaggaaagagctggattaggatgtattagtcacatgtgaaaaataaaaaatatgtatgtgcatgtctacatatgtgtgtggatgtgtatagttacaataaatacttatattttaaacttgatttttaaaccaacaatggaaagtagcaactctgaaagaatttttcttgtgatttgaaagaactctttccctgtcccccgttcatgaaagttagctattattaaaagcctgactacttaggaaattatttgtgtgggtatttcagacataaaatgtgataaaatataaggtatacttctaaaaaaaaaagtacagctctaaataggtgaaaagaagaaagagaatatgcaaggaagaaagaaaataaaaaaattggaagaaaggaataaacattaagaaggaaaaacaacatcatgtattcagggtttatagtgtacaagcactgtgttaagcttattacatttttttgttttatttaatatacagtcctagaagatggatcttacaatttgtttcacacaaatgaggaagtaaagatcagaagtgttaaaaccatgcattccctaaagacacacagcaagttaatggcaaatctgggaaagaaaccaggatctggctggtgaagcagaaaaaaagtcaaccctggctccattctcaaatgttattactccacagtctgtgcctccctttaggtatacaggacacccaggcaaggcgagcaagggttagactgataagtttttcaggggtgaggtgggaccgggttcagaggcagcctccagtccactcaggcagagaggaggggactgatccctgacatggtccgagaagtagtggggtagcctgggtggtggggctctgggaggctaaaatgatacattttcatgaatttttccacaacttttgcacttttgcttttgcttgtagactttttgtcttccaagaatcttagaagatttaaaacaatctttacaatctttgagcaggtgattcaaaacacattacctgcctgcccttctgtcatggaatgctggcctttctcaaaggggtgagtcttgattgccccacactaacaggtgaaagttatgtggtctttagcaaatcatttagctccctatactgtcctctcctacctgttaaagaaaggtctacgccctgcttcttaacatcctcacataacaatcagaattaattcccaaggaaatttttttaaaaaacagaaaaatactgtaaaattggtatgcatgccacaaaacgtatcattttggggagctgttcaatttgactgacaatttaaagaaaaagaatgcatgacaatccatgatgaactcatagtactttctttactttgattacctttctcatgctctccacatctctgttgatgaatgggtcagatatcatcatccttattttacaattgaggcagtgagagggtaagtgcctgaccgttgccagcaaccaagatgagaacaggacttgagtctcctgtccaaatctgaggttcattttacctctttcttatgtccaaattgctacctcagtaactacctttgcccttagtttcattggctgtaaaaatgggattgtatcatatctataaaaggtgatctcttttagagttaagattttattatctcaggaatctgagcctcaagtgcttttggcatgaaaatgctttatatgtttagcaaaaaattagaaaacagtcattgaatcaggagatggactggctgttggtgaactcagtcgatgaagcagttggaatatctgagtcatccctaacctatgatgcagacttcatcagagatgaatctggaggcagaaaatgtttccagatccacattgacttagaacaatgctgggaaatttttgaagtttttttttttaatggtgttcccttaattgaactatacatttttaattggtcaaaataacttatgatcttttttcctatcacaaacataaattgtttggaaattattctaagctattattctcagagaaaaaatccatagtgatactctagatttagcctttatgccttaatagaaacttgaagagatgctgaagcaatgttattaacatgccatttgcctccctgttacttgcttgacacacaacagatatcaggaaatgttacagttgtcactgaaggaaggtaaattttaggctattcactttttaatgtcagtgaagtttttttaatgccagtattcacacagtttgacctacaaaaaacataattaatttttgtctgtatttcatagtcttcatattccaaaatgattcactactgtatctttaattcaaacacagtgcctgacatataaatggcactcaatcaatgctgattgaatgagtattgaatacatttatatgcaaggtaggacatgagagcagtctgttctgtaagaaacatgaacaaagatttttcctatttaatgattaagatagtgttggattaaaaaatctcctagagaaaatcataaatgcatttatgttcttgagcctactttctagccatttctaatcagagactaccacgtgagaagagccaggaactgccaagggtaagaagggcagttctgtccaaacagatgccatttacagtcatggaaacagcaaagtgaaaagagtggccctggccctcttgtttgttaggacacctgtttggtcttacctacaagtaattctaatgccaaaaattattactttgggtgtagaaacagcctgtgaatacacattcacactttcaagctaagatgatacttaaagtacttcctgatggtgatatttaattctaaaaatggggcagtctgcagttcaccttctaaatctaacattacaatcaccttgggttatttttacagtcaacaagatgaaaaggatagtaggatgaggtagataaattgatttcaagtttctaggaggaattgtgttttcatcatgttctactctagaatttttgtgaagcaagaaaataaatatttctgtgaaaattaagataccatgaaaaggaaaagacttggcaaaacaaatatccctaaaaaacaaacttcaaacattttgccagtctaaatgaaacttcagcagatcaaaaagaggacaagatgtgttagattactgtgacacttttatgagggtgaatctatatttctaagggcatgtgttagtattacagcactattactcccacctccatgaagaaagtcacatgtagttcactcgctggcttatgttttgtgtgtttaacagaaacatttaaatttgataaaactcatttttatgaagttatgtaatttttgagatgtgtaattttatatagtgtaaatgagactcacttctgttctaaactgtgtgtagacatttattcaaaccttaatgttccataatctttactagggccgtttctgaacagtcttgccatgactactacatgaaactatgtaaatacatttacctattttattgttaatagtctatagtttctacacatggctatcaataacatattgcataggtcatcatgtattaacttaaatttgtacgattttaactaataatatagctttatgtttgggaaccaaactcagctctttatgagcaaggtactgtgtattattgagacctatttttttctccaatatttaaagttatatgaagttatggggcattttagctttagcttgattcttactttatatgggaaaaagttataaatgtgttaccatgattaggcttttgtctcttcttgggcttttgtttcatggttatttttggaaaggcttgctcagcggttggaagaaggaaaagaaatagtggtcctattcttttacataaatgtgataccaacccttagttggttatggttttcgtgagcttgtttgtattgtacattttgggggcctcattttccaggtggagtattttctaaaattgaagaaaaaaaatgaagaatcgtggaatataggaaaagagtccaaagtagggaaaacagactgagcaaaagggtatcagaatcattcaagactattgtgaacttgtgttattgcctacaaagaaatttggattcatttcaataattatagtagcatttaaccattcagaaactcattcatgtgactaagtaagaattcttattggtactgcacttcgcaaaataagtcagagaacttactttccttgcctctatatcatttccagaattatattcttgaaacatttagccttaataccagaacactaatttaaggatatactttgcacaatgaagttgccactttccaataagttttcttggacagatagtatttgagaatattatccttgtaataaaaattttaagttctaatcatttggctctgtgtggtgggaaattttccagctgtagaagcaatctcaaagcttaggtttatttgcttcctcttttttcattaaaaaatatattaattgagatggctgtatgttcttaatgtttatggaatatgtggatagtgtagtgtagcactagtacctataggtaaattacactatattatagcgtaaaactccaagaaaatgcgtgtaaaatctaaatgaattttattctgtgtgaaaagcattcagacttctactaaatcctgtttctcatcctcaaatttttttttctatcccagatacttgcattatatttttaagcaatttatttttggatgctatgtggagaaatcattatcctttaaaacgactaacaaagattcatacattcagtttgcattggaggaggcgttaatttcctcctcactgaattgtacacagaagatgttttggaaattttataaatccccctttttgatgaatcagtatagcatactggctaaggatgctcatactggaaccagattccattgacacttatatttgcttgctatgcaaccttggtaagattatttaatctttctgtgcctctaatataggaatgtgaggcacaataggattattatgacgaatgagttaatgcatgtaatgtacttagaacagaactcttggtaaataatagctactattactactattcatagttatcatcatataaatcttactggaaaggcccaagtactatttcataggaggaatatttctttgtatatataagctattcttttgcccttcatactgccccatcagcaacactttagaaaaaggattaataccattgactaggaataaaatatacagttatttgaaaatcttggtcattatatgcagtttttatttgcgtgttcactgtaagtctggtcttcttatgaaaaaaatttcattactaaaagcactttgatgtggctactgtaattgtatagtttgcataggtttttaaagttttataaattatgtgagtgcttttgcttccaagagtgacatggttctcttgttagtttaagagcaacacctcaggccctgcttgatccaaagaagaatgtttgatttcctttacattccaagggaaacatctgctttggagggtgtgggggcaaagggacagtcattcaggcttcaaggctttcagacatgaaagatatcttgttcatcatttctccattgatttgctttgcagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgacattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaaccaggtctgcaccagtgtgagtaaatcctttgcttggggaaagcttgactggaattctgctgggacaagagatgggagagatacattagagccatgttaaagactgatcatgaatttatttgagcagccaacctggctggacttaaaccaagactcctagttttatttttatgagggaatgtgtgtggtttttttggaaagctcctccttctcacctttaccaaagccacccttgcccaaagacagttgttggagtaagaaaggtaggttaagacgaacaaataccaaatgtcctacacatttcttcttaaaaacaatttacaccagaaatgatgtttattactattggactaggaaatatgtctataaacaacttcaataaactttttttcaaaaggtcattttatgcccagggaaaatgaaaacaaatagcggttgagtcatgaaaaacattcgaagacaggctttcggctttttaggaagggaattcccattgggactttgttggtagggattccttcaactgtacggtttcttttatttttaaaatagtatcatactttttctccaagtagcctacaatatttagatattgaaatcctttgtaaacaataaaaattttatagataacaaatgagtatctggaataggtttaaaagcatttgaatgaaaagtactgggaaaaaaagtttcacagacatacagtaaagtacctaagaataaaaatgcaaaacgcgtgcattattatgatagaccaaattgaatgattcggtgagtgatgatgtgaaaagtacaaaggcctgagtcacttacagtaggcacataaaatgttacaagaacatgtgttcttatatatcccactgtggtagctggtctccaaggcagttcccaattcttgtgcaggccatcccctgttgaatccaggctgacgttatgtgactgacacaatactgggaagtgatgctacatggtttccattatgtcttagttaattcagactgctacgtggtttccaggatgtcttagttaattcagactgctataacagaatactgtggtattcagactgagtggcttaagcaacagaactgtatttctcacagttctgaaagctgggaaatccaaggtcaagatgctggcagatctgatatctggtgagggccatctgcttaggttgcagatggctatcttctcattgaatcctcacatggtgaggagagagagagatgatctctttcatgtcattacttataagggcactaatcacatttatatgggctccaccctcatgacccagttatctcccaaaggcccacctccaaaaatcatcacattgaagatttaggcttcaacatatgaatttgggaatgaacataaacattcagtccacagcccagggcaaggttataagaagacatatatcctccacctaggtttcttggcacaatcaatcttggtccctgagctactatgtaagaagcacaactaccctgagacttccaggccacacagaagctgaccatggagtggtcatgtagacataagagaaatacacagccagtccacagccatttaagtcaccccagctgatgtcccagatgaaatgtggtagccagaaagatgtgcctttcagatttcctattgcagagaacatggttgaatgacagttatgatgccttgctttgaaacccattaccaagtttgaccaaggtcatgcttcctgcatgctcttgccagccaagactaagtatggcaaagatcctaaggctggcctgtatctaggagacataagacttctttgaagtaactttggctccaggactttatgtcagcattgctaaaactttctcagaactgtacttcagtccaagactagctgactttcttctcttcctcccttcctccctccctccctctctcccttccttccttcctttccttccttccttccttccttctttccttccttctttccttcttctcctcccttt

SEQ ID NO: 16604 - DNA, 6458 bp, Human
  misc_feature (1)...(6458): n = A,T,C or G
tctctctctctctcttgaaaaagagggtacaggggtggaagagaggctgggagctatactgcccatgatgctgagtccaccacccccaaagggctttgtttctatttcaaaaaaggagagaaggaaggaggagccctaaacctgcccaccttaccctccagcacacagagtctcaggaattgatgctcttcataaagaagaacatgctattccatgtatttatttaatccttcccccccatgtatttatttaatttggttccagaaaggagttaagtgagctataatacaaaataaaataaacattttaaaaagaatgagagaatgagacagagggaaaaccacagcagaagagagatgagactaggagagtaggcaagcttctttgctggagttggctctgatgcttctgcagccaagattcacagcctccttaaggctaggattttttttttttttctcaaaagaagcccaattatttcaagtactgattccagggagatatttcccacggattccctgtgtgttgctgggatcaacatccttagagcgaaagccatttgtatgaaggcagaaaaaatgttctgcagaagcatctcataccctgtgggtgagggaggagtgagcaggaattggccctacttttctggaagacaatttgccagttgtctatcaaaattttacatatactttggcacacaattacactcgttggaatttatctcacagacacattcacatttatatagtcaaggatgttgactccaacaacattggtataagtaaaaagttggaaactgcctacatgctcatggataggggacaaatcgactaactcaaggtcctcccttacaatggagtactatacagccttgaaaaagaatgacaagatctttatgtcaggacatggcacaatctctaagttatttcaagtgaaaaaataataataataataatattgcagaacaatgtgtatggttggatatacataaaattcttctgaaagaatacccaagaaacttaaatgtggctacctcaggagctaggaatgaaggtaggtggagaggagggacttttacttttcaatttagaatataccctgttgtgctagttgactttcctcctactgttaacaagtattacagtcctttttaatttaaattatttttcctagcacaaatttaaaaaaaaaaaacttaaaatggaaaaacacacaggcgtgagcaaaagaaatgaatggcaataatctctatggtttactgagtgcgcctggacatttatgtgctctcagtttctctccacaggaaatgcacaggtgagaaactgacgttaagggggactgagtgtcaagctagttagtggcagagggcagattcaaacccaacacggtcctcccctgctgcccctcggcctctgcctccaggtgggaagcgcatctaccggacggtcggcccggtgaggcgcagcgccccagactggcgcatccgcggccccagcgctccacgcctggggagcgcgcgcgcacgcagcggcgcgagcctggcggcggcggcgacaacaacaacgtcacagctcgagctttccttttcgggagtccccggcacacatcctgtgtccatgtttgggcatttacgtcacggcggcagggccggggcctcccaaaatggcagtggcccggggagtcggaagcccggagccagcgccgccgcagctatataagtgggggggctgtgggctgggggagcccggcagcgctttggagaggcgaggagccgccgcccgaggccggtgcgggcgagcgagggcgccgcggctccccgactcctttccagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctccccgccacccgcgcgcccccaagcccagcgggcgaggccccgggcgccccacagccggcgccgcgccatgctccaccttagcgagttttccgaacccgacgcgctcctcgtcaagtccactgaaggctgttgcgccgaacccagcgctgaattgccccggctgcctgccagggacgctcccgcggccaccggctaccctggaggtaaggagggcgagcaggggtgctcagacgacgacggcgcagcgcgggggcgcaccatacctgagaaccaggagggactgggacattggagctatgagaataggggcgatgggaagcttaggagtcctggggtgcgcacccccattcccacccacactgggccgccagcgcctccgcaggaacctgtgcggttatcggagcgcccttttgcctgtgcacgtgtgttttgcgtgtgcatgtttctatgtgctccttgggacgtatgcgggcccctgctgaatcagaatgtgcaaaaggcactttgtgtatatccgtgggcaccaagagttttgtaggtaggggctgtggactcaggtgcaccctttgatgtgcccagagctgattcctgctccctcctcagcaggcgacttcttgagctgggctttgaacagctgcggcgcaagtggggacttagccgactcctgcttcctggaggggcctgcgcccacaccccctcccggcctcagctacagcggtagcttcttcattcaggcagtgcccgaacacccgcacgacccggaggcactcttcaacctcatgtcgggcatcttaggcctggcacccttccccggtccagaggcagcagcgtccagatccccgctggatgccccttttcctgcggggtccgatgccttgctgccgggtccgccggacctttactccccggatctgggcgctgcccctttcccagaggcgttctgggaggcctcgccttgcgcgggtgccccctcgcagtgcctgtatgagcctcagctctccccgcccgacgtcaagcccggcctccgggcgcctcccgcctcgccagcgctggacgctgtctctgccttcaagggtccctacgcgccctgggagctgctttctgtgggggccccagggaactgtgggtcacagggagactaccaggccgccccggaggctcgttttcccgtaatagggaccaagattgaggacttgctgtccatcagctgccctgcggaactgccggccgtcccagccaacagactctatcccagcggggcctatgacgctttcccgctggccccgggtgacttaggggagggggctgagggcctccctgggctcctgacccctcctagtggggagggagggagtagcggcgacggcggagagtttctggccagtacgcagcctcagctttccccgctgggccttcgcagcgccgccgcggcggacttccctaaacctctggtggcggacatccctggaagcagtggcgtggctgcaccacccgtgccgccgccgccgcccacccctttcccccaggccaaggcgcgacgcaaggggcgccgcggcggcaaatgcagcacgcgctgcttctgcccgcggccgcacgccaaggccttcgcttgcccggtggagagttgtgtgcggagctttgcgcgctccgacgagctcaatcgccacctgcgcatccacacgggccacaaacccttccagtgccgcatctgcctccgcaacttcagccgcagcgaccacctcaccacgcacgtgcgcacccacaccggcgagaagccttttgcttgcgacgtgtgcggccgccgcttcgcgcgcagcgatgagaagaaacggcacagcaaggtgcacctcaagcagaaggcgcgcgccgaggagcggctcaagggcctcggcttttactcgctgggcctctccttcgcttctctctgagcaagagatgggtttatgggttggggcgccgccgttcggcgcgcacgagttccgggccgttcccctccccgctcttcttccaactcctcctcgcacgcccgagggccggcctccggtcccgcttccagtttccttgaagcgcccgccgcacacgccctattcagcaccagctccgcggacagttcccgcggtccaggcgctgtcacccttgtcagccgcgctttgggggaagtcttctgagaccacccagtgaataggcactaccctgggattcaagacagtcttttgtaactggcacacgccccacgccttcctctataacccccagagacaggctggggcagcgccaaggcggtctcgcgcgggactttgtacagcagtgtcttatccagcagccattggatgtaacgttttgctttgggttttttttccttttgttgttgttaatttttgtaaagcagacgctactctcaagcagttgacaaaactgtttatttttgcaattaaaattattgtgctaaaagcttactgaatctgccatgtaagctcctgacccttccccttagcttctcccccaggaccatatgtgccagaagataaaggagatccccacgctcatgggatacagaccctgaacatattacacacccactgtcaggcacacctgccaggaactgcggcacagagtaggcattcagtaaatgtgtgttgggttaatgaacgaatttaatcacagctcacctaagggctggaggtgtttctggaacttcaaagtggttaaaaggcgtaggtgttcaacattatgtatatattattctccttaatcctcgcattcccaaataaagcaggcatatacctcatttcaaagatgtggaagcaatgtagatagcttgctggaacaatgtagttaacccaggctaggaacagacaggtcaaacaaatctgtccaacttcaaagccaaccctcattttccaaccccagaatggagacacctaaacttaatagcactgattggaaaggcttcctaccagaaggtgagaaacaggtttggcagctagagggagctccaggcagtagcgacaacagcaaaaggctgcagtattttggtgctgtttgtgaaagcccagagtgttcagtgtcacagaggctccagacagtatctatgcatctgttcaagagtcacatgatgtcaggacccaaagggtctcagcatttagctagagcacacctgaatatagctgggagcaggcacttgccagagactgatggtcaccttagttgctcttcccacaaaaaggatcttctccaggtggcatcagcctacttaccattcagccatgcgcctgccacagccacttttctccagctgtccttccaagtgaactcttcatggctttgggatcagaggaaggctaggagggtgatgaggaaagcatgaccttgtaatggtgaaggtggcccctttttactctttgaactccccacccaaagcttttccactctttctggccaccttgggcagaccttggagcataaaaaggccgctgtgctctccatctctctgctccaatgacccctctctgataaggaagaaagaaggcctgtgtctgaggacttcattgttttctcttctgagctgagctgttcttgaattaagagaccttacagccctatgatgccagatcaaaccagcttctgatactcttgctgctttcttcactccttcactctaagatatgctcaccctccaccccacagtccagctgaccagagacaaaatgatcaactcagagaattccatccttttctctccctaggttttaagtgctttcatgtggccaagtatcttgtatctaagaaactaatttgtggtaaaggatttaatattacctcttctaggagaattaacattttagaacagtagcctgcagagggcaatgtttaacccaatgaagaggctcaaattgtggactgtcaggcactgtgataagtggtagattcatggagacacaagataatcatgaccctcattgtcttactatttaagtcaccacacctttcacttattaggcatgggccacctgacttcacttttcatgaagagtagggcaagaaaagcataatggcccatatttcaagcaactggtcccaaaacacacaagctgaacaaaggaggaaacgcagacagtgggtggctggcctctgatcacccctatcttgccctctccagcagcattccagcaagtgccatcagctctattattcttatcctcacacccacctaggcctaacatcactgatgagaaaattgaaccccaaagaagtgacttagtagtagtcctggtaccagagcccagtctggctctataactcctagctgagaagttcctgctatgtcccaagggacactgctcccatttattggagcttcccctagggattgtgagggatgagaatattagactagagatggaaagaattaaaaccaaacaatgtgaaaatccaaacccaggacccaacca

SEQ ID NO: 16605 - DNA, 27295 bp, Human
gctctgggtgagacatacataggttcagtttccatgtctgcagctgaatgcatgacagggaaaatcatttagcctccctgggcctcagtttcttcacgtgcaaaatgtaattaacacaacctacctcatggggttatattgaggattagagataatgtaggtaggatacctacacatagtaagctattatatattggcaacaataataaacttttaaaaaaagaaatatgttcatgctttactcatttgtattttggggactcaacctaccaagaactttatttctacttttaaaattggagatgtctgtcagtacattggcagtgtagcttggtttgccagatagctttcatttcaaaaattttaataggtttagggaccgatctttaacctttttagttctgtatacgtaacattctattaagcatttatattggtaccaccccatgcggaaacacacaatttgcagacgtcttaaagagtattcttggccgggtgcggtggctcacgcctgtaatcccagcactttgggaggctgaggtgggtggatcacctgaggtcaagagttcgagaccagcctggccaacatggtgaaaccccgtctctactaaaaatacaaaaattagccgggcgtggtggtgggcacctgtaatcccagctactcagaaggttgaggcaggagaatcgcttgaacccgggagaaggaggttgcagtgagccgagatcgcgccattgcactccagcctgggcgacaagagcaaaactccctttcaaaacaaacaaacaaaaacaataatcttgtgagtgttttcatctagaattaaaagggaggggaaaaccccaaaagagatttaagcaaagaatcttagggtttaatgccattctgtaggttcaggaagtctctgagctttaaaaagccgctcgcgtgaaagtaattaattattccatcacttcccgggggtggaggggggtgcggaaaaggcgcatgagctcaatgctgtatactgcagcccgattccagctctttcttgagggcagaaaaaacgccgagcggcgagcatttaacaacggccggcttttcttctcaagccccgcagcagccacgtggcgcctgccctagctcccggctcaccggccactagcctgcaccgctcttcgggaggattcgaggctgggccctcgccagcccgagttccgcgaagcccagaacctccagggccgcggccaccagaccgagggctccggccccgaacccaagcggggcagagcgcccaggcgacacgaggtgccagccttccattcgatggacgcctggcaggtccccggaagttttccccggggacaggtcttggcaacaggtccgaggcaaggccgggtggagcagagctccgcagcggctggtgaatcagcgccgcccagcgccggaccggccctcccagccaatgccagacccggtgaggagcagccaggctgctgaccatcagccacttagggctcgcctggcctggagaaaggtgacatcatcgtagctgggaggtttccgaaggcttcaccaatgggagaccggcgaggtgcttgccttctgcagctcttggccaatactaacaaagcaaaagggggcccgggttgttggtatagaaccaatgggaaacaaggaaggagcacgaggcggagttgcgaatcctgtcaccagttggaaagagggggtggagcccgggccttgtcaagtgtgaccaaccagcgagaggagcggactttgcggggtggagccctgaagccctctcccaatcgcacaagtgtaggggcggggcattctttggggggcccaatgaggaacgcggccgaagctggcctgtcaagagaaggggctgggggcggggagatggtgagtcggggataaacactccgcggcggtggcggctgctgctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagaggtgcacggggacggggaggggtccactcgaaacgaggccgggggtcctgtggggccggcctcaggtccgggcgcccagccgctccgggggtggttggaggcggggagaccgcgagcgctcccaacccctctggctctccccacgcgcggtccgaagggaagccgccgctgccccaaagcaatgaatggggtggagaaggggctgccgcccgccggggtcccgaacgccgccccttccccagcccttcacgagtgggtggccggggccccctccgatagcctccctggtttacctcacccgggctggtcccggccggcccccaggtgggcccggcgccccagtctcctgggcagaggagcagcgcctcccggtccccggctcacggtgcttgccccgcaccttcgcctgagctggttccacttaacccgcaccaacctgctggatgtagccagtgggaaacccaggctgcgtgagcctagccactactgtgtctttctcaacaatgagcagctggaatcctccttacacctgctccgaattgacgatattcacacaatttttttttaaatcattgttctcagaattccaccttactccatttaattatttccacaatattcttttaaagataaataaaggaaaaaggaaatactgtagagaggagagagcattaaatattctgggcccattcattaactggatcctcctgttttctagaagctgaacatggttatgcctccatgttaccatacaataacaaggacagagatgccttaaaacggaggaacaaatccaaaaagaataacagcagtagcaggtaatttggtaaatacttctttctgtcttttagattatattgtaggtgacacaaactgctgaatgtaagttttctgttgtgattataaccctataaaattacattgtggccgtcatgattcagtaatgtacacatggacttaagccattgcaggaagctgtttctgtttgggttgagggaactgaaaagaaaaatagaaatgttttacatttctttatgaactttattcaaaatttaatttcacttttcttcccttttggaacaaaaaaatctgtggaagcttcaagtgagattagcaatggtgacagtattttcccttcagaagttgcagattcagggcaagttttctataagtcaaaatgctggacattatccatttcttttacttttcatagtaatgattttataaacacattaaagtacctgacttggcataagtgataggatctcatacttgacatgtaaattaaatacagtggtttgtttgatactctaatttgtcatctctatttgtaatggcaaagaggaatgattgaggttaaaacctacctctttagtgatagaggaatatataataccaaaatattaatatgctacaacttttccatgttagccttatcgattatcttataccgtagttcttaaaagctgtgaatctcactggagatttggttcatggtcagttaaatcacatattaaagtcctatgcatagtttctggtacatgcaaatagtccatcaatgttgctgcccgtttccccccttctttgcccttaaaatatagttggctaggaaatttgttctattagatcccttcaactatacctttcctgccagtaaattaaaagcattgaccttttcgtcactagtttagaatccttatccctccctcaccctcatgaataactccttgcaagtatctatttggatatcctctgtggcttaatacagaccaggaatttcccacttaaacctaaaaatcacttgttcttgctgcgtcttctgtacttggtttacctctttagtatcgttagtggaaccacaggatgtgagcagcattacttgtgccatgcccttgaataaaaatggcacttgaaggatcaacctggtaattacctggtaggttttgcttgtcctcccaccttagcattacctgaaggtggtagccagtagttttgtgcatgggtatgaaggcactttaagaaagatgttaatactgacttgtaatatgcaatggtgtaaaaccaattaagctgtgttgcattttgttacaatatttttttaattttgtttagaagaattttgaggcctttcagttaatttttctggaaaagcatcatccatttttgcttttattattgtccactaatgatttgagaggaattgtccaagttacttattgaggcttaataccttaacactttgtttttttccttagtttcacaggaaggttgtaggggatgttcactagtggggataagaaaatgagatgttgaagtggcttggtcccaaaaggtgattaggaaagaaaaataatagtagttaagaatcttaagccaagaaatggattctttctagtatcttctctttaataatcagtactatgccaaaaaaaaaaaaataaaggctacaaatccttctgttaatgggttggtttgctttccatggttagagacgggattatcacagttgtccatacacctgactgatagtgagttagtgtaatatattcagtggtgtaaggatttctgagagaccatgattaaacctagaggtagcaccagccaaacgtgtgaggcaagagcaggcagttttctttcagtgtgatcatttccttcatgactcatttggaatagctccttttctgaggaacaagcaatcataatggagaaagcagcttgaccccatggtttgaatcggctttatatcctcagccatgtatggtcagaattttgaactgaggtaaaggatagggagagattactgctggtttacataacccttggataacagtttattcttgttcttacaggttgaaatgctgtgctttttgcttgtagagtctagggaagtacttttccttggacaataaaagatacgattttgccacataggaaacttcttgggaactgaaaatgcagatcttattcacgtttctctagttgcttattaaaacaacaaaaatgaaaatgaaattgtgaatatcaattgtttttgaaattatccatagaactgctggaatatgggaagatggaagtttctttcctactgatttttgaagtcaattactaattatttagaattgaaatctagaacttcttaaaagtgtgttttgttcaatgagtaaagcaagctttggcactcatgtgaaagaggaagttcaggacttgccacccagttgttttataagacagtggctagagtgacctgacatgaggagtgtttttgaacccaagaatttttcctggttatctcagatacaccgtaatttggcttagtttttttttattagagtgtatttttaaatggtgaaatttgacctttatcagtgattccagagttatccattgttttccataatcacatggaaaatagttttgacacaaggtatcagtgtgttcttacagtgctttaattaaaaacgtaaatgtttacccatcaatggaggtggctggcagtctcggaactgatcatttttgaaagggctgctttttattaataactcagtttcagtaaactagatgcacttcagtaatgctctagccattaagtacaagtccccctttaaaaagcaccatgtgtttaacactcgagtaatcaaataaaatctgtagttttaaaaattttgttcaaattttggaagaagttgtgcttcctatggagtttgtttaaaagtttattttggggattcagaattttgcataagtatataactctatttattagtttatatattttcaaagaatccagaaatattttggtaagaatttcctgtgtgctgttattttctactctcttctcaacctattcactttcctctcctccacctacaaggggtggtccttgtctacagttaaagagggtaatctcaaccaactgttggcatatactttcatccattttattttatttatttatttatttttagacagtctcgctctgttgcctaagctagaatgcagtggcaccatctcgacttactacaacctctacctcctgggttcaagtgattctcctgcctcagcctcccgagtagctgggattacaggcgtatgtgaccatgcctggctaatttttgtatttttagtaaagacggggtttcgccaggttagccaggctggtctcgaactcctgacctcaagtgatccacccacctcagcctcccaaagtgctgggatcccactatgcccatctactttcatccatttaaaaaaatctgtcaggctttgaacttactagtcccggttaaagttaaaatgccacgtgctttagagccaaaggtttgcagtatatgccagattcttgttaactatagtatcctgttggccattgaaggcaataaaccttcagaacaatgtgactggagaatgctgagggataaccaagtgaatcagtgtaaagcttttatttctttttaattgagatgggctcttgctgtgttgcccacactggtctccaactcctgagctcaagcaattctcctgcctcagcctcccaaagtgctgagattacaggtctgagccaccatgcctgaccattttaaagttttgttttgttttgttttgttttgttttgttttgttttgtttttgagatggagtctccctctgtcgctaggctggagtgcagtggcacgatctcagctcactgcaacctccaactccctcgttcaagggagtagctgggattacaggcacgcgccaccacgcccggctaatttttgtattttagtagagacagggtttcaccatgttggccaggatggtctcaatttcctgacctcatgatccgcctgcctcggcctcccaaagtgttgggcttacagatgtgaaccactgcgcctagcctgaaacttttaagttaaccaattttggattggtttgaatacatgaggtccatatattgtttacctagaaaacaaatattctaaacttaaaatactgtcattttctcatttattttttcttcgtgaataaaaattgattcctaagatccctgtgaaagagaagtttaatgctaggttggaaatttctcatttcaagacaacctcctcacttccgctgccatccccccacattcactctccttacccccattctctgatgagtgaacttgatgttggtgcccctgatgtaaatgagtggctgagcactcttgaggtggtattcctccatgattgctgtgagaatttatttcctaagcccagtaaggtgctgattatggccccacagaattcatgagctgaaccagggagtaaactcctgagctggttaaattctagagaattttcatagaaaggtcaagcaagattcagctcctttataatactggtagcttcttccaaatttataactggttaggaaggggttgtgtgaggaggacactaaaggggccacattgacttcttatgactttatggtaacttgtccataaagtcttaggccagaccttgtctttaaggtcagccataaatacactaatcatatggtttcatatccatcacacctttcatccaaggctctctaatcagttttacagctgttacctcattggtccatacttgttcagtaaataattcgtaattatttttattctcattttatagacaggttaaccagtaacaggatggtaaagaattttattcattccacagtatatcagtggcaaagctggacttcacatttcactaacttctgctttaagcaacctatcatctttatattgagctgaactttggaaaccccttcctaaaatcatttggttgctatttaacagtagcatcttgtacatgatagttacttcagggagtcagaagtttggggaagggggttattttactatttaaaacaatatagtcaagcaactttacacaaaattttggtgtatgctacccctagggaaaactgcaggggtggggtaggggtgctacctcccctgttctacccttagcctacagaaagctttgtcgtattatataacgcaaattcacattgcatcgtgcagctgtttttgtataaatagaccccttttatttcttgtcttaaaatggattatttttccactagagaaggcatgcttcttggtttgtcgctttaccttgaactctattttaggatttacatttatctaactcttcaaatggactaatttttttagtagagcccagtgaatttttctgcctttctacatctctcctatcaactttggagagaaagaagttaaaagaattgtgttggtgttgaagtagttctttaagacaaaaatatcttattcttctcttattgttccctctttcagatcaactcacaatgaaatggagaagaataggtgagttggggatttgggaggtggaatgcggggagctttgttgcattctctgttcatgcagttcaaacttggttgctctttttgactcttcccactagtagcacctgatttcagaattcacccagcgccctctaagcagcatcgctcataaattacttaggtagatgtagagcttgccagttaaaagaccacacccctaaccctcacccgcaccagcccactcctgaagaaggcctttgaatgactattccacagaccaaagcattttagtcagaggcaacatttccacaaatagtgtttttaaaaaaattacatgctactgaatataattggcagtgttatctaaaatacatatacacagatatatatacacataatatacatgtaagtatatattaacacatgtgtattaacgtgtatgtatgtgtatttgcagtttacttgtgaatgaagagtctcaaaattcaggcaaatgtatgcatggcagaaattggagatggtgcctaactagaggaggactgccaccctcactgggctccatcttgccgcagcctgagtggaatctctctcacctggattgcctcttgctgcttacttaaatctttattttccaaatcaagttgcccctccttcagtgaggcagccgagtggttttcaactctggttgcacattagaatcacttgcaaagctttctgtgtatttttaaacatatttttatattaaatacattatacacatacacttgtatatttttctggtgagggtagagaacaaaggtttatttctgctgattctataaaataactttttattatagaaaatttcaaatctggccaggtacagtggctcatacctgtaatcccagcactttgggaggccaaagtgggtggatcacctgaggtcaggagttcgagaccagcctggccaacatggcaaaaccctgtttcaactaataatacaaaaattagccaggtgtggtggcacgtgcctgtaatcccagctacttgggaggctgaggcaggagaatcgcttgaaccctagaggcggaggttgcggtgagccgagatcccgccactgcactccggcttgggcaacagagtgagactccgtctcaaaaaaaaaaaaaaaaagtagagtgactaatgtaatcaactcctatgtatccattacccagcttcagtaattatcaacattttgccagtcttctgtaagcaaaaccacctattcccatgaagtattttaaagcaaattttcttgtatctctagtaaacaccaaaaaaaaaaaaaaacacacaaaacacccaaaacaacaacaaaaaaaaaaccacttgcttttaccatactgaaaaaaattaatgataactttttgtggagcttttaaaagccaacaaacaaacaaacaaaataatgcccagaccttacccttagcaattctgatttaattggtttgggttgaggctctgcactcgtatgtttcaaaagctccccaggtgattctcatgtgcagccatggcggagaaccattgaactagcctcattctggtctctgagctcccatcaatttgaaatgcgggctacccatccaaattgagtgctttctcagtgccctgcatgaacaagaaaaggatgtgtaatgatggctctataaagacatgtggttatttcctgccaaccctctttgaaaaaggagcctgactctgaaagtcaggatctgaatgatatttatgtttaatcagtgaaagggcagactaaacccttcccaggcaggtagaatccgggaagagggcggttagctttactccactatggaatttcgtgtgtgtgtgtgtgtgtgtgtgtgatgctgagtgtgcctcactgcatatatgcttctgctcatcccatcgtcttcccttttaattgttctatgattgtgactgaccatgttttaagttggagcttcctttatgctttagctatttacatatcatgaactagaaactcaaaagtatctcttcttaaaggggaaaggtagtcagttgtggcttctctttctcatttttagattttctcttcagattctctcccttcttcctgcctttgcagtgatgtgggtaaaccgggactatttctgctgaaaagtcttctagttcttcgcccctctaatactttagtttggtatttatttttattattattaaaatttgatcgcttcacataaagacttactaaaactttgtgacttttgcctctgcaggaatgccacagaatgtcaattgtattatttattatagcacctcagggatgtttattttctgtctatggtggccccagaacttgtacatgttactgggtattaaatgcgttcatagtagggtattaaatcagcaaggtccccatcccagaaaaatgtgcagtttgtccaatgggaaagatgcagagacagtttcagttaatatactaagtgctaagattgggatgtgcacaagaagctagaggtaaaaattctggaaaactgaacgtgaagtcaccactaggcaagctgcctgtaattgagcttgcttgtatatgaccaatcaacctttgcttgttgaaggattagttatctagtttccttcttttcttttttggaatttggtcttttaaggtcttgataatctttctagtctagagcatgtgaacagaacagaaggaaaatcaggactcagtttacttaatttaagcaagcattggttgctgcagttcaggggaggttaaagttgctgggctccactctcttattagcatggatgcttaagaacttcagggtttggaggtcagctgaacagctgtttttgtactctccctggttttagtagctgagttctataaaagaataccactcgggtaaatgctaatatactttagccattttttacctgataacattgcataaaaagattatcatggctttcattgcttcttggccttttggctaaaatcaagtgtaaaaagattgccatggctctcaaaaaaaaaaggaagaagaagaaaagacaacttaggaaaagaacttctaacagtgggattttcccttttcttgatattgcagagttgattatacttgggttagttttcttgaatggaaaccttttctatggcactttagagattgtaaataattagtgttactctatgttatcaggactccactgtaaggatattatacccaacaccaacactttgaagtatcttcgcattggtgggacaataaaagaaaagacttctagaatggtggtggtggtagtattttctactcaacagaataggtgttgagcacctaagatgccgtgtagtaggtgctgggactacagaatccagtaaagactacgcactgctgtggaggagctcagattaatatcactctacagggggtttgtcagtcagcacatggcctgtgtttctctgcattttagctaattttctgggtctgatctcctaagaaaacacccttgggagggtggggtatgtgtgtgtgtgtgtgtgtggtttttcttttctttttttaaactaatcttgcagaaaattttgagaaatatagaaaataatactaaaaatttaaattgtccatagttctagcactcagagaaaaccaatggaacttgaaaatatatctttccaattgttttggaaaagaactgaaaatatagttttgtgtagaaagttagaaaattcagaaaagcacaaagaatataaaaatcacctgtaataggcctctcagaggtaacacctgctaacatttgttctatatccatctagacttttgtgtgtacttttttttaaccaacatgggatcatatagtaataatttgtagcatcttttccagttataaacattttccaatgtcattaaatctcctttttcaacattacttaatgcccagtattatattatatgaatatgttaaacctcatataatcagtcccctggtttagattcttcccagaacctaaacaatgctttcttaaaccacctgtagaaaaatctctgtccaacatcataattatttccttaggataaatgtatagctatggaattggtggtgaacacgtttttaggattgctggattgtccaccaggcaggttacaggcattattttccctgcacttcacaagttgatgttataacttaaaacctttatgagtttgataagtaaaaaataaaaaaacacacaggcaacttgttttaatttgcatttctcatactactagcatagttgaacaatttttatgtctttgactctgtgtgtctctttgtgtgaattgtctattaaatagcctttgcccaattttctactaaagaatttatctttttctttattttaaaaagtttccataatataaaggacatatatgaaagatattgacactttttctatcacataactgtccagtttatcatttagctatacagaatcagtcttccctcactgattcaagttgctacctttggtgtatacttatttttgtttatggctaagtctctttctagacttattcttccagtccattgatccatctcttcttcctgtgccaatatataccctttcattctcctttttttttttccatgcccttatctattttcaccagtttatttttcctgaaaaaaattttaatctgtgaattccccaacccctaaattctttggggagtttaaaaattgacattgcataattccaatataaattaacctttaaaagttcatgcttatatattagatcttttcatccaggatttggtatgtgccttaatttattcagatttctcttctgtctctaagcaaagttttgtagcaaagttttccacacaggtcttatacatgtcctgtaaaaggtattcctggatttatatatttttagattgctattggtttcccatcttagttaactaattgattattgttggaatataaacatatttgaatcttttgttgttacataccctttattgatgataattctgctatttctttctcttaactgagaattcctccaatttaaaacaaagcctttcaatgaatccctcagcaaatggagactgagcaaacacatataagctacagccaataggtcaggagccaggtggtagaatagactcttttttcaaaagatggctctggcgtctcctttaatagtagacatccatttttctggagtggtacatatgcagctcttgctagaattaggtgcctggtctagagctactacctctgccagagtcttctgaccctgtgacagaagatttctgtgtgtgctccatggggaagactccgcagcccaatctaagctgttatttccatttggtcaaacagtatttcagtggcatctggtctggcatgagaaatcaattcagtcaggtctcttctggaagaatattctaattgattacaggtccctatagttgttccttttgggttttgatttttcaaatgaccaagtcccttatatgggaagggctggggcctgacttttgcactgggcctgagttgtggtatgcattgcatcactcttattgtttctgaactttcttgaccacattcagatttcactctgggatgttgtaacaagtccatgtttgttgcaacatggggtaaggttattacgaaggagagacacagcgatcagtgtataaatccaatctatattgatggtctggagaagaactcacatttgtaccacaagaatcatcttccttgtactataacccttgagtagatgacacctgcctttggcaagacttggaggagagacacatgctggtcatttgaccaatttccagtctcctacctgggaccctggggctattcccttactttttgtcataggcattaatagtcaaatagtgggatagagccaacaggtatgattataatatatatgttgtatttgaaaattaggctctgaaaaggagatattaatgtggtgtacttatgtatttcatactttaataatgaagtgaccttatctctccaaaatgtagccactgttaactgctatttatgtattattcactgagtatattactatctttgtattttctacaaagatttatcagcacaattgtgagaaatcttcaaaaccttttagggttccaattaagttggtaataatgatgcacttggcaattgtttataaagggatcattttagaaaaaggaggaaagtattttttccctcttcaaagtgtgacttgtagtcttcacctggattttttttttttctgtttaacccagtagggctttgttctcaatgcagaatctcctgtgacccttgacattttaagggattaattttacaagtcccattaataaaacttgttccttcttactctatactaaataccttcttttccttattatacagctcatacatacccatatctaaaattatttttgttcaaactccaattatcttataggatttaagatgctatttaattgggtaagtctggcccacaccaagataggtgataaaatggtgaaacctcagagttaaacaggctaccctgttgagggtgatctatttggaaaggaaaagaaggttatgataggctgtgaaaacttggaaagaagttaagtcagatgggatgtttgagggtgagggaaaagaaagaatatgtttggtaagagcaaaggagagcccattctataactttaggtgagagctgatatctatcagggtttgaatatagctcctacaaatcattctgcaataattcatctacacgtttgagcactccaactaaattttaattacctcaaaggtagggacttgatcttactcaatattgtatcccaagacttgctgggggcactggctcacaactgtaatcccagcactttaggaggccgaggtgggaggatcagttgagcccaggaattcaagaccagcctgggcaacatagtgagacccatctgtaccaaaaaaaaaaaaaaaacctgtagtcccacctactcaggaggctgaggtgggaggattgattgagtctgcgaagttgatgctacagtaaactgtgatggcaccactacactccagcctggttgacaatgcagacaaaaaaagaaagaaaatatagcctgggacctaagaaagcagcagaacataacataatagttctctctctttttttgagatggagtcttgctctgtcacccaggctggagtacagtggcacaatcttggctcactgcaacctctgcctcccaggttcaagcgattcttgtgcctcaacctcctgagtagctgggattacagatgtgtgccaccgcacctggctaatttttgtattgttagtagagatgggtttcgccatgttgcctaggctggtctcaaactcctggcctcaagtgatccaccctcctcggcctccgaaagtgctgggattacaggcgtgagccactgcgcccggcccagcctgttacactttcaataaagagaactaatcacagataacagtgcttccttcaaacacacacacatacccacacacccttcatttggtaccacttctggtcttgattacatccaagtcaggaagaactttaaggatagtatatttaatgcaggaggcactatctacagatagcaccatctacctaataatcctactctgttgaatctattccccaatttgcagatctactagcctgagagagatccatagatagaatcaaggaagcatggtctggaggcagaaataagaagagctacagtcagaattgtctgagttagcccaggtgctttctatcagtgccaaagctctggtaggagctggtgcctcaaacagcttggcaccttcttcattaataacttcctttacttggatatttactttccgtaattcatggctggcaagaagttaaggaaaactaacagcagaaatacgtggtatctgaatatattttatatttaaatctttaatctgtttggaatttattttgatgttaacctcctcactctcttgccattttctgaataatccattctttccctaaggatttatggtgttatctcctttatgtgctaaattcctatctattcttaggtctgtttctggggatttctatcctattcatttgatttgtctgcctattcctgtattagtactacactgtttttaattattgaagctttataatacaatttaatatctggtacagcacattcctcctcattattcttcttattcaaaaattttggcagtgtcacacacatctattcttctagatgaagtgtagtcccagcgttaaaaagaacactgttgggagtttttttcttggaattgtgttaaatttgtaaacaaacttgaggaacattgacattttttgtttggaggattcatatccaggaatctgctatttttttcatttactcaattttcttgtgtctttcaacaaagttttatagttttcttcccatagatccttcccaacctgttttaaatttgctcctcaatatgttatactttcttcttgctattgcacatgagatatgtgaagatctctgtgcttggacttcccaagtcaatacatatttgcctctatttttattctcctttggccattgcagtcgagatcaaggagggaggcccagactcttcaggacacttgctcctgcagcaagcagaagtgaggcagctgcctccctcccaaccttggaatcctttctacccctgactctcaatgatgtgaacaggaaataaaggaatcttttattttgcattcattggccttataaaacccttgctaattttgtaaatgtaaagaaatagtacttttagcataagcactttctgtgtttccatagaaaatggattagattttccattaattattttaatgacaaaagatgtccattttcttcaaggaagtattcagaaaagtggattttgccagatagcctctgtctgcctagtgagacatttttgagttccctattgattgtaaaaggaatatcatagtgctcttattatctgtgtttgctcacagcaattctccttctacagaggaagctaggattgaaagaataactgctaccatatacagagtactccctgtcagaccctgacccaagggcttccataccttgtctcagtcaatacccatgacagccctcccagggaggcgcttgtcaccctcattctactgatgaggaaactgaggctacacagagttaagtaatttgcccagggtcacacagggagtaagtggcagagccaggatctcaaacatttactcttttttaaatattaacttcatttttaatttttgtgggtatgtagtaggtctgtatatttatggggtacatgaggtgtttgatacaggcatgcaatgcataataatcacatcaagtaaaatgtggtgttcatcccctcaagcatttatcctttgtgttgcaaaccatccagttctactcttccagttatttaaaaatatacaattattttgactatagttaccctgttgtgctatcaaatactaggtgttatccattcttttaagctattttttttttaacccattaaccatccccacctcctgcccacccccgctacctttcccagcctctggtaaccctcctactctctatgtctgtgagttcaattgttttgatttttacatccaaaaaataagtgagaatatgcaacgtttgtctttctgtgcctggcttatttcacttaacctaatgacctccagttccatccatgttgttgcaaatgacaggatcccattctttttatggctgaatagtactccattatgtatatgtaccacatttctccagacatttactcttaatcactgcattaatatttggttgcatagtgactgagtcagaattttttaaaaaaattaaaaatcaacaaaatttgggatacttaaaacttactgaatagaatctatagttgtatctaaatttgttattactagttatgggccatacttgattcagagcatgacttattatagttcaaagattggtttctttatgccactgtagaccaaaggtatatcagcttattcagaataattaaagttatgtttctgaagagtcagaaggtgaagtttgttagtccatggcctaggtacaaagcagtgtggatcagtgctaaaggaagaggcagccgggtgccaggaagatgggaggtagctcttggcaacagagggaagactgaagaagatgtgatgggaggagagtcaacttcctgggtcacactgaggtgtcgggtggcttcctgttgaggatatatggcaaaacccctgctagttccccaaatgggagtttgacctggtttaaaatgggacagcagggcacaggagtagtcagaactgagaaaagagagctgagacgggtgtttgttctgcttgttttggatctgggagctccgtgggtactcagggctggcagagggattctagatcccaggagtttgtgtgtctgtatgtgtgtctgtgtatgtgtgtgtgtgtcagggttggagagctttggtaggagctgtacataacagaggggtctgtttgcttttttatctggttcagggattggatttcactactgtatgatagaactgagtctacttaatatatttcattgctctcctgtggttggcccgggcaccagtgtggggatgtctgcaggcagtggcatgtgggcagggggcagccatcaggctgcagcagtgaggcgccggagaaggccaaggcagacactgccaaagacagagttggctttgggtctctgcaaaaatccagaaagaattctggtcctatttttgtagaactaggccagaaaacactgaatgaacaagtattagtctcagctggaattagtcaaatggcttatttctagtttcacgactaggagtgttctttggaaacccacatttgggtagtgaaaattgcactttctgggcaagactcctataaggctagaaatgacaatgcatcaaaagatgactttattatatttttatcagtggacaaacttcctaaaaaaattcacacactcatatctgcatataaaccaacatcataaaagtactaaaatgacactgttctgaatcatgcagtctttgcaaataacaagctggctgaaaaatatctaaatataattttaatttttgaactttttcttctaattggaaaattagctcatacctgtaatcccagcactttgggaggctgaggcaggcagattgcttgaggtcaggagttcgagaccagcctggccaacatggtgaaaccccatctctgctaaaaatacaaaaattagccggacgtggtggcgggcgcctgtaatcccagatactcaggaggctgaagaaggagaatctgttgagcctgggaggcagaggttgccatgagctgagatcacggcactgtactccagcctgggcgacaagagcaagaactctgtctcaaaaaaaaaaaaaaaaaaaaaaaacaaaaaaagaaaattagtctataagttttatggcaagaaatagacaaatttataaatgtataaattatactttctcatagtgtttctaataacatgatctattttcatggctctttttgaagaatattatccaagatgaacaagtatattttacatacaagttttcttcccttccctggtccccaccacatgcagtagtgggaggagcacacctgtaacatgagtctttgctctgactctgccacatggacaggtttttcagaagaagtgaaagacttacaaaatagtaaagcccttgtgctattacctcttcctagctcagaaatgaatgctgtactccccaagcttgccaagccttagagcacccttggagagtttaggacaacttcctcatgacctagaagaggcaggaggctcagaaggaaggaagtctaatgccttgcttactagccctgccttaggggaacatcctgaagtctccctggagagtgtgaattgacttcttacattaatatcatgcatattcacctgtcctatagctttctgaagccatttcctttctttggtctatattttcaacttttgctattacagtacaattcttaagaggaaaaagggcaaacctataaggcattgcattgtttcccaattcagctggaggggagcctcctagaccccagggaactctgctccaagtaggttgtgtgtgggcaatgaatgttatctaaaacctgaagactctgagcactgctgaaggtgcaaagatgcagtagagatggactctgtcctctagaagcttaaagtctagttgaatagatgacataatccattcagcaaacacttattaagcatgtgtgtgtttgaggcacggtgacagcacagcaatgattaagctgcaatcctgactttctaaggagactgcaatgaatggttaagtaagaaatatgaaacaagtcaggcagtacagtgaacttcccagtgaataatataaacagttaagtggtgcttagaaaatagaggaatcactgtgagctaggatggcttgggaaggctttaaggaggtggtaagcttaagcaaaacccccaaatctcagctgcttcttacattcatagaattttccaggttctagaataaagcacaaaccatttcaaggaaatgtaaatttctcagttggagcaactctcgtgctctctcttcagtcagttgccgtggctgctgcttcatccagcccttctccctctcccactccgtgccattgcatcagtctgacatactccaagaacaaaaagtataaaaaatgactcagtaaaaacccccatcacttccttccttatctctgtctgactgttccttgccttctccctgcccagccagtttcttatgtgtcattccagagtttgtctacatacaagaaaacatgaatatagattcttgttttcctccatctttaagatagcatggtatactcacagtttggaatcttgcttttctccacttaacaatatatctggaaaatctttcctaataggacataaagcacattctcattctttttgatagctacatagtactacacggtgtggatgtagcataatttatttaaccagttccctcctgggtggtcatttgggttgtttcaatctttgctattacaaataaagcttcaacaaataactccacagatatatatgctccttgacttatgatggggttatgtctcaagaagcccatcataaataaaaaacatcccaagtctaatatgcatttaatacttcaataaactcattataaatttaaaaaattgtaagttgaaccatcatgagtcagggaccattactgtatatagtatttacacatgtgaatgactatataatagcagatattattccctaccccagcacttgtattatcaatagacttagcttcgaaaaccttggattttgcttctcattggttttcaccagagttgtctggttcaaaatatgtttattcagcaaaaggtcattggtagcatttgccatcgcaaggcctgggcaacttcacactctttgagaactcattctgcctggggtgcttctggcccactgtgaaactctcaaatgctactgtggtcttgttttcatagacgggctcatcttcgcttgtgcctggagaagttgaaggggctggtgccacttggacccgaatcaagtcgacacactacgttgagtttattaacaaaagccaaattgcacataaaggtaagtgtattgttgggatgctgctttatctttacctgttcagtgagggtttgtctgttgttacatctccaggacagtcctctcccctgaactcctccagtctagctattggatgaatcacaggtacctcaaatgcaacatattcaaaacccaactgagtgtttctcactcccatgcaccagaggttaaatggtccatccaactctccatccagttgtacaagccagaaattcaggagtccgtgatagctcctgctccttaaccatatatctaggccatctccaaggcctaaatattttgcaaccggtctacttccatcttcatccccactgtctactgcaataaaatcctcagaggtctccctatatccctctgggtccctcccgtctgctttccatgcttcctgagaacagtccttccaaggtgcaaatcaacacgtgaccttgtttaaaattcttctgtggctcaggacaagctctgtcacctggtctgccccagattctgccttgcctggtcctcacttgcctctgcagcaccatcttgttccccaattcccctttctccagcccttcttccagtccctggcactgtcatattgtcttactttagggcctttgtcaatgctcttccctctgcttggtacactttcctctctcttcttcacctagaggacttctacttattcttcagatcacagtgcaagtctctctagctctgataatccttcgctgactttcccaactcagtgacctccttcctgtgacaggtggtcccatcactgggtatctcttagccctgtcataactgacatttgacagtggtttgtgtgaccattgtgttgtctcaatccttagactatacaccccacgagggaggggactgggtctttgtgctcacctcacagccccagcacctcctagggtatcgggcacagagttgacactctctttgctacctgaatagcaaagggtaaggggaattggattcaaagtcttgagagccacagccaaaatccctgtttagcatgtttgtataatcatattatagttggacaaatgttactttaattatggttagaagcctgcattcatgacaattctgggagaaaacctctatttaaagcaaaacagctacaattaaacaatcttcttaattatctgaagaatatgagaagctgggggcagatttataaaaatgagtattctatggaaatgtgttttctaaactcttctgttggacaaattagaatcaggacatcaaaagggactattatttcctgctaacaaacagaagttaattgagatttggcatgacacaaaaaagtgcttatgtaattgggacatgtacttgaataaacatagttttaaatggaagcgtgtttcttaagctcccatcaagtgcagttttctagtccggagatcaggtgttcaggggatcgctgcaaacaagggagatcaggttggggactgctgcctgcagtctttctgatactaaaactgagggctaccagggtgccagtatgtgagagctcacccccagaatccctgtgacaggacaagtacccccagcactggcgatgctgaagagtcagacgaagccaggagtcactggccagtcgacttcctgtctcagggagaagcttgatgagtggcaccgaaaggcgtctgaggaagtgtggcgcattccactgctagaagggaagatgcgggggccattgcccatttagagatctccctgtggggcccaacaactacccctttgacttgcagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacaggggtgagcctctctcactctcctccctgtctcccttgtgctccccaaccccagagcaggggttcagtactgcggacaggaggcagagtgtaagaagaactaagacactgggtatgatgtagagaagtcgaacagtgtgacctccagtgacaggttccttctccctgctaacacttaggtgacaaccccagaagagtttgattggtgtcagttttcagcctagtttgttttgttttgttttgagacggaatcttgctctgtcacccaggctggagtgcagtggtgtgatcttggctcactgcaacctccgcctcccgggttcaagcgattcccctgcctaagcctcccaagcagctgggattacaggcacacaccacaatgcctggcaaattttcctatttttgtagagatgaggtttcaccatattggccaggctggtctcgaactcctgacctcaagtaattcacccaccttggcctcccaaagtgctgggattacaggcgtgagccaccacacccagccaaatttttgtattagtagaaacagggtttcactgtgttggcccagctggtctcaaactcctaacctcaagtgatccacccgcctttgcctcccaaagtgctgggattacaagcatgagccaccacgcctgagctttctgcagagcgctttcatcaatgtccttctctcttgtcctccctgcagaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggaggg

SEQ ID NO: 16606 - DNA, 13203 bp, Human
ggagtggcaacaacttggattggctggaacctaggtgggtgggagataaagtacaggggtggattagggccctgcaggagagagggctagatatcacagaggaagtgcacgattcagggaccccatctggaaggttggagagccatctgggtgcaggagaggaggagctagagggagggaccctttgcaggattttcttgagatatggatggcttagatttatgcactgcctaagcctgttgcttatcacctctcagcctggagtctagcccactcttcgcctccgcctcataggaaagggccagtgcctgcagggagagctgtttcttgacctttgcctttatgtaattttgttattaaaatcaaagcaagcaaacaaacaaaaaaaaccctgcccctgtcccatagcccctgagccgttgaaagtcagtgttcttattcagagttctgtgatcccctctcagtgtgcctagtcttcaagggccttttaatctaaaagcgaaggttagaggctagctaattaatcaaaagataaactctttagaaaagtttagctatcactgccatgtctgggggaaaaacaaaactaaacaaaactttaaatctagcatatgatatggggctgctctgttaagaagtcctcaccagcaggccgggcactgtgattcacgcctataatcccagcactttgggaggccgaggtgggtggatcacctgaggtcaagagctcgagaccagcgtggccaacatggtgaaaccccgtctctactaaaaatacaaaaattagccaggcatggtggcatgtgcctgtaatcccagctactcgggaggctgaggcaggagaaccacttgaactcaggagacggaggttgcagtgagccgagatcccgccactgcactccaggctgggcacaagagtgagactccatctcaaaaaaaaaaaaaagaagtcccgcctggcaaaggaagtggcgatcttagatttctattgacgataagaatgttactctatacaaagggagtaacgaagtaacaaagggaccagtgtctaagctaagtatcttttattaagaagaatcacatgcttgggggattagtggctcagggtgaggggatgcctgtaaaagaaaatgaccatcccatccttatggccagggcacatcccgaagcacttttgagacccatctgggcatagcagggggccgtgattgaaagattaataccaaagaacctctgaatgactcgccctcccctgcccactggaatcagctgggagctttaaaaatcttgatgcccaggactgactctgaatggtagcaataccaggaattacatcacctggtattagcaccacactgtacaggctacacgcacattcagacacgaccttgcttgtgcctttactaagcctgggtggaggtgggccaggtattgatggataggaggacaccagagttcacaggagagtagtgatttctccagtcctacaatgaccaggtagtcatgctgagtaacctggtaaatacttgaagaactaactaaacttgaagaagataaaaaggcaaaccacaagccaatgtctccactggtttcaggtgttttctttctcatcaccagaaagtctgaaaaccacatttggtttaaaactaacctggattttttatgaactgccaacatgaggcttatgtcatgaacacatgtgctgcctttattcctccaggatttggcacagtcacaatagtcatggattgcttcagccgtagcttgcctccgcagatgataaggatgattagattccccttcccttctccacataagcagcggtgcctgcgacagggaaacaggcattttgctgacacctttccctccaattgcaaaagctggcagggcccctttgggctttacctgcaggctctgggtccctccaggaaagccctccctggagagctagggtaacaagaccttttgtcaggagagtgcactgacgttcctttcttccccagctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacagtgagtacttgctgcccctaaggccaggtcccctgcccacctcccctaccagggacatccgcagtatatccagataacagggccacctcagcacagcttatttctgggatgtctgagtgctgtcaggaaagctaaatgctactttgatgactgttggcatggcgtggcagccaagctgcatgaaagcctcatgcatcctgggcggatccccagctggggggttggtgcactgtggaggccagtgcagaaccaaaggcatgctcgttctttccacggttgttggagtcttcagaatagtgatgacatgggcaggtgctccagagaggactagagacagctcctagcctccttccatcagcaccagaagtacttcctctctgcagaagtcactttgcaaatacatgtcgagggccattgttgctgttacaggctgatgaccatcattctgcacagcccttcctctttgtccacttctctgcccctcctcatcctccaaaactcagttgctgtgttgtatcttccaggaagcctccctggggcctagaccaggagagaccttttcaggtgtgtcctggccccatttgcttgcccacatctcctgactggactgctgtgcagggtcagagaccctgggaatacagtgcaatattcctagcatttggaactatgccagatttattccctggaaatatctaaagtctgagtcttaggggatttattaggttggtgcaaaagtaattgcagttttcaccattactttttaaggccaaaaccacaattacttttgcaccaacctaatatacctaattggatatgcacaaagaagtcacaggacagttaaaggctgccattcaattcagtgtaggttaactcatggtggagacagtcagtggatgggcccctctggcaaggttgtggtcagtagctacatgtcgatgcaagaagccagacttacaccctccaaggttgcctaagatttggacagataaacaaactgtccctttggtttgtggctattgagacatctgaaacacatggccctggttctggtaacagtgaggcacccgttagagccccagcttgttgacagtagccacaacctgctcacatccttctcctggaccaaggcagcactgagtggtgaggtttgaggtctgagctgggctggcctttccctccccaccaagcagtatccattctgcttccaggggccttggaaaaacatgtttgctgggagaagacaagtagctctggttcagactgggccacagcccaggctctgtcactcagaagggccctcctcgaggagcaggagcaagctagtgggctgccagccttgcttctcatggccagtagctgtgtgtgctgccccatccttccattgtcctgtgtctatggccaggagggtcacagggacttaggaacaagactggtggcccacacaggcctccccagagggacctaagagctaattttggcagattgtctggaaacaggaatgatctaggtgcctagacagcatctctcatttccagggaggcggccagtcccaactcctgtgtcccttcccagccttggtctccctgccagagaccaagttcagaatccatgagccagagactaagctctcactcctgccaggctgctggcttcctgggcttagggccctcctgagttgcagggtccaagttgggaccagcttgtcccatgctggagggatctagaggccttgatcccattgcccggggatgctcctatctgggaagtgacaaggacaagtccacctggctggctgactgtgagaaagtagtcattgatggctctggaaccaaggcctttagagccccctggcatgggatgtactgtttccagcccagactctgcaactcagaagggcctcgtgcccaggcacactgctctgggctcccggttttcacctgtaacataagcagcttgggcaggaaggtctcagagcctcctccttagccctgctgtccaaagattcaggggctccagtaacctttgcagcttctcactgcaggacagtgccaagacaggggctgggatgggaatcgtgaaatgcccaccagataccaagagagaagcccagcaacaggcttatttcttcatctctgccacctggctcaccttaggaaatttctcctaactccaaccctagcccagggatacataaattatatacgaattagggttagaatgagtggaaacaaagttctccacgatagcccaagggaaatggctggtagcgtctgtggggaactcatctctcactcagtgctttcttttctgttcttttggggctttttttttttcatgcaaagtctgaaaactctccattcctgcccacagagggaggcaggagcctttataaccctgatgcctcaggactccgggtcacacaggtttacagagagggtagatgttccaaaactagagaattttagtcctgaaagcaggattcaaagccattgagatccataactcattcttccatttttttccatgggtcaattcagccatccaagttccttgttctgctactggcaataccagatgaataacctcttcctaaaccctcacagccctgccagctggaggtggccactttatcccagtcctttgtcccaattctgaggccattacacttgtggaattacccacctggttctttatcaagaaagccgagtggaggaccagttctctctgacagctggggaagctggagccaggtcagcttgcagaaacagagcaaatactttagggtagccaacagatgcttttgttgttggccagcatctgccccaaaaaaccactgccctacaatgccctcagccccctatggtgcctgtccctctagaagcccccatggggagctggtttggagctggtttagagctggagctgcccagcaggcccctagggcagatgctgtaccaccctggccctcctaccaggctcctgcccagactgggtcctctgtgtctttgcagctgctgccaggtccgaaaacactgtgagtggtgccgggccctcatctgccggcacgagaagcccagcgccctcctgaagggaagaaccgcttgctgccactcagaaacaggtaaggagactcttctctggtgggagacactattgggtggagaaaacgaccaccttctccaagtcagggcagaagttcctggagtatgaagcaggaagagaggagaaaaggaagagactgtttcattctaccaagtcaggtttagtttattcataggtgccttttacttagtagggaccccttacatcctggctggtggctgtgggacctttgacaagttactcacctctcacagcctcagagtttttttgttttgttgttttgttttgttttttgagacggagtcttactctatcacccaggctggagtgcaatggcgtgatctcggctcactgcaatctccacctcccagtttcaagtgattctcctgcctcagcctctcgagtagctgggattacaggctgcccaccaccacgcccagaaaatttttgtatttttagtagagacggggtttcgcagtattggccaggctggtctcaaactcctgacctcaggtgatctgcctgcctcggcctcccaaagtgctgggattacaggcatgagccactgtgcccggcttaccctcggttttcttattcttaaaaagatgtgcaaattggaggagtactgatataaaatacctagtatagtgtatcacccaattgtaggcactcaagagatgttcattctctttcccttgagaaagtcacttcccctttttcatctgtaaaaggaggaatttggcctatgaaaggtctctaatgaccttaaaacccttagatcctatgatcttcattaagtttaccttgtttcctggatattttcgccaacatccatgaagacatcaggatgtggggcccagcttgcacctcaggagcctcctcggagcatcagtggctctgtgcttgtggaggtgaagagtccttcatccaaacagggctggaaaagtctcacaccggccagcttttcagggattcaattttgaccaagagagcccatcgtaaagttcttcttgaggacatagtgggtcaagagacagtcattaaagcgaatccacccagaggtgtccttccctagtaaacagttggcgttcagaagttccagggtccatggagagggtagggaggaaggcttctgggaggctggacacatgtgcattcattagagctcatggtcatctggagggagctgaagccccaagaacatatgtgtttgttctttatttcaataaccatagtcatcgtgcacagtaagggagcacacagagagtgcgggagcggcacttgagatttaggagccacagctcttgaggatgcaaatccattcagccttacagtggtcttaggaagaggatggctcatgagcgatgtgggtaaactgagtctgatgacagcctgcttgggtcccactgggaatcagtgggggagtgaggatgagaaccagggcctctaaagccccctctcaacatctcctttcagctaccttgggctaatctattgagctaatgaaggtaaatatttttattttttcttttagcaccaatagaaaaatgtttttaatcttttaagaaaatttgtaatagattctgtagcatttgtctgaacctaacagagtcatttggggtggagtaagtttcttgttaatgtcacttcttctctacccacatttaagaagttagctctaagcctggggatgggtctggcctttagagatggcaacctgggctgaagtccctctccctcagatggtgcatatcacaacctcatatagcacctgtcaggcctgctgggcctaaaggatgggtgaaccagtggtactcacctgtgagcacctctagaagaaccatggcaaggacctagagacatgtccaggctaagctgaactcaggaactgaggacggtccatgctgcctcaccacgacagacacagaggataccctcagggcccagccattgaaaaataaatgggtccattcttgtatggcctcaggggaagcctttctgccaccagagccctggactagggctgcccaccaagccaccccttacaggatctgactgcaggccagattaaaatgagaccctcacaacagggggcatccccccgctcccccccatctgccttccttctgctatcactcactcactcactcactttcaatcagtctctctagcttcctttggcactgaaagtactaggtcagaggttgcggtccctgagactgaaccagcagaatttggactcgggcctaactgcccgagagaacttggtgacattggctctgccatctccaagtctctttcctaagcttattttcccaacgtggccagggtgtggcccacagtgcttaacctgtttttccttcctgccagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacaagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgagcatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttatttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaacggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttcttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttcagtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaaatcaagactggagtgtttctttaatgagattaggatattgctcaaggaaatgaagacttttctctgcaaatatgaatgatgaggaaaaattagatgatcttttgcaaaatgtggaaatcctataattaaccatagttgatccctgtctccttgaagaattcaagttctctgaagctcttcccagtgtataagtacttagtagactatgtgtccaataatgctaattgatgtggtagaaaatatatacaacctctgccactgcaggaattgaaatctggtcgagaagacagactgatacgctaagaataattcaggactatttctagacaatacaaataagagatgaaattataaggtagagcatatatgttaacagctgtggttctcaaagcatggttccagacctgcagcattggtataacctgtgaacttgttaggaatgcaaatctttgggctccagcccagacctactatactgtgggggtgctccatactctctctgccctctgggtgattctaatacatgctcaaaatttttatatattttttaattttgtagagaggcggggtctccctgtgttttccaggctggtttcaaactcctgggctcaagcaatcctccaccttggcctcagagttctgggattataggcgtggaccactgcgcttggctgatgctcaaatttaagaactactgtgctataggattcagtgaagggacaacttacttagtgttgagctacagttttatggaaaagctttgaaaaggctttgcagaagaagtgaaacagagtttacctcttggagttcaaatgtaatagccatcagaaagtgtagccttgaatgaagggctgcatttatctggatcttctctgctcagcctagttgaaggaaaaaaatagatctgtccatctcccaccatacccctgggctcacccacccctgttccctaccacccagtctctaattataaggaattgttctaaaactgtcaaccggatcttacaagcccatagtaaggcctctgcacttttttttttttttttttttttttttttgagatggcgtctcactctgtcacccaggctggagtgcagtggtgtgatctcggctcactgcaacctctgcctcccgggttcaagcaattctcctgcctcagcctccagagtagctggaactacaggtgtgcgccaccacgcccagctaatttttatatttttagtagagatgggatttcgccatgttgcccaggatggtctcaatctctagaccttgtgatccacccgcctcggcctcccaaagtgctaggattacaggcatgagccactgcacccagccaggcctctgcacttctaacctgtgggtgggtttcacatatgcaacataggaagcactcacagagaagtggagggtgaaatcgttgctgcacagtataaaatcctgggccccaaagaaggttctactctttgtagggagggacgagcatgtggagcttgctgtccagaccccagagggcttaggatcagccaaacttgcagaaagatggaaactcaaggaattcttcatcccaagctccctggcctggcatctggccctcagtaaagtctttccctacctcttaagagagagtggggagacttgctacccaaacctggtcttcctcctcatgaccctattcagtctttagagacatctccaggccttcttcctaaccagtgggatttttcactagtccccattttttctcctccttcccaatttctaaaccatctacctgccaaggctgcctgcctgccagaaccaaggtccagtgattgccccttgtcctggtcaggtgcactgaactgtctggggtggggaggacccattccaggaaaaagcaccgatcaactttgaatcaagccagacctttcctcatccagttgacttgcagttgacaacttgaaagccatgttctggatgctttgggtctagcctttttggatcctgttggccc

SEQ ID NO: 16607 - DNA, 40936 bp, Human
gccgacatcacgtttttcgatgtgtaaattctcctatgtttaaaaaatatttctacaacttaaataaacttacatcatagatattttccagttcaacactacagatctgattaatagcttttcaataactgcaaaatagtccataaaatgaatgttccatctgggggcagcggctcacgtctgttatctcagcactttgggaggctaaggcaggcagatcacctgaggtcaggagttcaagaccagcctggccaacatggcaaaaccctgtctctactaaaatacaaaaattagttaggctaatttaggtggtggcgcacgtctgtaatcccagctactagggaggctgaggcaggagaatcgcttgaacctgggaggcagaggttgcagtgagccaagattgtgtcactgcactccagcctgggagacagagcgagactgtctcaaaaaaaaaaaagaaagaaagaaaaagaaaaagttccacatgtatttggtgtaaattgaataaattaccataagtggcattgatggatattcaggttactccatttttttctactgtaaacaatgctgcagttgtatcttggcacataaatctttataaattaattgttttatttctgtaggatagattcctagacataggattactttagtgacatatatatataataagcaatgtgaaatgcatacagagtatactgaatcacatttcagagctctaatttctctgcctcctaaagttggactgaagtttatgtatcttttgacttgtttacttttaagattcttgtgaccaatttgcattaaatagctggggttttttgtttgtttctttgtttgttttttgagacggatcctcgttctgttgcccaggctggagtgcaatggcaagatctcggctcactgcaatctccacctcccagattcaaggattctcctgcctcagcctcctgagtagttgggattacgggcccccaccaccacatccagctaatttttgtatttttagtagagacagggtttcgccatgttggtcaggctggtctcgaactcctgatctcaggtgatccgcccgcctcagccatccaaagtgctggaataacaggcgtgagccactgcccccggcctaaacagctatttcttaaatgcttttcaatgtgcaatcaatacacggaagaaatgcaaatataaataaaaatctggcatctggaaatatcctccccgcgctgaaaaatctggctagcaccaacgacgcaaattcttaataaaatccttacttttttaagtaaaactttttttcttttttcttatttcttaagtaaacattttaaattgaaattttttttctgtacagagaaagttgaaacatccattcctatgtttgggatgagaaaagataaattatttatgttattggaaaacagaagattacagactgtcaataaacttttacttttaaatgaataaataatacatgacaattcttttcacatgagagaacgtctgcttctatttcctcctaaaatactgtggcggctgggcatgtcaacagcgccgctggtgtagtggtatcatgcaagattcccattcttgcgacccgggttcgattcccgggcggcgcataggcgttttgcttctcgctcgctaaaaaccagatagcttgaagagtctttatatatctttccaaaagaggaaagatttaggctttttactgtccctgaaggtttccactccctcataattcgcggtcgaaacactcgaatccgcagccagaagacaaaaaagttcacgcaaatcgtgaagtagttaatccttgcgcctgcgcagtctgaggcgtccctcgcgtcgggtggaagagcggctgcgcaacaagtgaacctatggattaaggtgtagccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctgtgagtctggggcagcgatgagggaggcgggatggtggtcgtcccggagggaaggcctcggccctgcgccgctcccagcctattgttctccgtggacaccgcgatatcgtggtttttgtttccttagcatgcacctggatgcttacaaccaagacccaatctgtgaggacgaggtgaagggagacggggctcaaccctctcaattaatcccttcactttagcaacaccattgcatgacctttgctctcgccacgggccctctgtggtcttagacctggagaaaagactttaattcagacctctttttagaactcgtcgaaccttccttttgtcctatgctttctttccttttcccgcttctccccctttttgattaacctcttcttatctttacagccgtctccctttaattttacttttgatttcctactgaaattcttcctttcattttcttctcggtgataagattttttttcctcctcgagggtgcttgtactcattttcagtgcagtaaactttattcttgcagttgccaattggaaaaaagccaagcatttttctttaacctctggctttccttctgtagcacccaccgaccaaaaagcctaaccagacaccccaaggatttggaaatctcacccagaaggaatatatcaattgaggggaaatggatttaatattatttttatagtcgtttactactgttgtgattgacatggtgttgaacgagcgggctgtaaatgccctaacatatttacagagaatttttagagatagcgttaaattaccggagcgtggatattttctttgtcgtgtggcttccccaactgcgttctttgtttttcgaggtattatcggatgagttgatcctgcctttgttggcatttctcggaagaagaaaagctcaatgagttcttgacatagctttttgtttttcttggatgacatagctttttgtttatattcttggaatactggcagtttgagagctccatgcattaaaaatgcaattttaggtttctctttgcagctctctaataaagttgctctgaagtacgatgtaattgtttttttacctccaaaatttttccacttttaagttgctatttcttgtctatattggaaatgtggttacacttgttttcttaatagattgtcagttaatctgttagtaaccttgaaatttcttttctctattcctgaggctcagaaagtatcttttcagtaggacgtagcaattagtgcatgacctttgttttaggaaagattgtatctgtagatgaatactccctaaaaaactactagcctcacggtgttggtggaatctcttccctcttgcctcttagctatgacagtcatcagcattttgggttaaggcactgctcgtgttttataatgtaaacttaatattctcagtattagtttgaaaatgtttaattttagaaactgcagaagtatctgaccacttaactttttaactttttaattttgtttttactttttaattttttgagatggagtctcactttgtcacccaggctgcaaggctagagtgcagtgatgcgatttcggctcactgcaacctccacctcctgggtttaaatgattctcctgcctcaccctcccaagtagctggcactacatgcgggcaccaccatgcccggctaatttttgtatttttagtagagatggggtttcaccatgtcggccaagctggtctcgaactcctgacctcaggtgatccgcacacctcggcctcccagagtgctgggattacaggtgtgagccactgcgcctggcctgtcctcaacttttaactattacatttattacttattttgccttgtatccctcactaatacaccccatccaagaaactcttcctcaaagtagtcatactgtaaaagtcttctcttgtttctacctccctcaacccaaactcccatttttctagtcaggcaaaccttgaccaaacatgagggtactaatccctaagttttcctaatagtgtttttaattttaatgtaagatttttgctttaatgaccctggaagtcagaggcttttaatatatgttcttagcacagttcttagcacattaaaaacacagcctctcaatatatgttcttagtgtggtccatggtaagtaatcaatacatttgtttaagaaactggtataattggctgggcacagtggctcacgcctataatcctaacactttggggggctgaggagggtggatcacttgagggcaggagttcaagaccagcctggccaacatggcgaaaccctgtctctactacaaatacaaaaattaactgagcatggtggcgcatgcctgtaatcccagctactcgggaggctgaggaaggagaatcgcttgaacccgggaggtggaggttgcagtgagccgaggttgcgccattgcactccagcctgtgcaacaggagggaggctccatctcaaaaaaaaaaaatctggtagaatttcaagcagtgaattaagattttactctttcttgaggataaaatagagtctgaatttttatcacccacatacctaaatggctcactggaaattccttcatttgctacatctgagtgttcggcatctccatgttaagttagagaataccagtatttgatttcttgtcaccaatactttggaatcatattctgagacaaacttcccgaaagtttatactgcaagattattttgaggagtattcaaggtacagttaataagttcaaacatttgtagtgagcatatgggtgatgtatactactcttctccatatataaatttgaaattttccacagtaaaaaaataaaaatacgtgtatagtgagtctgaattggccttggttactttaaaaatattcaacttgtgaactaaaagctacacactagactagaaaaacattgctggtgttagttgatgaaagttaattccctcaaatccagacaccttaatatcctttgtgtggtttactctcaaatgcatgagtgttctcttttgagataactatactgttattgtgtggctttcccatttgctaagatgcagatctgtaaattatagaccatctttaaaagcctgcagctggccaggcatggtggctcacacctgtaatcccagcactttgggaagccgaggtgagtggatcacctgaggtcagaagtttgagaccaacctgggcaacatggtgaaaccccatctctactaaaaatacaaaaattagctaggtgtggtgacacatgccagtagcctcagctactcgggactccggaggctcaggaaggagaatcgcccgggaggtggaggttgcagtgagccgagatcacgccactgcactccagcctggatgacagagcaagacggagcccaattaattgctatatactaatgagggccttgcctttcttctgctccatgctcatctttcattcttgttgtctactccactctccaaatagtattggccttgtaatttgtatgaaataaaatctcttgtattgagaatcagacctatctttttttttttttttttttttttgagacagagtctcgctctgtcacccaggctggaatgcagtggcccaatcttggctcactgcaagctccgccttccaggttcacgccattctcctgcctcagcctccggagtagctgggactgcaggcacccgccaccacgcctggctaattttttgtatttgtagtagagacacagtttcaccgtgttagccaggatggtctcgatctcctgacctcgcgatccgcctgcctcagcctcccaaagtgctgggattacaggcgacaatcagacctattttaaagattagattgaaggcaaggttggccaaaatgagatatttattagataatacttatgtttccaaataactgctagtaattaagaatatgctagaaacattacattcactcagtaatattgagagcatactacatggctgtccgtcttctgggaactggggatatggtagtacatataataggccttttacgaatttacataagtaattatgttagatggtaataagtgctatggagaaacataatgcagggtatgcatggtaaggaggaaggggtggatatttatagagaataataaaggaaggtcatcctttgataagtgacatttgaggaaaaaagtgaaggagatgagggagagccatgcttctatctgaaggaggagcaccctagaaagagctagtgcaaggggcccttgggggcaggtcatgctggttggttagcctgaagagagtaaatgtagtagaggagtaggaaatgaggtcagaatgataaataggaatgttaggggagatagaaaatgccagatcatacggatccttatgagggctatcttatctgagtaggaatggaagctgtaagtgggtttcacgcagagtagtggtatagcctatcttaaccttaaaactggcaaaagcaagtagcctagtcaggaagccaatccaggtatcagagaaagcagtgcctgtaattgtagttagtgctggtgaaagtgatgggaagtagttgaattatggatatgttttgaaaatagagcaacaggaattaccagtggcttagatgtggcatgtgagaatgatgtcaacaataaatggatttattttaaaatgtgtaatatcagttatctaaaatgttatagtttgttgcaaaatataagtaaaaatgaaaagtcttgaggatcgatatcccttaagatgtctacaggcatagtattgaatacatttgttcaagctggtttacctagtgaaggaggtcccaactagtaaggcagtttcagccatctcttgtaacagattattctttgtgatgggtatacatttgttaaataataataaggttaggatgctgatgtatagtatatacacaagcacttactattctacacaatttatttatttatttattttaattgagatagggtctcatcctgttgtccaggctctggcgcagtggtgtgatcacagctcactgtagcctcgacctctcaggctcaagggatcttcccacctcagcctcctgaatagctgggactataggcatgtgccaccatgtctggctaatttttaaaaatatttgtagagaagcgatctcactgtgttgcccaggctggtctccaactcctgggctcaagcgatcttcccaccttagcctcccaaagtgggattataggtgtgagccaccgtgcctggtgtttacacagtttcttcattagcaaaagacataactaatcttttccctctagggtaacttaagcaaaatgagagaattttctagcaaattgcaaatgttcagaagtcattctgagacagtacatttaactctttaacagatatttatagagcaataaatatcactgcaatgatattgcaatgttccaggcagtgttctagactagcagtccccagcctttttggcaccgagaccagttttgtggaagacaatttttccatgggcgggatggtttcaggatgaaactgttccacctcagagcatcaggcattagataaattctcataaggaacacacaacctagatcccttgcatgcccagttcacaaatgctgctgatcttacaggaggcagagctcaagcagtaatgctccctcccctgctgctcacctcctgctgtgtggcccagttcctaacaggccatggacgcataatggtccatggcctaggggggagttggggacccctgttctagatggtagataccaactaagaataaaaatgaaaacctcttatggaatttattattaggtaaaaaactattcatcgtttttactcaaattttcagagaccttatcaaattctgccttttttttttttttttttttttttttttgagactgagtctctgtcactcaggctggactgccgtggtgagatctcggctcactgcaacctccacttcccgggttcaggtgattctctcgcccaccatcacacttggctaattttttgtgtttttagtagaggcaagtttcaacatattggccaggctgatctcgaactcctgagctcaagtgatcccccacctcagcctcccaaagtgctgggattacaggcgtgagccaccgctcccagctaatcctgaaaatttcttataggcacaagagtcaggtgagagtagacacacaagagatgcagagatagtacagagttttgttttttgcgggggagggttttgcggaagaatggcatgataaccttcatctagcatcccttaatgttaccatcttatataaccgtggtataattatcaaaattaagaaattaacactataggctttattccaatttttccactgatatcctttttatattctaggatccaattcaggaaaataccacattgcatttcgtcatcgtctctttattctccttcattctgtgagaggtctttctgaccttaacacttttttttttttttagaggtaaggtctcactctggtgcccagactggagttcagtggcacaatcattgttcacttcagcttcccaagtagctggaactacaggtgcacaccaccacacccagctaattttttcttattttttgtagagacggtgcatatcactatgttgccctagctggtctcaaactactggcctcaagtgaatctctcacctcggcctcccaaagcactgggtttacaggtgtgagccaccacaccctaccgacactttggaagggtactgtttctcctgttctccaaaatcaccgtgacttcttttttcttaacttactctgttggttagaagtaagtcaccgaggctagctcacactcaggaagaggaagattaagttacacttcctggagggaggtatatccaaagaattcatagtcatgtaaaaccactagttcattggtcaaaacttttttttttctttttttaagacagagtctcgctctgttgccaggctggagtacagtggcatgatctcggctcactgcaacctctgcctcctgggttcaagcgattctcctgcctcggcctccctagtagctgaaactacaggcacacgccaccaagcccagctaattttttgtattttttagtagagacggggtttcactatgttggccaggatggtcttgatctcctgacctgtgatccgcctcggtctcccaaagtgctaggattacaggcgtgagccaccgcacctgtcccaaaaccaatttttaataaatattttagtggaggtactttgaggctattcagataccctgtttccccttttaaggtttcatcaactaatgtgagcttccatgggtggatcttcctttagaaattattactgtggtgttttaatggtgattttctatttctctcattctttctacatttattaattctgtaagaaaaaactattttcccctcatccgggatccatttaaacattattgattgtatttggttgtcagtgttttttatgtcctttttttttggtgggggggcagggagggcagtgtcttgctctgtcaccctggctggagtactgtggtgtaatatgagctcactgcaatgtccacctcccaagttcaagtgattcttgtgcctccccttcccaggtagctgggattacaggcatgcgccaccacacctggctgatttttgtatttattgtagtagagatgaggtttcaccatgttggccaggctggtctctaactcctggtctcaagtgaactgcctacctcggcctcccaaagtgctaggatttcaggcttgagccactgtgcccagctttctgtttcttttatttatttatatcttagaaatgaggtcttgctatgttcccaggctggactcaaactcctgggttcaagggatccacccacctcagcctctcaagtagctggggctgcgggcttgtgccaccactcccttttattcaagaacagtcatctgttgtttttgttttaggacaataattttttgaagagactgagttgtcttataaagtgtcccacatctggattcatggaattgttttatttgcctgatatcctataaacttaaatctaattttcagcttggttagatttaggttagacttttttatgtaaatatttcataggtgatactgtgtaattcatattatatatatgcagtatctcattggtcgttgcccatctataaaataattgaaaattttatcactgggtcatagtggtaacagccaaagctctcatttttaaggtaaggttttccctttgcaatttattaagtaatctatgtgataactttgacaccttgtgactatttccacaccaactgttcatgtagtagtttaagcattaattaaagatccttgcctgaaacagttatttcattagggtttacacattgttaatttaatactatctttctacatttattaactagcattctcctgtaaaggagaacttttctaaactagagctattagattacactatttagtgggagttcctacttaataggataaatgcttaattctgtctctttttcagaataaagacttggtgtagtaataactcccaatactggtaaattgctgttgggtaaatgttgctgttactttctcttttgagtaccattattttacctgatcgttaaatgtcatttgttattaagactcagcatttcttcctttgccatcttaaccttttccaaaggcttcgtgttaagcactcaatatgtgtttgttgaatggtagatggaaagaagaaattgattccacactttgtgagcatgtatgaatatttacttttctggggagaaagtccataccttgtatcaaattttctgaagggtacctgagagacaaatgagaaactaccattctggggagactgcattccctgattccagaactgataaacctctaactctgtaaaatgactagaggtaatctcatctcaaaatctcatttaaaaacttatttataaaccctttattggccgggcgcagtggctcacgcctgtaatccaaacactttgggaggccgaggcaagcagatcacgaggtcaggagatcgagaccatcctggctaacatggtgaaaccccatctctactaaaaatacaaaaaactagccgggcgtggtggcgggtgcctgtagtcccagctactcgggaggctgaggcaggagaatggcgtgaactcaggaggcagagcttgcagtgagccgagatcacgccactgcactccagcctgggcgacagagcaagactccgtctctaaataaatgaataaatagtaaaacctttattttctttttagagatagagttttgctctgtcacctgggatggagtgcagtggcataatcatagctcactgcagcctcttaactcctgggttcaagtgatcttcccacctcagcgtccgaagtagctgggaccatgccatgggacatagtgccaccatgtccgctaattttttatctttatttttattttttgtagagacgggggtctcgctgtattgactgggctgatcttgaactccttggctaaagtgatctttccaccttggcctccaaaagtgctgggattacagatgtgagccactgcccctaatctaaaccctttaaatgaagatcatcacagtcttatggtcttgtaatgcacgatttatatttttatattgataaccaactcataatctgtgatgtttctactccctttcacccctcttctactgatcagtaatgttaaatggaaggtttctcatcccactgtaagcattcaaaacaactgataatttacctataacttttcaaaaatgtgttcattgcataaccaaagtctacctaaattgaacaaataagggaaataatgttaatttaaaaattgggggtaccagcctggccaatatggtgaaaccccgtctctaccaaaaatataaaaaaatagctgggcgtggttgcgggcgcctttagcccagctacgtgggttgcttaggcaggagaaacacttgaacctggggggtgggggtttcaattagcccagatcccaccactgcacccccgcctgggggacagggggggactttgtccacaaaaaaaaaaaaaaaaaaaaaaaaaacttgggggaacgtcaatgttcttagtagtagtaataccatagaagtatgaaataattgcaatgccttttaggtttgatggtatacatttttttttttaattgagatggagtctcgctctgttgcccaagctggagtgcagtggcaccatctcggctcactgcaagttccgtctcccaggttcacgccgttctcctgcctcagcctcccgagtagccgggactacaggcgcccaccaccacgcccagctaattttttatatttttattagagacgaggtttcatcgtgttagccaggatggtcttgatctcctgacctcgtgatccgcccacctcggcctcccaaagtgctgggattacaggcatgagccaccgcacccagcctttttttttctttttaaagacagtcttgctccgtcacccaggctggagtgcagtggcgtgatcggggctcgttgcaacctctgcctcctgggttcaagcaattctcatgcctcagccgtcccccagtagctgggattacaggcaggcgccaccacgcccggctaatttttgtgtttttagtagagaaggggtttcactgtgttggccaggctggtatcaaactcctgcctcaagtgatcctctctcctcagcctcccaaagtgctgggattacaggtgtgagccacctcgcccagccattattgtataagatattttatataactaatgatgattcatttgagtgtttttaaagcttgtcttcctaaggtaagcctggaaacgtagaaacaagcaatcagtttgcaaaacgatgactaaaacagacaagcacatactagcttccccttcactagcaaggtgtaatatattttcttttttgagacatagtctcactctgttgcccaggctggagtgcagtggtgcaacctcagctaacccagcctctgcctcctgggttcaagtgattctcctgcctcagcctcccaagtagctgggtttacagatgtgcaccaccatgcctggctaatttttgtgtttttagtagagacagggtttcaccatgtttaccaggctggtctcaactcctggcctcaggtgatcttcccaccttggcttcccaaagtgctgggattacaggcgtgagccaccacacctagctaatatattttcaaataacatactttacatctgttttcaaagagattttgaagtgttggcaaacttttaaaagttactcccaaatattatagtttaaggcaaagatctgcctatttctcaagtttaatttttaatgaacaactttagaaaccgatggagaataagcaaattaaaaatggtaaatcaagggctgggcacaatgcctcatgcctgtaatctttaagattacactttgggaggccaaggcaggcagatcgcttgaacccaggagtttgagaccagctcagcaacatggtgaaacgccttctctacagaaactgtaaaaaaattagccagatatgatggcacacgcctgtggtcccagctacttgggaggctgaagtgggagaatcccttgtgcccaggaggtggagattgtagtgagccaagattgcgccactacactctagtctgggcaacccagaagaccttgtctgaaaaaaaaataaattgaggtaaattgagctgggtgtggtggttcctctagtccgttactcaggggaccaaggcagtaggtttgcttgaggccaggagtttgagagcagcctgagcaatatagccagactatttctcttaaaaaaaaaaaccgggtgcagtggctcacacctgtaatttcagcactttgggaggctgaagcaggcgggtcacctgaggtcaggagttggagaccagcctgaccaacatggagaaaccccgtctctactaaaaatacaaaattagctgggtgtggtcacgcatgcctgtaatcccagctactcggggaggctgaggcaggggaatcacttgaaccctggaggcggaggttgtggtgagccgagatcgtgccattgcactctatcctgggcaacaagagtgaaactctgtctcaaaaaaaaaaaaaggtaaattgtttctctttgtgtttcagatacgtcggtaacctttccagagatgtgacagaagctctaattctgcaactctttagccagattggaccttgtaaaaactgcaaaatgattatggatgtaagggtattttacttagttaactttattctttttttttttacacattacttaaagccattgcttggaaggaattcttagtttaccatggtctaaatatagtataaattattagtttactgtagtctaaatatagtcttagtttaccatattctaagttaatagggattttagtgaatttgtaatgaacctgttttgacagctgaatttaatttgttttattacatgatggaagatgacaatagaactagttatttctagatcagatgggaacatatatatgggctctttcaggtgcattgaggcatcagaaatgtttatatgtggtgtcaactggttggctaataaattcagctcttacaattaaattggaaaacaggtttaaaaataataggcatttggtacagtgaaagtatttttaactttatttttaaaggtcatcattcaagtttttcttgtatttaggcaattcctatttatgagacaatgtattaaacacacacacatacacacacacacacacacacacacacacacacacacactcattcatctaattggtgttaaccctgaatcataataggtataaaaagacatttagggaacatttaccccatttccctggagtctttgtctcctggttggggggaaaagactttaaatttttttttgagacggagttttgctcttgttgcccaggctggaatacaatggtgcgatctcggctcgctgcaacctccgcctcccgggttcaagcaattcttctggctcagcctcccaagtagctgggattacaggcatgcgccactacacctggctaattttgtattcttagtagagatggggtttctccatgttggtcaggctggtttagaactcccgacctcaggtgatccacctgtcttggcctcccaaagtactgggattacaggtatgagccactgtacctggcctaaattttttaatgggaaaggctatgttaaagagaaatccttttgtcccatggtctctcttttctgtaaacttttcgtttgtttgtttgtttgtttgtttgtcttgaaagacagggtcttggtatagccattgcacccagcctgctataaactttcagttttcttttctccagaaaagacaatcatgtatgtgtgtatgtgtatctgttaccttctttcctgttgtattccagttcaacttttttttacttaatatttttaaaagtaattatttagccgggcacagtggctcacacctgtaatcccagcactttgggaggccgaggcaggcagatcatgaggtcaggagttcaagactagcctgaccaacatggcgaaaccccgtctctactaaaaataccaaaattagccggacatggtggcaagcgcctgtaatcccagctactcaggaggctaaggcagtagaattgtttgaacccaggaggcgaaggttgcagtgagccgagattgcaccattgcactccagcctgggcgacagagggagactgtctcaaaaatatatatttatccaattggctttgatttgttgtcttagatcttaaaatgttgtcagacctttgttctgatgctgcaaaatcatctgcatattatatagatgaaatcaacaaagagttatgttcttttattctatcacatttaatatcggtatgcctttggataaaggagaaaaaatccatgtacccatagagaaagacaggagggaaagatggggaaagatgaagagaaatttaaaaccagtctttccttaatctagatctccttacttatcccaatggtagcatttatggaaaatttgctgcctgtcagttactttaatacattgtcataaatgctcaatagaaacataaagaaggtgttattttcatttcatgtatgaggaaatgaggcaaagcaaggctgtaaaccctaattgatttatccgaatataaatcttctctgttggtttgcctgctgctactctctctctggctggtcatatgtttccctggggaaagatcattagacaaaacgttaatgattgccttggctacagaaaaaaccaggttagcctttgccactttttatcatttgtggattctgatcgctcaaaagcttagatttttattattcaaatctaaattccagtctgttcacattctgagactaatgttcacatttataaattttatgctccctggactgataatatgtatatatgcttcgattcttatttaaaaagttagttttttctgcatataaattaagtaaagcatattctttttcatttatttactcttaaatgcaagtgactttttctttttttttttttagacagagtctcactctgttgcccaggctggagtgcaatggcatgatctcagctcactgcaaactctgcctcccaggttcaagctattctcctgcctcagcctcctaagtagctgggattacaggcatgcgccaccacacctggctagttttcgtattttcagtagagacagggtttcaccatgttggccaggtggtcttgatctcctgatgtcatgatccgcccaccccagcttcccaaagtgctgggattacaggcgtgagccaccacagccagccgcaagtgactttttctaacttcatttcagtgttgcctgtcagcattgatcttggtaatagaattcccattgtgttttattagtttgagttatataacatttttattctctaatttttttagacaaaatatagtcccaatatattaaactttgtcttggcctcgttgctttaaaatttttacaagtcattgccagtgactctcaaactattaattgttgatgtgcacagtgactgatgcctgtaatcccaacactttgggaggcagaggctggaggatcacttgagcccaggaatttgagaccagcctgggcagcataacaagaccacatctctaaaaaaaaattaattaactgtacttgaaataaaattgtatattcctctattttagtagctttctagtcttttgaattagttttttattttaacaaatctgtttaggaggctatggaaagaattttaaaatggcctataatgtcatttgatattttgcactgtaggtgtaaaaattggaatttttttctgctacttgaatttataattaaacatccaggttctatttatcacatagcctcacctacctggaacaccagcagaaaagggaagttttgtttttttttttgagacagagtctcgctgtgcgcccagactggaatccagtggcaccatcttggctcactgcaacgtccccctcctgagttcaagcgaatctcctgcctcagcctcccgagtagatgggattacaagcacacgccaccacacccagctgatttttgtatttttagtagagatgaggtttcaccattttggccaggctagtctcgaactcctgacctcaggtgatccacctgcctcatcctcccagagtgctgagattacaggcatgagctactgtgcccggccaagggaagataattttttttttttttttttttttttttttttttttgagacagagtttcactcttgttgcccaggctggagtgcaatggcgcaatctcggctcaccacaaccttcgcctccagggttcaagcgattctcctgcctcagcctcccgagtagctgggattacaggcatgcaccaccacgcccggctaattttgtatttttagtagagacagggtttcaccatgttggtcaggctggtctcaaactcctgacctcaggtgatcagcccaccttggcctcccaaagtgctgggattacaggtgtgagccatcatgcctggctgggaagataattttttttcttttttcttttttcttttttttttttttttttgagacagagtctcgctctgtcgcccaggctggagtgcagtggtgcaatctcggctcactgcacactgcaagctccgtctcctgggttcacgccattctcctgccttagcctcccgagtagctgggactacaggcgcccgccaccaggcccggctaattttttgtatttttagtagagacggggtttcaccgtgctagccaggatggtgtcgatctcctgacctcatgatccgcctgcctcggcctctcgaagtgctgggattacaggcatgagccactgcgcctggcgggaagataattttttaaaggcttctgagcaagcaaaaaattgatgtcagaaagttcacattctaaaacttattctaaaattttacttaccagagaatctcttcagttttcagagcctatttacctatattttaaaacaggtttaagaaggttggctaagattttctgctactcagcaagctagtagcagcaaggagcaatgtacatttgtagcagtaaaaagtaacttataacagggaggggatagaaaaatcataaaaagccgaagtgagacttcagaacttaggagttcagtcaaacttaatctgtgtagcttgaacaaatggttatatgatgatggggtatgtgtagctatatatccagttaggatacctagtcattaatattaaattatagtactatagtataacctgttgaagaaaatagctatgtataaaagcagtgtgattttaagtgtttgcttttttttttttactttttaattattttagagacaggatcttgctgtgttgcccaggctggattcaaactcctgggctcaagcattcctcccacctcagcctcctaaagtagctgggactacaggagctggctgtttacttttttgtttgtttgtttttgagacggagtcttgctctgtcgcccaggctggagtgcagtggcgcagtctcagcttactgcaacctccacctcccgggttcaagcaattctcctgcctcagcctcccgagtaggtgggattacaggagcctgccaccatgcctggttaatttttgtatttttttttaatagagacagggtttcaccacgttggccaagttggtctcaaactgctgacctcatgatccacctgccttggcctcccaaagtgctgggattacaggtgtgagccacctcacccagcctacttttttaaatctaaaatttacttgtggaatagaccattcattctccatggcctgataacttagatgtataaaacttggtttaagatttttttttttacataattttaaggtaatgggtgaataaagcttaaaattggcttttgtgtttcttctcccacagacagctggaaatgatccctattgttttgtggagtttcatgagcatcgtcatgcagctgcagcattagctgctatgaatggacggaagataatgggtaaggtaagctgtcgtaattaaagaaggtgacttgcactgaaaaaatttaagttatatatgattttgtttcctttttagaaacattaaacactttttttttttttttttgagatgaaattttgcccttgttgcccaatctggagtgcaatggcgcagtcttggctcactgcaacctctgcctcctgggttcaagtgattctcctgcctcagcctccctagtagctgggattacaggaacgcaccaccacacccagctaatttttcgtatttttagtagaaatgaggtttcaccatgttagccagactggtctcaaactcctgacctcaggtgatctgcctgcctcggcttcgcaaagtgttgggattatagatgtgagccaccgcgcctggctgaaacattaaacactttatagcaaaaggtcagttattgacatataatattaaaaaggtaggataaagcttttagagggcagaggcttgtgtttatgttagtattttcttttctttttttttttttttgagttgggtctttctctgttgcccaggctggagtgcagcggcgcgatctcagctcactgcaagctctgccttccgggttcatgccattctcctgcctcagcctctggagtagctgggactacaggcgcccgccaccacgcctgactaattttttgtatttttagtagaaacagggtttcaccgtgttggccaggatggtctcagtcgcctgacctcatgatccgatctgcccgtctcggcctcccaaagtgctgggattacaggcgtgagccaccgtccccaggtttttttgttttttttttttgagatggaatcttgctttgtcacccaggctggagtgcagtggcaccatcttggctcactgcaacctctgcctcatgggttcaagcaattcttctgcttcagcctcctgggtagctgggatgacaggcacccaccatcatgcccagctaatttttgtatttttgtagagacagggtttcactctgatggccaggctggtcttgaactcctgacctcaggtgatccgcctgtcttggcctccgaaagtgctgagattacagacgtcagccagcagcctatgttagtattttccatggtggattgtacatggtaaataacaaaatatttgctgaattactcaagcttggatgctaatggaaaagaatgaaaggaaaaaaaataatatgggtactttaggtaggaaaggttaattgaatgataacagacacataaagattaggatttgtcaacattatttgcctaaatgtaggtcagaagattaagtattgaaacttgaccagagctggtatctccttcagtgtttcatcttaaacagatatcttcctatgtgtttatagatacaaatgtgattttgggctttatttttgtgaagtataaatgtagaaattttttttttttaggaagtcaaagtgaattgggcaacaacccctagcagtcaaaagaaagatacaagcagtaagtatattttatgctctttgaacatttgtttttattgtacccagtagttttattgtaaagcctataaacatcatacatgtttgcagtaatgttttgatcgttatcctaagatatgattgaatgtgtttgtgttaataaatttaagaacaaatctaatctttgtcatcaggtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaacctttggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaagatttcttctgttttgtctgtttaacatttattggcacctgaggcatgcagagtactgataagatgttttcagaatgtagaaagtaaagttgtttaaattatcagccaaaggtagatgttgaaaatctcatttatggatttaattcattatctccgtagtttatattcccatggtagtttaaaagtagctaataaaatactgtgaggaggccggacgcagtggctcacacctgtaatcccaacactttgggaggctgaggcgggtggatcacctgaggtcaggactttgagaacagccaggtcaacctggtgaaaccctgtttctactaaaaatacaaaaattatccgggcgtggtggcaggcgcctgtagtcccagctactcgggaagctgaggcaggaggatcacttgaacccaggaggcacaggttgcagtgagccgagatcatgccacagcacagcctgggcgacagagtgagaccctgtctcaaaaaataaataaataaataaaaatactgtgatggataggaactttttaaaaaattaaatattacccgggcacagtggtttatgcctataacctcagcactttgggaggctgagaagtttgagataaatactggcaatatagtgggaccctatctctacaaaatatatatattttttattttactttttttttaatttttttttttccgggaattccgaaaattcagccgagcccagtggctcacacctgtaatcccagcactttgggatgccaaggtgggcggatcacttgaggtcaggagttcaagaccaacctggacaacatggcaaaaccccatctctacaaaaaattagccaggcatggcgacacatgcctgtagtcccagctacttgcagggctgaggcgggaggatcacttaaatccaggaggccaaagctgcagtgagtcatgatcaagccactgtactccagcctgggtgacaaagtgaggccctgtctcaagaaaaaaaaagttgaaaattgtaaagtacattgagaggtgaaaacaatacaagctcaatcatgtacatgtcccatctaccaaagattttttttttcctgtaagatgagaaaataaaaattaagagaatttatttggttctcaaaactttactattaagcatagcataatgttttagaaaggtagaaaaataccttctataatggattgatagccgtgattaatttgagttccttagaggattgattcataggttttaggatgttttagtgcaagttagggaaataaattggcggtttgatgggctaggaactcatttttcacattttcgagattgtggactgtagggttctgctatataaaaatcactgttgaatgtgtatttagtatgaactagagtcaaatagcaaaggatgtctcttgataacctgtgtatggcctctggagttagccagagatgtatacaaattctgacaaccattataaaacagatgtaactttgagtaaataatataattttttttttgagacggagtttcgctctgttgcccaggctggagcgcaatggcgcaatttcggctcactgcaacctccatctcctgggttcaagcaattcttctgcctcagcctcccaagtagctgggattacaggtgccgccaccatgcacggctaattttttgtatttttagtagagacaggatttcactatgttggccaggctggtctcaaactcctgaccttgtgatccacctgcctcggcctcccagagtgctgggattacaggcgtgagccaccgcgcccggcagtaaataatataatcttctataaaatcttctataaatttaaatctataaatttcaacttatgtaaaatttgtgatacgtgcttggctctgttacgcagtgctacagccctgattgcaattacccccagcctctcttcctatgttctacatgctaggaagaccacaatactgattgagcttagcttctctgcctaccccaaaataactgaatgttcctggaaaaaaactgagttcaggtggttttgcttctaatttaatggtcacacactttaggtgagtacagagtactgtcttggcaaacatgtgtttctcatctttcaaccaccaaacttacataaaattcatccaccttcccattcttcctattatagtacaggaaaggtccttcctgtcaaaggcaaaatcacttatgattgtgtccccatctctcttgccttttcaaggactttgagcctatgctgccactgcttcattgtttttttttttgtttgtttgttttgttttgtttttgttttaacagcagctttattgagatataattcaagtatacagtgtggccgggcacagtggctcacacctgtaatcccagcactttgggagactaaggcaggcagattacttgagcctaggaatttgagagcagcctgggcaaaatggcaaaaccccttctctacaaaaaatgagccaggcatggtggcacacacctgtagtcccagttacttgagaggcagaggtgggggaatcacctgagcccaggaagttgaggatccagtgagctgagattgcaccactgcactccagcctggacgacagagaccctgtctcaaaaaaaaaaaattttttttttaaagtatacaattcagtggtttctaggtaattcacagaattgtgcaactattaccaaaataaattttagaatatttttaccaccccaaaaagaagctacatgactcattagcagtcactatcctcctttcatgcccctcctgccagccctgaacaattgtcaatctactttctgtctctgtagatttccctgttctcaacatttcctataaatggaatcataatgtgctgttcttgttattactgctattctgtgtcatcactctattccttctctactggatcattctcatcaacctaggatctctcttttttttttggagagagggtctcactctgtcactcaggctggagtgcagtggtgtgatcatagctcactgcagcctcgaactcctggcctcaatccatcctcctgcctcagcctccagagtagctgggaccacaggtgtacaccaccatgcccacctaatttttttttaaaaaaaggccaggcatggtggctcacacttgtaatcccagcactttgggtggccgaggcaagcagatcatgaggtcagaagttcgagaccagcctgaccaacatggtgaaaccccgtctctactaaaaatagaaaaattagccaggcatggtggcacacgcctgtaatcacggctactcaggaggctgaggcaggagaatcgcttgaacctgggaggcaaaggttgcagtgagctgagattatgccactgcactccagcctgggcaacagagtgagactccgtctcaaaaatatatatatatatttttttgtaggaacaatctcactttgttgcccagtctggcctcgaactcctggcttccaccagtccgcccgccttggcctcccaaagtggtggggttataggcatgaggcaccgttcctggccatctagtatctcttaatcaaaaccactgtttatcctcacatcccttccctaactgtatccccatttcttggctataattctcaagagttgtttgcatatgcttctactttatctcccattcacaaccaccaacatagatacatctctgttttttttccacttttttgagtgagtagttttatttttttcctgaggagctgtatcaaagtatcataaactggatggcttagagcaacaaaaatttattttctcaatgttttggaggcgtgaaattcacaatcaaggtgtcagcatgtccatgctcttttgaaggctctgtagaagaatcctttgttgcttcttccaagcttctggtggttgctggtaattcttggcattcattggcttgtagctgtataactccaatctctgccttcatcttcacatgaccatcttctctctttgtgtatccatataatcatcatctttttttttcgagacaggacctcactctgtcacccaggctggagtgtggtggcacaatcacaactcactgcagccttgacctcccaggcttaggtgatctttccatcacaacctcctaagtagctgggactacaggtgttgcaacaccatgcccagctaatttttctattttttgtagagacaggattttgtcatgttgtccaggctggtctcgaactcctgggctcatgatccacctgcctcggcctcccaagtgctgggattataagtgtgagccaccgtgcccagtctgatctttacttcttatgaggacttgagtcattggatttggggcccaccttaatccagtataacctcatcttaattacttcggcaaagaccctgtttccaaataaggccatatttcacagataccagggtataggacttcatatcgttttgagggacacaattcaacacataacattagttaagcgtctcatggagttcggactggttggggtgataatatttgtttctttttaagaatgtgcatttcctgccaggcacagtggctcattcctgtaataacagaactttgggaggccaaggcaggaggaggactgcttgagcccaggagttagaaaccagcctgggcaacagcaagaccctgtctccattaaaaaaaaaaaaaaaaaaaaagcctggcgacctagtctgtggaccccgaatccctcccattgcctgttgcaaccagtaaaggctgttcctaccatagtaaagaaatgaaaaaaataaaaaaaacagccaaccttgttggtgcatgcttatagtcctagctactaggaggctgaggtgggagtatcacttgagcccaaggagttcaaggctacagtaagctgtgatcatgcctggatgacagaataagaccctatttaatttttttttaaagcatttcgttttcatatttcaagaaaggccttgaatttgcctgttccttcagtagtagattaagcttacctttgatgtgtgcacacaaaagttacactccatttactttttagtctactctaagctggttttactctcactttgtaccaatgctactctattttcaaggtcacctcttaacctctgttttcttggctccctggaccatacacttttgtggctttcttccttcatcactggctactcctccctagtcaccttagctagtgattattcctttacccatttttcaagttttgctgtttttcagggctctgtcctaggctctttctctagtctgcatgaattttgtatcttcagtctacttctctgcgttccacatttattaacaaatggtcttcatttatatgtctcacaggcatctcaaagttttttcttaatggagctttttgtttcttcctcagacctgttccccttttctttcctagtctttctccgcatttcaataaatgctgtctttccaatttctctagaggaacctaagagttatcttttctctccttttgcttgtggtgtcccctccagcccccattattttggccttgagtttaagttacattcactgctactgcaatgctcctggccaccaacactttttaaaaatctagaatattgcacaagtttcataaagtatctttatccccttactacccattatcctaagccattctcctcttagcgctaagaatggccttcttgccgggtgcggtggctcacgcctgtaatcccagcactttgggaagccaaggcaggcggatcacgaggtcaggagatggagaccatcctgtctaacacggtgaaaccctgtctctactaaaaaagaaaccctgtctctactaaaaaatacaaaaaaaaattagccgggcttggtggctggcacctgtacaggagaatggcaggaacccaggaggcggagcttgcagtgagccaagaacgcgccactgcactccagcctgggagacagagcaagactccatctcgaaaaaaagaatggccttcttaaaacataggtcatgatgattccttgcttaaaatctttcagtttcattctctgacattcttttttgctcgctggattccactgaaactagtctttcacatgctgctttcagatgcataccaaacttttgtgccttaacacactttgcaatacttttctctccactggggctttcttcctcattgttttgacttggctatctcctattgctgtcaggcttagtttaaatgtcatttcagagagacctttcttattcatcctgtctgtagtagatccttgtgcccatattctctatctcagccttttgtttctgtcataggtcttaccacaatatgtaattgctttatttgttccccacaaaagaatgtaagagaccatgtatgcttgtttaccagtgtgtccctagctcttaaccgcatgcctggaacataactgttcaatatttatttgttggatgaatgagaaaccaaatattgttaacaagcttgttagattgtttaagattttcttctatagtagtctgagttgcatgaactttatgatatctacctcattagggctgtcgggctcacgaccttttcagatgattaatgttcccaaaatttaatattcaaataagagaaaaacaatacaaaagcaccattgggttgagcatggtggctcatgcctgtaatcctagcactttgggaagctgaggtggacagatcacttgaggtcagaagtttgagaccagggccgggcacagtggctcacgcctgtaatcccagcactttgagaggccgagttgggaggatcacgaggtcaggagatcgagaccatcctggctaacatggcgaaaccgtgtctctactaaaaatacaaaaaatgagccaggcgtggtggcaggtgcccgtagtcccagctacttgggaggctgaggcaggagaatggcgtgaacctgggaggcagagcttgcagtgagccgagatcacgccattacactccagcctgggccacagagcgagacttaaaaaagaaaaaaagaagaagaagttcgagaccagcctggccaatatggcgaaaccccatctctactacaaatacaaaaattagccaggcatggtggcagatgcctgtaatccccgctactcaggaggctgaggcaggagaatcgcttgaacccagttggcggaggttgcagtgacccaagatcacaccactgcactccatcctgggtgacagagcgagactctatctgaaaaaataaataaaataaaatttaaaaatataaaaagcaccattgcattttaggaaagctatcatatgttgtgtatttcatagagcattttcacttaaacatttgtgaaaagcaccaagttttctctactgctaagagttgtttaacatcaactaatagtgacttctttattgtttctaatgttgtacggaacaggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatgtacttagttttcatttttgtaattataaataatattatttctaatgtcaagtctcctattaaatagaaaatactgggtaattttttagacattcgtgggggaggtttaattctgaactgaagtataatatgtgtaatataagcattttgatcaaggttaatgttacctttacagtagtgtagtgaatgctacttttctctttctgcacattttatttaatgaattaaagacataaaccttttctctcaccagcaaataccaaacagctatcatatgatgaggttgtaaatcagtctagtccaagcaactgtactgtatactgtggaggtgttacttctgggctaacaggtatgggagccttccctgtgtggcattaatttttaaagtgcaaagcttaatatttgtaggatttttatataacttagtgtgatttgtttgttttggttttttgtctaacagaacaactaatgcgtcagactttttcaccatttggacaaataatggaaattcgagtctttccagataaaggatattcatttgttcggtagggatggttttttaaaaaaacatttttcttggtaatgtaactggaaaaccagaaaataaataaaaataaaaaactttttcctccaaaatattttttgaacatttacctcgttttcttaaaaatttaccttggttataaaaaagttgaaattttggccgggtgcggtggctcacgcctgtattcccagcactttgggaggccgagacgggtggatcaccgtcatgagtttgagaccagcctggccaacattgtgaaaccccgtctctactaaaaatacaaaaatataaaaattagccggcatggcggtgcatgcctgtaatcacagctactcgggaggctgaggcaggagaatcacttgaacccaggaggtggaggttgcagtgagccaagatcacaatcactgcactccagcatgggcaacagagccagacaccatctcaaaaaaaaaaaattgaaatttctctagcatccagcgtatttgcctctgtgattttatagctccctccctaacacaaggccagtgaaacacacattctttgttaacacaagttgccccagaactacaagatctttgaaaaaaatagcaaagaaaatatgccatgttacgcaaactgttttacctcagactcaccttgatttttaaaaataggttttattcataaatatttaaaagaatttgtattggtgattcttaatattgttttcaataggttcaattcccatgaaagtgcagcacatgcaattgtttctgttaatggtactaccattgaaggtcatgttgtgaaatgctattggggcaaagaaactcttgatatgataaatcccgtgcaacaggtgagagggttcttaactttgagaagtaattgttgggctaataatgttattttaaggtgaagattgttgataatccttgttaataagtttctagctaaaatgatagtatataagggctcttcctacatgtattatagttccagaatggtgtttcatggattgcagtggtgacatgatgaatgtgaccgcctcaattgactcatgctcacacagtggattttaaaatgctccgagaaacctaaaagggtattacatctttttttaatacttggtagatttattcacataccatttggagaactcacaagcatgcttgactcaactgaaacaaaaataaagctgtaaatatagttatggccttggcatttttcttccagattttgctgccttttttttccaggcagctttagtggttcaaacttgattccacaaagatttctatgaggaaactgtaaatggagcacagagatgggagtaagcaaatcctaaactatataagtgtcttaagtaagctgaatatagaaataattaatcacatcttccctatctaaaggaaacaatcatgtagatagtataccaaacacttaaacattctactaagtttaacatttattactagggtatcaactgatgccttccaaaaactatgccattcagagtatcacgtagagttacagcagtataacctcacttgttttgttgttgttttttgtttttttgttttttttttttttttttagcagtcaactcttgtttatcctgtcattttaattgtaatgatggccctgtgtgttttggctaagaatttgtggtatcagcatattaggattgtatatatatagttaacttcaagtaatactaaattttatttaatagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaagtaagcatatcttatgtcttcctttactaacctttgaaaatgtctaaagaaattttaagtaggaagaaattttaagaattagtgggtaatagggcctcttatgtaaagcgtaactatagccttgaaagaacttaaaattgttttttagtaagaaaataagagcttaatagttgttaagcttttcacatgactaatggtcacttagccattcttatatacactgagtttgatgctagttgttgtattcattatgcttttttctgtacaaagggttttttcaatatgccttgttacattgcaagcttccttatacaccctgaattacactattttacttacatttctgaaaaacacactggaaataaaaatacttgagaggttaaaaaggaatttagtgggctgggcgtggtagttcctgcctgtaatcccagcattttgggaggctgaagtgggtggatcacttgaggccaggagtttgcgaccagcctggccaacatggcgaaaccccacctctgctaaaaatacaaaaattagccaggtgtagtggtgcacaccagtagttccagctatttgggaggccgaggcaggagaatcacttgaacctgggaggcggaggttgcagtgagctgagactacaccactgcactccagcctgggcagcagagcaagactctgtctcaaaaaaaaaaaaggattttgtggttgggcatggtggctcatgcctataatcctagcactttggaaggccaaggcaggcggatcacttgagtccaggagtttaagatcagcctgggcaacatggcgaaatctcatctctacaaaaggtacaaaaaaaattagccaggcatggtggttgcgtgcctataatcccagatgttcgggagactgaggtaggagaatcgcttgagcctggggagacgtaggttgcagtgagctgagatcataccactgtactccagcctgggtgacacaattaaaacctgtcttaaaaaaaaaaaaaaaagaaaagaaaagaaaatcttgtaatgttatgaatttttatgagctttcatatgctaataattgttttgatttcttctttgagtagtataatgttcctttttcgttgtagggaacctacctgactctttcaggtagtggtttcctcagcaaatatgttcaaccaaggcatagagatgagatggatagctttcttttccaagaatggggttaggtttttctatattcaaaggagatgaatgttgataagttcagggtattttcttagctttaatttctaacaaaattaaactgtccaaattaaacatacagggatgcttgtttttaagagaaaaaaactttagtaaaagatttcattttccctagcataaattattctatttgggattaagaaaaagtatgtttcccatttcccatatttgttcttgttgtttgttcttgccaatactttattttaatcagtggatttcctctcccctctgcttctttcacattctccaccagtcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaa

SEQ ID NO: 16608 - DNA, 40936 bp, Human; identical to SEQ ID NO: 16607

SEQ ID NO: 16609 - DNA, 12285 bp, Human
gtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccaggtgagcggcggcaccgcggggaacggccactttcacgtgcagaggccaccccacccgaccgccggccgggctcccagcgccccgggccgacctgtggaacgcctctaggctgcgacctctaccgcctcgacacactggcccctgactggcccgcgcacggacggacgggggcgcggcgcaacagggtactggaccgaggtcccttcgcaggtcaggccggagcagcgcccggccccgctctctcgtcactggggagcggtctccgaagtcacaggccgtgggcgcgctgcggaacgggaggaaacgggaaagcgggcgctggcaccccggcccggtgcaaccgccggaaagcgaacctgcgccggtgcccagcccgaccgactgtcgaaagcgcgcacgggccgcttgacggcagcgaggccagccccggggcggcgggaagtggccgtcaccccgtggggctcccgcttcctggcagcctcctgcgctcgccttttgtctctctagtgtttctgttttttgtttgacacagggtccagccagacccaggctggagtgcagtgatgggatcatggctcactgcagcctcgatctcccagactcaagcgattctcctgcctcagcctcccgagtagctgggaccacaggcgcccgccatcacactctgatccacccgcctcggcctcccaaagtgttgggatgacagccgtgagccaccccgcccagccacatatacaatttgacatagttacagtactacatgatactatgtgtatgtagcaatgtataatctactgtatggcaaaatatacaatatatacagcaatatatacaaacatattgtgtatcatatgtaatacaagaaacagtattttataccatctgatacagtcacaatgtcagctactacctctagttctgaaacatattcatgacccggaaagaaagccccctatgcattaagcagccagttttttatttttattttatatttatttatttattattatttttttaggagtctcgctctgtcgccagctggagtgcagtggcacaatctcggctcactgcaacctccgcctcccgggttcaagctattctcctgcctcagcctcctgagtagctgggactacaggcgcaggtcgccacgcccggctaatttttttttttttttgtattttagtagagatggggtttcaccatgttgcccaggttggtctcgaactcctgagctcaggcagtccacccacctcagcctcccaaagtgctaggattacaggcatgggccaccgcacccggcagttttttatttttatttttatttatttttatttttgagacagagtcttgctctgttgcccaggctggagtgcagtgacgagatctcagctcattgcaacctctgcctcccaggttcaagcgattcttctgtctcagcctcctgagtagctgggattacaggcgcaagccaccacacctggctaatttttgtatttttagtagaggctgggtttcttcatgttggtcaagctggtctcgaactcccggcctcaggtgatctgtctgcctctcctcccaaagtgtgagtcatcctacctggcctgttttttatttttaaaccataatttattgatttttttttttgagatggagtctcgcactgtcgcccgggctggagtgcgagtgcagtggtgtgatctcggctcactgcaagctccgccttccaggctcaagcaattctcctgcctcagcctcctgagtagctgggattacaggcgcccaccaccacgccgggctaattttttgtatttttagtagaaacgggtttcattatgttggccaggctggtcttgaacgcctgacctcgtatccacccgcctcagcctcccaaagtgctgggattacaggcatgagccaccacgcccagcccataatttattgattttttaaaatttgtccagccttctattaccacgtcgaatccattagctacagccatcccatgagaagctgagtggattcagccccacctcctgctcacagaccctgtccgagcacctcatttgtcccaacagcattactgcaggacccccaggacgttggactgccagctccctgggtctcctcctctctggggcagatcctcagtcctcccttgacttcacgactgtggccagatcatgtgtggactgtccctctctttgggtctccagagcgcttgcatcaaacacccctaactcagaagtgtgcagccacactgggactcagaacccaacaacagggacagaagactcacgcccttggggtgcccggtctcgtggcatcaggcatgacttccagctcctgcgccttccccagcaactgctgactggggacccagaccgggagctgagcgacgggcctggcgagcgaagctcggggtctcactcaggcaccagcccctccttgccccaggcttgagtgactcacaggtctgtcatgtcccgctggcccgggaaggcggggtctgggtgggaaggtgggcgggcaggtcagcagttcccaggcctggtgctggtcctccttgttggcggcgaggcggagacggggcgggcctgcctgttggcaagggtggggcgtccggcccagccaggcccttcctggccgggtggctcaggaacacagcctcttcctcttttttttcccctcctagccctattcaggcaggagctgctcttctggggtatcgcgatccacttaaggatgaggcagacttggtgacaagctggtctgagcaggtatgggagccccctggggagacggaagaagggaggaagttgccttctgcctggggagggtttgagagggagagggaagcctagggctcccaccaaggctgatattgacagccagggtttggggctgaagccaggaaccgtcgctctctctggttcttactggtagccctcatgggggtccctgacgccagagcctccaaggctgcatgtgccagcccagggctgcccacatacccatgtatatcccagaataggcaccagggtagggaacccaaactagcatgagtgacagagcaggtggtcagggagaaacagacatcaaacccagccaggagagagacaccgcaacagagagacagagaagggaaaccagagacgagagggaaagtgagacagagacggacagagcctcagagaggtaggaagtgagcccgaagggaaggtgacaggttgatagagaaaagcaggcagacagagcagaggaactcatgcctcaggatgcaaaagccacatggacagggcgtggagcaaggagccgagccctgcaaggtcaggtgagtgtgagacaaagataaactgagagaggggggctccagctggtgagatgaacaagaagggctccccagtggtggcaggggcatgggaaagagtccccatcacaggttgcaatggggatgatttggccatatctgagaccttttaaaatgcacacacccttcactgccgggagtttatcttaaagagaacatctcacaagtggggagacagagatgaacgaagatgttcctgtagttgctaatggaggcgaaaagcactggggtcttggaacaacatggtgaaaccccatctctccaaacaaattttaaaaattagcttggtagccgggcgcggtggctcacacctgtaattccagcactttgggaggctgaggtgggaggattacttgaggtcaggagtttgagaccagcctggccaacatggtgaaaccctgtctctactaaaagtacaaaaattagccgggtgtggtggcacgtgcctgtaatcctagctacttgggaggctgaggcaggataatctcttgagcctgggagacggaggttgcagtgaactgagatcaagccactgcactccagcctgggagacagagtgagactccatctcaaaaaaagaaaaaaaaaattagcttggtgtggcagcatgcaccttgtagtcccatctactcggaaggctgaggtgagagcatcacttgagcctggaaggtggaggttgcagtgagctgagatcacattactgccctccagcctgagcaacagaatgagactatcaaaaaaaaaaaaaaaaaaaagggggggggccgggcgcggtggctcacgcctgtagccccaactactcaggaggctgaggcaggagaatcacttgaacccggaaggcagaggttgcagtgagccaagatcacgccactgcactccagcctggtgacagagcaagactccatctcaaaaaaaaaaaaaaaaaaaaaaaaaaaggtagactaggccaggcgcagtgggtcaggcctataatatcccagcactggctgggcgcagtggctcacacctgtaatcccagcactttgggaggccaaggccggctgatcacctgaagtcaggagttcgagaccatcctggccaagatggtgaaaccctgtctctactaaaaaatataaaaattagctgggcgtggtggtgggtgcctgtaatcccagctactcgggaggctgaggcagggagttgcttgaacccaggaggctgaggttgcagtaagccgagatcacgccactgctctccagtctgggcgacagagtgagactctgtctcaaaaaaaaaaaaaaaaaaaaaaaaaaaaaaaaaaaaatcccagcactttgggaggctgaggtaggaagatcacttgagtccagcagtttgagaccagcctgggaaacatagaattcaggaggctgcagtgagctgtgatggcaccattgcactccagtctgggcgacagagcaagactttgtcccaaataaataaacaataaaagaataagcttgaccgcttgtgcactgttggcgagaacgtaaaatggtgcagtcaccatggagaccaatatgacacttcctcagaaaattaaaactagaactaccatatgatccagcaattccacttctgggtatatacccaaaagaactgaaagcaggggctgggcgctctggctcacgcctgtaatcccagcactttgagaggccgaggcgggcagatcacgaggtcaagagatgcatgaggctggggcaccagggctcattcctgcaatcccagcactttagcaggctgaggcaggagaattgcttgagcccaggagttcaagaccagcctgggcaacatagtgagaccttgtctctatttaaaaaaaaaaaaaaaaaaaaaaaaggacacggtggctcacacctgtaatcccagcactttgggaggccaaggtgggcagttcacctgaggtcaggagttcgagaccagcctgaccaacatgaagaaaccccatctctactaaaaatacaaaattagctgggcgtggtggagcgtgcctgtagtcccagctatttgggaggctgaggcaggagaatcgcttgaacctgggaggcagaggttgcagtaagccgagatcgcaccattgcactccagcccgggcagcaagagcgaaactccgtctcaaaaaaaaaaaaaaaaaaccagatggatggatgaatgaatgaatgaacaaaatgtggtctacccagatgcccagacaatggaatatgattcagccatgaaaaggaaagaaattctacagccgggtgcggtggctcacgcctgtaatcccagcattttgggaggccgaggcgggcagatcacgaggtcaggagatcaagaccattctggctaacatggtgaaaccccatctctactaaaaatacaaaaaattagccgggcgtgtggcaggcacctgtagtcccagctactcgggaggctgaggcaggagaatggcgtgaacccaggaggcggagttgcagtgagccgcgtttgcgccactgcactcagcctgggcgacagagtgagactccgtctcaaaaaaaaaaaaaaaattctgacatatgctccaacatgaatgacccttgaggacattttgctcagtgaaatgagccagtcacaaaaagacaaatactgtaggatttcacttttttttgagacggagtcttattgtcgcccaggctggagtgcagtggtgcgatcttggcttgatcttcacagagcaagactctgtctcaaaaacaatttttttttttggagacagagtctcactctgtcacccaggctggagtgcagtggtatgatctcgggaggtcactgggaggctggtgctgggcagcagctagtgccacttcctctgtcccatatttcagcgcctccagagccagaactgagcccagtgagagcgcaccctggggcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcgggtaagttcatcacttcagggaagccgtgcccctaaccaccatgagccaaagcccccatccctgcctgaccaggggtatgttctagagaagaggggagaagaagaggtgtggcacggagatgcagcgcaggcgcttgcctgctgctggcctcagtctcctcctctgtgaaacaggtgacatgtgggtgggatgagtcttttcctggggcatttccagtcccactgctttctgtgggctgcagtcagtgagccttaacactctgggccacaacagtgccagtcccctgggcccactgcctcctctcagggcagttggcactgagtcaggctggccttcctgatgtcccacagatactggctcgctgtgacatcatggtgctgcaggaggtggtggactcttccggcagcgccatcccgctcctgcttcgagaactcaatcggtgaggaagattctgtgggtctaatcaggggcacacccagaggcttgaggccctgaccccgcctccccttttcttggcagatttgatggctctgggccctacagcaccctgagcagcccccagctggggcgcagcacctacatggagacgtatgtgtacttctatcggtgagcacggagctggcagcgcagcagggtggggggcggtccttggccctaatgtgaggtaggctcattagtccccggggccacaggccccccatcctgggacagcctcacctgctttgcatgctttctcttctcaacaccttttattctgggctcttcccatcctcgacccccgccagagtgtccatagagcaggaggccttccttctataagcacaaatgtggggtccctcctcctctctcctgtgggagctgctggggctcagggtgtggctggccccctctatgaaagtggccagcaagggctgcagctcctgggaagaggctccgtggggaccacttatgggccttgggtagacccgatcttctaagtccctgggaggacaggctggcagggagccctttggagtcaggatccagagggcaagggaggctgcagggaaggagaactgattctctatataaataaaatgatatgacatctggtatgcgctccaaaattactgggtaggcagggtacagtggctcatgcctgtaatcccaacgctttgggaggctgaagcagcaggatcacttgaacccaagagttcaaggctgcagtgagctatgattgtgccagtgcactgcagcctgagcaacagagtgagaccatgtctcaaaaaaaaaaaaaaaaaaaaaaagaatgacatcaaagtgtccaaatgtcaaaatgtactatacccagtccgtggaatattattcagccagaaagaggaatgaagcacagacgtgccacagcatatggacgaacgcagaaaacattgatgagctgatttcattcatatgaaatatccagaataggcaaatgtacaagatagagaacagattaatggttgcaggggctggggggaggggagaatggagagtaactggtaatggatgttatgtttttattaggagtaatggataccaatgttttaaaattgattgtagaaatagttgcacagccttatgaatgtacaaaagaaccgtgttgtatacttgaagcaggtgaattttatggcatatgaattatgcctgatttttgaaagttctagagacaggttgggagggctgtgcccacattgccgctgttagtggagggcccctccctgagcgccgtttggcacttgcaagccaaaatcaaagacgtggggccactgctgcccatccctttgtcctcccaggtcacacaaaacacaggtcctgagttcctacgtgtacaacgatgaggatgacgtctttgcccgggagccatttgtggcccagttctctttgcccagcaatggtaggaagggaagggtgggcttggtatgtgggagcagaaggggagttctggctggctccactgggggcttcctcacccagacgggctagggggagaaggtccaggagtggatggcagccctcggtccctgggccttgcagtccttcccagcctggtgttggtcccgctgcacaccactcctaaggccgtagagaaggagctgaacgccctctacgatgtgtttctggaggtctcccagcactggcagagcaaggtaggcctgggcagtttgtacaggagggacaaggatagggtggcccagcggccagcctgatggctgctgtgtctctaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggtgaagggatggggctggcatgaggagggagggcagcagcagggtcacagggaagcccctcggccccgggcactgacactgccccaccacccattcccaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaaggtccagccaaggctggtcaaggcaacatctccacacagaaaatctgcaccagttatgtaagctaaaaagctgtgtgaacccaggtgtcccggaaaggggctgcaggacacagcaaaatgccagcagcatgccggacccctcccttccatcctcctctccaaagaagagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaagaaatggctgtaaactgagattacaaaaaaccagaggccttttgggagccacaggctgggggctggggccaacataccccagctctgggaccaaaagcctttggagtcctgtccctggatacagatgctcaggccacccacctagcactcctctcatttttgctgctcccccaaaagccagcgctgttctacaatagttcaggtcagacatctaagatccccaggccaaaccatgccacacacgtgtctgttccgaggtcttgttacaaatgaccaaaggttagcctagacctttggtcaggtggtgaaggccctgggaatgcaggttctagaaggggtgggggcatggggcccaggaggttgctagagataggaaatggggcaaatcgcaggtgacctcagcagtacctggatgattcccaccaaggaggaatggccaaaccagatgggtgagaacaagcccaatgtgatgcacacctacccttgctaaataaacgctgctggtcagcctctagcccacaagcccctcttggtccgcatgtgttgtaataagcaacacaactgtaggctgaccccagcctgggattgcaaggctttgctgcagctgtgcttcatgaaaagcacttcagtgtttttcaacctactgcctaggacctggggaggtccaagtcaagctccagagtagacaactgacataaggccaccagtcccagccctttgcagggtttgctgcctcatgagcagggctgagttgtcaacctgtttctgaagtgaaagggcaatgacccaaaggttcccagaggaagttccttccccgtcaagaatgtagatacaaagacataggtggacaggaagtagaatttattggtgagtattaagaggggggcagcacattggaagccctcatgagtgcagggcccgccacttgtccagagggccacgactggggatgtacttgaccccacagccatctgggatgagccgcttttcagccaccatgtcttcaaattcatcagcattgaacttggtgaagccccacttctttgagatgtggatctaaggagcaatggaaagaactgagtcaggaggcctggggcaaaggtgggagaagggggctgcagcactacataccttctggcggccaggaaacttgaacttggccctgcgcagggcctcaatcacatgctccttgttctgcagcttggtgcggatggacatgataacttggccaatgtgaaccctggccacagtgccctggggctttccaaaggcacctcgcatgcctgtttggagcctacattggggtagtgcaaggtcagaaacatgaacatccacctgaaaggcctgtctccaaggtcccttagagcaacccatacaaccaacaggctgcgtacactaccaaggaagctgctgtgtgcagccatcgcacactgggtccccatgaggaaaggaactcagtcggcttaattggctgcggagatcccaagaaccactgaaaaggcgccactgggctcctctgccagcttcagctacctgctggcaagatggttgtcattcagctaaaagcaagaagagctactcccatcaccagtgtttcccctaacctgtggggaagagcttgctaagacttactcatgctttgtttgtatctgcaggaaggggtcctgagtgaccactgaaagtcacttgccagcctggcttttctagtagccatagtggctgagtcactggggccacctctatgctctgataaaataatgcaagcctaataatgtagagactccaactgccttaaaaggcccagaccaagctcacctgtcagccccagcacaggacaacatcttgttgatgcggatgacgtggaaggggtggagccgcacccggatatggaagccatctttgccacaactttttaccatgtacttattggcacaaattcgggcagcctccagggctaggtagggagaagaaaagcagcaaagtgagagaagataatagagaaac

SEQ ID NO: 16610 - DNA, 16810 bp, Human
atcagctccttaattacgtggaaaaggtggcatagtggacgtaaaacagtttgtcacttgtttagtcctctagttaggtaatattggatgtgtgtttcaattttagagcaggtacactaagattattagtactcattgcaataaaattcttaactggaaaatcgctactaattcttaattggatcttttaagttttttacttaacctaagctttctcagtctatttttccctttgagtattccatcttaaagcatgttgtgtatttaatgtggcagctatgttgcaagtcttattttggtcttaatactcagtttccagatgtaatatattacaagtagaaaaagaaatctactttccagaatgaactttgttaaattttacagatattgtttggtttatgaggttgttcataacagatgcaaatttgaggaattatgtgtagaataccagaaagactttagtgtttggcaatttatttagataaattaagataaatccatagtacaagacataaaccaaggtggtcctctctgtgtgatgaagtagcatttttttcttttcttttttaaactttcctgtatttaaaatcttttacacaaaacacattcaattgtaattaggaaaaaaaacccaaatttttaagtgtccatagtcaaaagtatgcctggatttgtcttagtttttctctgaatttcttaagaaatctttgtattagcttttttatctacattaagatatattttgttggctgggcatggtggctcactcctgtaatcccagcactttgggagactcaggcaggtggatcacttgaggttaggagtttgagaccagccaggccaacatggtgaaaccccgtctctactaaaaatacaaaaattagccgggcgtggtggtgcacgcctgtagtcccagctacctgggaggctgaggcaggagaatcgcttgaacctgggaggcggaggttgcagtgagctgagatcatgccactgcactccagcctgggtgacagagtgagactccatctcaaaaaaatacatatatattttgttgattctgatgcattttagactaggaaattttatattttaccctgctctcctaaaatgaaacagtgaagacatcattgcaaacaaccttactcagccaaaaacaaaacaacaaaaaccctccaccctctgtatgttttactataactttaattctgttctttgttcatgtaattgctttggttgggaatctaagataaactcactttatgtttaatatcctattacaatcagatgttttaatgaattagtatttgttgtatgtgtgtgtgtgttataaattatttttaattagaaattgtagttatcttgagaccagtttaaaattttaacaattagaataagatgagaaaatgatatccagggtacagaataataatgccattggggtatacaagatcacattgatttgttctttaaatgtctttcagagtggtattttagtggcctaagaacaattgttgctttcctaaataagggttaatcttactttcataggatcaggtttaattggagaaattttgttgaaaacagaggaagttaaaatgaaataaaaggtggccgggcgcagtggctcacgcttgtaattccagcactttgggaggccaaggcggacagatcacctgaggtcaggagttcaagaccagcctgaccaatacgatgaaaccctgtctctactaagaatacaaaaattagccaggcatggtggcatgcgcctgtaatcccagctacttgggaggctgagacaggaaaatcgtttgaatctgggaggcggaagttgcagtgagctgagatcatgccattgcactccagcctgggcaacaagagcaaaactccatctaaaaaaaaaagaaagaaagaaagaaagaaaaggtgatgaattagatgataacacattagagccagagctaaaggaaaaattgctgataacgtatttttttcttgtgcagatacgtaggtaacctttccagagatgtgacagaagtccttatacttcagttgttcagtcagattggaccctgtaaaagctgtaaaatgataacagaggtaagatcttcccagttccatgtgctgacaattagcatgatgggttgattagcatgattttaaaatttcattgtaagcctcaagttattctggtggagagatttgtgttgtgttgacttattactttgatttggctgacaaactaggcttagaatggagttttatttaagagggcaaagtttccgtgctgttaagctcaaacggtcattcttcatggtgtggttatcttgaagtgattctgctttcagaacattattagagctcatttcagaatggtgaaaaattggaaagtatttcatacaattccaataagaatgttaacgatttagacagcatgtgttcatgtgcgagaacacgaagttattatgtgtgtagtgtgcagcaccgttcgtctcgtgtgtctgtagcaaatacttacctttttatactttcctgctaagactgtagcagcacccaattagtcatgttttaggcttttcttccttgtgtttttgttcattgatcagctttcttttttttttttggactatttcctatgtactagatactgcagtaagtgctagagatacactggtgaataaagatagttccttggcccagagaattttacagtttagtagggagacaaaggagttagcaggcacttaggaagtaggataataaatgctctagaagcagacaacttaaagtgctgtgggagcaaatgtgtatccagtgcagccttaggtcagtgagcggcttcttggaggactcactgcctaggcggaaaccttgaaaggatagtagtacatactggctagaaaggaattgagggaagaagggattccaaataaagggaactttgatccaggttggtagggagagcaggagtgcttgagacagagagggaaaaatagaacccgtagcatggttgtagttaaaatggaattagtcgtaagagatggcaggagtttatggaaagggctagaaactgtgctaaagagtttgttttatcctgaaacggagaactgttaaaaacctttaaagtgcattggccttttgattgtctttcccaagtaatgacaatcatcattttgttctggtgtattatatttttccttcctgcctttaattatttatttgtgctttcatcgatcaaaaatttcctttgcactaggcactatacaaggtactggagatataatggagagacagccaaatgagtttcccaagcaaatagggatgtaagccatgaagagaataaaacagagttctgtgatgattggagggttggtgctatataggctaggtgatgagagatgtcacctctttgagctgagatgaataacaagatggtgctatctatggtaagagctggaggcagaggaaacagcaaatacaagtcttgagttggtaatgaacttgtgtttgtggaatcaaagaccgatggctagagtctggtgagggatggaggggagttaagggaaatgagtctaacagcaggattcagaatcacaggacattatggtccatgacatagtttaggttttactctgattgctgtggcagaccagtggaggggcttaagcagggggatgaggtgccaagatttgcatatttaagcttactactctatgtagagaatgactgttttatggagaatagattgtagcgggcaagagcagaaggagaaaaaccatctggatttacttcactagtctaggtaagagatgatggaggcttattctcgaaagtgctagccgaagtcaagataaggacagaggttgatagatttggaatatattttggaggtagaattgataggactgggttggctgtgggacatagggaaaggaagaaatcaggaaataccctaagattcatgttaatgcagttgtatagttggtaatgctatttatttgctaaagtgggggtgacctgatggatgtcaccatggggagtggtgggaatcagaaattgtgttttggatgttagatttaagacatgaattagacatcaaagtggacgttagattaggcagttggataaagtagtttgcaactctagagagaccggtgctgaagcttgcagtggtatttgaatccatgaagccatgggactagatgagttcacagagagagaatgatggtaaagaagagcacagaggccgtgaggtctgagccctggacaagctcaacatttagagtttgagtaagggaagaaagatcctacagtgaggaaacaggaaaaccagagtgtggtaggagacagaagagaatgtttaaaggaggatggtggtcaactgtagtgaattctgcttggaagtaaagattaggatggaaaaggaatcacagaagcagcagagaggtcattgttgagctcaacatgcagtttcagtggcatggttagcttggaagctgacagaagtaggtttaggagagaacgggttgtgagaaagtggggaaagactcactagaaaatttttgagaaacatttgtaaagatttattttaactattttttaaaaccccatgtatacatacagctatttgaagggtagagggactcgaaatgaattttcataacatccatattctagaactcctagatttgagcttgtaaagtctcatatttctctgtcttgacatttatgtcatccaacaaaaattggtgacaacgctaaataaggtagggacataacggattttttttttttttttttaagagacagggtctgactctgtcctccaggctggagtgcagtggcgccatcatggctcactgcagcctccacctcctgggttcaagtgatcctcccacctcagtctcccaagtagctgggacagcaccgccacacctagttcatttttaaatgtgtttgtagagattggtttcaccatgttaccaatggtcccgaacttctggctggtcctaaactcctaggctcaagtgatcctcctgcctctgcctcatcctcctaaagtgctgagattataggcatgagacactgcacccagccataattgattttttttttttttttttttttttgagatggaatcttgctcttttgcccaggctggagtgcaatggcatgatctcggctcactgcagccttggcctcctgggttcaagtgattctcctgcctcagcctcccaagtagctgggactacaggtgcgtgccatcatgcccagctaatattttttatttttttattttttgtatttttaatagagacaaggtttcaccatattagccaggatggtcttgatcttctgacctcgtgaaccgcccacctcgccctcccaaagtgcttgggttacaggcgtgagcacttttttttgagacagagtctggctctgttgcccgggctggagtgcagtggcacgatcttggctcactgcaacctctgcctcccaggttcaaacgattctcctgcctcagcctcctgagtagctgggattacaggcgcccgccaccacacccagctaattttttgtatttttggtagagatgggggtctcaccatgttggtcaggctggtctcgaactcctgacctcaagtgatccagctgcctcagccttccaaagtgctgggattacaggtgtgagccactgcacccagcccataattgatttttaggatgtcacttggtggtgtaaataagaagcttccagagggtataaactctagcagagtatctagcagctatttatttttctttcataaatttcatttcagtatgtgaaaaatcctttttcccccatagttttatgattttttttttactttagatgttgttatcatagattctagctttccttatataatacaaatatatattattgattctaagtcaaatttttttagaattttaatatctgacagttgggatgtgacttagaaataagtggtgtcttaaattagatgatatgcagtgtgatgtgaatatataaaatatgtgatgtcagtgaatatatgtgtatatatacatgcacgtgcatacattgattgggagctggcctactattagatagatttgaaattggtattcacgagtagactagtttcctaaagtgtatgggattatcatagatctgctgttggacccctgtatgttttgctgtgattatcagtgttttccttagagaccattggggcaaaagagataggagtgaaaggaaaactcaactagcacaattttagcctcttatttattttgatgtcctttcttcaatgaatatttatggtaaatgtaataactcttttacaagaatttaaatgtgtgttttcatttgaagtcttcccccatttcctttctttacctcttaagaacagcattcacgtggctacaacagtaggattttgtatgagagcccatagttttgttgtcagtattaacgatcccactttttttccctcaaggaaatgccttctggttcctttgccactattgtttagacgtcttattttggatttttcttctaaaactttcctggaatgaaaaactgttgtggttgaaaagatctttattttatctggtatatttatcccttgtaagtccaactagaattccacattttaaatattattcttatagggcattttacattgaataatgatgaatgtttttagccttacataaaaatatgtatttgtacagttgtgcagctattcagtacaggttgcagtttcatagaaattcatttctagtttggttgtcaggtgagaatgttgctatagcttaggtagtactactttcttcacatctttataaatgtgttttaggtaactactgtcaagcacagggttgcagaatatatttaatatagattttttatatggtgttcttatgatgtaaacttatagctttgtcttggaatattttattcagatacattttcagaacctcttttcttgatcaccactgttatttctctgatctttggaagaccaaattcaaagtatatagaatcttcagtacattagactattttggaaggtagggaattcatttcagtagctggttataaagcttaagttttcttgtttttattttcattctttccatatccagaaaagaaatcaataaaattcagtctttgtagcagcatagaattccatcatttgtagtattgatcctaattttgatcagtagtttatgaagttggttcttgctgtatttctgtatcctgggataccacttatagaggattatgatgcataagtagaacgtaatttaaaaataatattggagaaggaaagtagtggtaaggagtggtcctcatcagatctgagtttgaggttttgtttggtttaatataatcttctattttatatttaacacacttcaccagaattctttattttcatttaatactgatgctcatgattctacaactgcttttatagttccgtttgagttcagcagtattctgaggtgcaaagtcaggtttagctttaaatcttatttaaaaagtgttaggctttcataagcttatgcagtctcaccttgtatattcccagctatcagtaatgttttttcctggattttcttctcagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggtaagataataggatgatggcaccttatgagtacatatatttgcatgtcaaactagtttgtattctttctaggcaaatttttgagcagatattcggctgctgagtgatggttttgctttattcagcttagtgcttttacaaaaataaccctgcttgataaatgatttaataagtggtaagtgttgtaactcatgacatgcctaataattttattaaatataatctttatttttaggaggtcaaagtaaactgggcaaccacaccaagtagccagaaaaaagatacttccagtaagtactcctgctgcattttactgtggaagagttctgaaattatccaggaggcattaccagcttaaataggtttttttttcctcctctagagttgccttaaaaaggttttagtggctgacttcttaagtatttgattaccaaatgctctgatttcagatcacttccatgtgtttgttggggatttgagtccagaaattacaacagaagatatcaaatcagcatttgccccctttggtaaaatatcgtaagtatcataatcagtactacactcagtcatgataggcagaattgtatatgattaacttgtaattgaattaagattttctttctctagttagtatggttttgttttgtttcttatttttcatttatttattttggtttgttttgagtagtggatgttgttgaaaatgttaatgtcatttcagtgtcttggggtctcgttttcatctaatcctgtgtataatatgttaaaaaaaatttaagtgattctgtttgttatctttgaagcagatgtttgaatggtaaaacttataaagtctagctttttgtcatatgttttcaaaatttgatggtttaggataatgagttaatcaaaagtaaatgtgatctatactgtgtaagagttcaataacttttataggaggaatttataaatgggggagagtaggtaaatccttggatatattgtgattaaattggaaatgttcatgttttattatgataaatgtgtttttgatattttagctataagtgaaaagtactattatactattaaaatgtttcaatgtatgagtcataaatgtgggattaattagatgtttttgttagtgatatttgattctactagttaagaggcaaatgtggtttgatttttaacaaatttatgctcagattttactgttgttacttggtaaaaaatatattggaaaactaaaaatggttatgaattgtagaaaatgtttatcataatttatctttctgattaaaatcagtttattttgtatatttcctgtagatttaaattaaacatcttagtactactttacaggaaagtgtttcaactaagaacaacaatattttctctatacaatttgttgttctatagatttaatttctttaaaagatgtaattcttaactttctgttttgatatttgctttgctttttaatctaaatgtggtaagtagtactattttaaaaatcaatataaaaataatacaggttgctgtttttcaatctttatttatacctgagacctgcagtttttcttaagtccaagtcacaattaaaagtaatagcattctggttattttgcagaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatgtatgcctttttaattcctattttttcctctttttcaattttttaatatttcatatattttgtatcactaggcagaagacatttaactatttagagattgcatggtaaagtagttagtattgttacagtaatttatagaatcagtaaaccttagaggacactagtaaatagaatattagaaagggaaactgttgttcctattaatcttcaaatttgagcatttagtttagaaagcacaggctatttgattaggttgcatgtttattacatgtttttgtcctactgcttttttctaacaggtaaagaagcattagggagagttcaggaatggttgtagttaattagggctaactggaattttattttaaaaatgctcacaatacagtgtgtgtggttccttttagtttttattttgagggtggctcttacttccctcatttagctgtgcttcttttcacagggatgcccgggtagttaaagacatggcaactggaaaatccaaaggctatggttttgtatctttttataacaaactggtacgttcttccatctcaatttatattttttaatactaaatttagtcattagttacttaatgtattgaatctgaaacttgaatatacttgaatgttaactacaaacacaacttttatgtaatgttatgtatgttttaataatagagtataatttcattcctctttcataaactcgaaaataaatagctagaaaaagaatgattatactataaggaagattattaaaattgtgtttgtacattggtaaaggtcagatggatttagaagtaaagcccaagtctaggacagatgagctaatctgagaatttagaggttaggtaaattatattcagttttaaccatgaaaatctcagttttaactctaccttttaaattattattcatactcttatataactgggatgtgaatgactacaacaaattatgtaaataaaaatttaagcaattcatcttgatttttgcatatattctttgtaaaaggggtaccaaagtaagcatttgcattaactgtaacattaaataataaagtgggctttgattttaaagcagtttcaataacttaaatcaatgttttgttttgttttgttttgtttttttgagatagagtctcgctctgttgcccaggctggagtccagtggtgccatctcagcccactgcaacctccacctcccgggttcaagcgatcgcgctgcctcagcctcctgagtagctgggattacaagcatgtgccaccacacccagctcatttttatatttttggtagagacatggtttcacttgggttcgccaggctagtctcaaacttctgatctcaagtgatcctcctgccttggcctcccaaagtgctgggattacaggtcatctacattttattgaagtggtaagataaagggccagagtattctgtttttgcttagattgaatctcaagttcaaatcgttttctaattggtaatagttcagtttcgttttgtttaggatatttagtaaattcatctactgatttgtatggaaccagcagcgccgatattttatttcatcttactgagtcttatttatcactcttttctttgtgattgtgctttcttttttatccataggatgcagaaaatgcgattgtgcatatgggcggtcagtggttgggtggtcgtcaaatccgaaccaattgggccactcgtaaaccacctgcacctaaaagtacacaagaaagtaagatatgtccactgtgtgtgttaaaattatattcttcacaaaatcatgtatcatgtattcatctagtctcaatttctaatttatttatgtaagagacagggtcttgctctgttgcccaggctggagtgcggtggcatgatcttagctcactgtagcctgaaactcctgggtataagtgatcctttcacctcagcctcctgagtaactgagactacagggacatgccaccatgcccagctaatttgtaatttttttatagagacagggtctggttacgttgtccaggctgacgtagtatttaattagtgttgcaagactctaattatttcattttatatttcattatctgaaaataattgggctgtggtataagtatttttggagctgtgaatcacctgattttatagatcaagtctgtgtcaaatcatagcatcaagaaaaattatgttttctcctcccattgaggcatatctttttttttttttttttttttttttgaggtggagtctcgctctgtcacccaggctggagtacagtggtgcgatctcagttcactgcaacctccgcctcgcaggttcaagcgattctcctgcctcagcctcctgagtggctggaattacaggcgtgtgccaccacacccagccaatttttgtatttttagtagagacagggtttcaccgtgttggtcaggctggtctcgaactcgtgacctcgtgatccacctgcctcagcctcccaaagtgctgggattacaggcgtgagccaccgtgccctgccttaatttttgtatttttagtagagacaggatttcgtcatgttggccaggctggtctcgaactcctgacctcaggtgatctgcccacctcagcctcccaaagtgctgggtgcccggcctgaggcatatcttaatagtatatagtaattaacagaagagtttcatagtacaatataacagtcaacgtttttgttttgtttctgcatacagacaacactaagcagttgagatttgaagatgtagtaaaccagtcaagtccaaaaaattgtactgtgtactgtggaggaattgcgtctgggttaacaggtacaatgtttggttttctaatcacctctgaggagcttcatcactgttcatatgaatttcatgatacacatcagccatgttttatttgtatgttttgttttatagatcagcttatgagacagacattctcaccatttggacaaattaggaaataagagttttcccagaaaagggctattcatttgtcaggtaacactctacttgaaatatcattattactcttatatttgattcattcctttcacttatgttctccagggtatcagtgtttgttattttagtgcttctttgcagtatagaagtttaagctacctacctaatgtactttagaaaaaaaataccaacttgcaggtgtaaactgatgagtttccatgttatttattgtgttaggttcttaaaaaataaaagacaaaaccatatcatttttctttcttagattttcaacccatgaaagtgcagcccatgccattgtttcggtgaacggtactacgattgaaggacatgtggttaaatgctattggggtaaagaatctcctgatatgactaaaaacttccaacaggtaattcgatttttcatagcattctttaaggtttccatcttacatgtcacataaaagctttggaaactctgtaaaatgaacaataaaataaagcatatagctactttcagttgattgtatttcaaaattgattatttgcggtattaactgaatcttaatactttcttttcacaggtgtcaccaccccaataaacttagacaatgataaataacagagtcctattcacataagggtgcttacttagtttttctcttccttgtctcccactctttcttcatatacggtgtttcttatgtgttccctaaaacaatactttgctttttcctaggttgactatagtcaatggggccaatggagccaagtgtatggaaacccacaacagtatggacagtatatggcaaatgggtggcaagtaccgccttatggagtatacgggcaaccatggaatcaacaaggatttggagtagagtaagttgtttgggtttttccagtatagaaacgtatggttctgacaaaataaataaaagtgtgttttcctagggagaatctattttaattatatacattgagctatttggcattatgagcattatagaaactaatctaacaaaatatgatttatgaggctaagaaattacttctcattacctaggtggaaaggggggattggggtaacatttagtgtgtcctatgatccctgtaagcagttggtagaatttgatttacatttctgatacacttttatttatttttgcatgtaaaagatctttgtccagatatattcaaaagtttgatggttttatgcctatgtggtatgtgtgagaaatctgaggtttgtgtgatacaaagtaactggccttttttttttttttttttcttttgttgatagagtggtttcctcctttgtaattcccctgcccagggccagcccatagctttattttcagatttcttcctttgagactgtttccaacatgaacttgtttttaaaatttcttatgtaatagatgatgtgttgaatcattcacaatttttaaaaaattagtttgcagatactcctcagacatcagtgtgttaagttgtggttatcttaaaaatatcaaagactaatactggaatatgtattctacacatatatcatttatttctttgatctttctatttgttgtaggtgtgttgatttctggttttctattctgtgattaggctctgcttgatttttgtgtaaatacatatgtgattttttttttcttgtgtttgctgaagattttttctttttcttccaagtcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttttttgtttttgtttttttttttttttttttttgctttacattacttggtatgtaaataccttgattaaaaccttgtaaaccaatttcaaggttactataagttgtatagtacaagtgttttttaaaaatcttggggtgtttttaaaaattaagatatattttgcccaagaatttttttaacaagattgctaaaaacatcttatttagacacttcaatgtaccaatttataattggatattcagtttaaatagtacacagagttgtggcttttattttcaattaatttttttccttgtgggcagtgtgcatggtataataagcctgagcagaggcttaagttgtatgtgtgcagagtttgtaaaggaatcaattggaagatgcagaagaccgaggtttgctttcaaggtatttttcaggctgtgtgggtaaaatttgcctcaaatttctatcaaacaggaatgtaaaatagataaaatcctatgtatttgaattgtcagagctagggagtgcaaatgttttggcaatgtattcaaaatgctggcctgggcaccaaagagaaaatagccttttacagttacatagtaagatgcgattagtacccacaaattactgttttctaaacatttgaagttttacgattagctttaaaataatgattttataaattggtggtcacaataattttggtattactttcctccttttcccacttagcaatatagccaaatgtattcaacataaaaattcatagggtctgaaattcatagctgggccaaattttttatggcaccttagttttaccataatggtcatctattacactcttctgttataaaatatacccttatttcttttgtttatagtatctttgaggaatgtttttggaaaagttaatttatattttatagggagaacactcaataaattatgttaactgtgcccccgagttaaaaattttatgagtatatgtgaaacttgaacaactgaagactttttttaattgataaaaatgcttagtatgcctgttttggtctgccagtaaattaagtagcttattgagataactaacagctaaatatagctgtagtgtttcctgactgtatattctatgatttaataaaattatccagactagttatattgccacagtaaacatgtgactgaagtgtccttcatcttaa

SEQ ID NO: 16611 - DNA, 16810 bp, Human; identical to SEQ ID NO: 16610

SEQ ID NO: 16612 - DNA, 40512 bp, Human
ctttgctcccccagctgtcctttgtcctgtcccaaagcctgggtccccctgctccaacagacccacccttctaggcctcgctgcctcccaccctccatgcttgacagagcagcttgtctgagcaggagggaaccatttcgtttctccctcaagggctgcagaggccactaagaggcagggacttgtccggaggcacccatttctgaaggggcagagaactcaagtcttggacccaagtccacggccacctaaacacaacaaccatttagcgactttgctaaaatatatttagagaatgaatgtggagctgacaactttcctcccttcctccatccctctctcctccactccctccctcccttccttcttccctccctccttccctcccttccttcttttctgtagtcaggacattagaaacaaacaaagccatcatcaaacacctttatcatttcacacagaaaaggacattttaacacccccaatagtaggaaagatataatctcaggtaaagagctgtcctgatccacagaatcttgtagaggttgtcgctcctggggagagacactgggcacctgagggacagaggtgtgaggaagactattacaccacactcccttttgtatgtcctgcactgtgccccacgtaaagaaacatagtgatctatttcaaagcaaaagcaaaacaagcaacccaagactgtccttcctctaccagcacagttcacttggtaaatatttcctagtcttccttctcgtttatttgtggactagtgaagaaaaccgcctaccagcccgtggcactgtgggcaggcggccacctgggaacccctggcctcctctcctcaattcattttaagttctgtgagaaaatagcccccacctttcatttctggcatctttctctgtgtttttctctccagccagacaacctggggttgcatcccagctcatccacttccttgcttgcttctttgtagcaaattatttatcgtctctgtgcctcagtttcctgatctgtaaaatggggcccttgaggaaactagcttgcaagtattgctgcaaagtttcgatgggatatagtaagtgctcagtaaatgtcaacttttctttttcttttttttttttttttgagacggagtttcactcttgttgcccatgctggagtgcaatggcgcaatctcggctcacggcaacctctacctccggggttcaagccattctcctgcctcagcctcctgagtagctgggattacacgcatgcaccaccacgcctggctaattttgtatttttaggtttctccacattggtcgggctggtctcaaactcccgacctcaggtgatctgcccgcctcggcctcccaaagtgctgggattacaggcgtgagccaccacgcctggcctcaactatttttaatagctatccgtcctcctttctgtgccctctacccttagcctggtgcctggcttggctcattccttagaaaatgtttatcactataaaatatatacttgagtgccagacatcatgctgaccctgaggaagactcagcccttgctttcaagaaatgcaccatccacctgactgaccctggaggaaaaagtcatttactttgcctcgagggagggtgcgggacagattgaggcagagtaggagggggagggcagctttacgcagaaatgtcaggccccagaggacacacaggggcttctggaagtggagaaaatcgatgacagggtctttgttttcgggctagggctgctgggccattttcttttttctggactttgcctagaaagtggagagtctagggaggctacaaataacagtttggcgttcttatttccttccctctagtagaaactggaaaccagtggccatctgttgtttagtccacttaaaagaggatgttgaggcttgttttttcttcggacccaagggtgctcgggagccctccagtctctgcctttctcacacaaggcgtctctgggaaggcagtggattgttggtctgcgtggaacttctcaggtggacaccagagcatggaacgtaaggaatcgcccccacccctttccatgtccgcagtttgcctgtcgccttggccctgggcggggcaggggctgggaagagtgtgctgtgaggacacagaggtgcacaggtgactgtggaagggccagtaggagcacttggctttctgtgagtcccgaaccctcgtgtgaaaacgccacgatgccctttctgagtggagccaaccctctgccaccagctttcctgctcctgacttggatgctggctattactatgattattgaaaaacttttttcacttttgatgttatttcctgctaactgcagttcaatcagatctctctggcaagggaattgcatgcaggtggggtagttattctcagcagctagatactggagccgataaacacttaagtaatatttagataccatgtttccatgacccagtttctctggagccttacacagatcaccagttgtaacaaaatgactctctgattctaaattgggaggactttttaaaaaatgtactacacttgatgtggtataggtgacaagaggttttaaataagttttgtggggtgtgtactttctttgaaacttcattacaaagtagagtattttaaaggagtacagtgtgtgtgtgcacgcctgtgcatgtgagttgtaccaaaccactttggaatttagggttaatatctctgccttttcctggactcgaatgtttaatagtctgtgagtttgggggagtacttaggacaaaccttctgaggatgtaagttgactctgctgttgaggaaactggatagtgagatattactaaaatattatttgacttggagaaattgtctatgcaggatgattacacagaccttcctgcaaattaacagcagaaatccatgctgtgagcattcatctccgatgagtgttacagatgccttttgagtatggatttccaaggaattaatgtctggagaaggtctctgttagatatgacatcatagcatctataaataatgcatcataaaataagctgcaagcaaccagccccagccatctgcactgtgatgcttcacccatccttgaaataatggcttttactgacgccagaagccacataggacagcataatcataaatggaaaacgcatatacattgtgtttgtgtgctggatgattccacctggtcttatgtgacttttttttttttttttttctgcatggattggactcttaacagttttctgttttttccccaaagtgtgattgttcttggtctcttaaaggctgttgtgttctggcctctgtgagtataaagatcagcagatataaaagctaaaaatggcagtagagcccttggtaaagagcgtgtactctggagcaggagtacctgggtttgggccgtgatttcccattttctagctgggacgcttgtaagttaccgtgcctcagtttcttcgtctgcaaagtggaaataatactaaccacgtcagtaggttattgtgagaactgaatcatttaattcaggtaaaagcttggaacggtacccagcacactgtaaatcatttgcaagtttttcttttttctttttatttttttgagacagagtcttgctctgtcaccaggctggagtgcagtggcttgatctcggctcactgcaacctccgcctcccaggttcaagcaatcctcctgcttcagcctcccgagtagctggaactacaggcgtgcaccaccacacctggctaattttttgtatttttagtatagatggggtttcagcacattggctaggatggtttcgatctcttgacctcgtgatctgcctgcctcagcctcccaaagtgctgggattacaggcgtgagccaccgcgccaaccttttttttttttttttttttgagacagagtctcgctctgtcacccaggctggagtgtagtggcacgatctcggctgactgcaacctccgcctcctgggttcaagcaattcttctgcctcagcctcccgagtagctgagactataggcacgtgctaccatgcctggctaatttttgtaattttagtagagacagggtttcatcgtattgttcaggctggtcttgaactcctgacctcgtgatccgcctgcctcggcctcccaaagtgctgggattacagacatgagccacagtgcctggccttttttatttatttatttatttatttatttatttatttatttatttatttattttaagacaggttcttgttttgttgctcaggctggagtgcagtggtatgatctcagctcactgcaacctccgcctcctgggttcaagtgattctcctgtctcagcctcccgtgtagctggggattacaggagtgcaccaccatacccggctaatttttgtattttttgtagagacgtggttttgccatgttgcccaggctggtcttgaatgcctggcctcaagtgatccacccacctcggcctcccaaagtgctgggattacaggtgtgagccaccatgcctggcccatctgaagtattaaccattattattagctaatgacagagtagtctgaaaataaatttgctgaaaaatacgtattttgcatgcaaaaaatttgaagatctaaaatgacgtaaagagcccaggagctaagaaaacaaaatgaaacaccaaaaacttttattcattgcaaaaatgttttacagctgaagtaaacaatgacaacaaaaataaaacagcatgataaaattgaaacaaacaaatatcacaagcaggtcttccctagctggagagatcgtaaagctgctggagaacatgcctgacattttttccacctattcatgtcagtcctgctttcttgtgtaatctgtctgaaatggaaacttttatcaatgaaaagggatagaagaatattgcaactttgtggatccaggtaccagaagttgggcagctgggaaatcttggttttgctttcttcttaagttcagaggtaaacctgctttgctattgagaaagagtatttatttcttctaatattactggactggttgtaacatttatttatgtatgtatatatgtatttatttacttacttactttaacctgcttccccttccaccttggttgttaacatttttttctttttttttttaaacttttttccctaagacggagtctctctctgtcacccaggctggagtgcagtggcgcaatctcagctcactgcaacttccgcctcccgggttcaaacaattctcctgcctcagcctcctgagtagctaggattacaggtgcgtgccaccatgcccggctaatttttgtattccatgttggccaggcaggttttgaactgacctcgtgatctggctgcctcagcctcctaaagtgctgggattataggcgtgagccactgtgcccggcctcttttctttttttatgatttttttttttttttttttgagacagcgtctggctctgtcacccaggctggagtgcagtggcgcaatatcggctcactgtagtttctgcttcctgggctcgagtgatccttccacctcagcctcctgaatagctgggcctacaggcccataccaccatgaccagctaatttttgtggtttttttggtttgtttgtttttgttttattttgttttgtttgagacagagtcttgccctgtcacccaggctggagtgcaatggtgccatctcggctcactgcaacctccacctcctgggttcaagtaattctcctgcctcagcctcccgagtagctgggattacaggtgcgcaccaccactccaggctaattgtttgtatctttagtagagacagggtttcaccatgttggccaggctgatctcgaactcctgactttgtgatctgcccacctcgtcctcccaaagtgctggtgtgagttgccacgcctggcctaatttttgtattttttgtggagacgggatttcaccatgttgcccaggctggtcttgaactcctgagctcaagcaatctgcctgccttggcctcccaaagtgctggtattacaggcatgagccaccgcgcccacgggtcgtaactgagctgagatggcttaggaattcattacttagtgtgtccctgagcaggggaccctgagttgcagaagtgccctcagcctaagggctatccctgtctgctcagtcatattggaggctggggatagtgacttggaaaagagagatgccactgggtgagtggagtttgcaaatgctgtctcatcaagatctgtctatactgatatcagtcaagatggatttgaaaagggtggggtgccatagccaaaagccttaaacttgaaagacagtcaggaagtcttagaaaaattcaaaccaacatttttggggaaaataaaaacttatgacagatagagagcaggtatctcagatagaaggatcttctattccacttatggggacagaaggtgagcaaaaaggcaagaaggaattgctctttatctagagcaccatagccagaaaaccaatacccatggctataaaaagcagctccatcttggcatactttctgacccgtccctgaaaactccatgctcttctgtaatagtgtcaattgttaacgtatttcatggcatatgatataagggagatcttagcccaggagaccatggaatggaagggcccatcggttttctaactatgttcccaggagccctgggattctgcagacatggccctggtgaggacagctgacctcccatacaggtcccagtattgggtccatccagtgattcattagctgcatcaccttggataggtcattctatcttctggatttttgcttcccagtctataaaatgaggtggtgggggaggtgggcctggaccacattagtgtgttttgagttgtaaaattttttgttcaaatgaaaacacatttgaacacataaacctaatatgcaaaaatgattagagtatgaaataaagggtgggggttggcaattgtctaacagtgaggtcagttcttttaactctcagacattttgttggctaaatggtaatctactgtgtgtatttatttgcaagacagcgtggcagtgaaaacccaaacatggtctggtttattatggaaaagaatgtcaagagttttggaatcctttcagaccaaggttgaaaacttatggccaaagtggttctgccatggcaagagaaatttgcagctgcctagattgttcctggaacagtgaacttgtgtctctagatttatttacttaagagaagatctgctggggaaatggagtaaactgtcaaactgtattctctgggcaaagagcagaagagtaaattagtggaatgcttggcagaatgaaccctgctgcagaaatttcttgtaataatgatcttttaattggatttatactttgttggaaagaaactcagtgttcaggagcttgccactgcagcatttacaaagagaacagggaactaatttaatatccacgaactggagggtcactttagaaaagcatcagctccatttggtgatgtgtttaagtgagtttccttcatggttagaggaaaggatttgtcccaaataattctcttacgtactctattgccaatgagcattgaagcatggtccctgctgggtttctgggtttctgctttattgatgattgattgattgagacagggtcttgctgtcatccaggctggagtacagtggcccaatcatggatcactgcagccttgaactcctgggctcaagctatcctcctgcctcagtctgtcaaatagctgggactaaaggcacatgccactatgcccagctaagttttgtattttttgtacacacaggatttcactatgttgcccaggctggtctcgaacacctgagcttgagtgatctgcccacctgggcctcccaaagtgctggggttataggtgtgaaccaccgtgcccagcctagtttttaaatattttatagagatggggtcccagtatgttgctcaggctggtcttgaactcctgagatcaagccatcctcctgtctcagcctcccaaggtgtttggattacaggcatgagccactgtgcccagctggcctggttctaatttagctcatgtcatctggtgaatgtctaaaatcctggtagtttccccaggtgcttggatttggagtcccaggggatcaagaagtcaacatgtattttgaccccccatagaacatcagagatcacaggagctgttactattaagtaagtccagtgtgctctgatacagattttctccaaaaccatttttagctgtgtggccccctagctgtttgcagcaattaatatttatgagactttatttaaaaaaatatatcatttagaggtggtttgctgtgctgatttatttatgtatttatttaatcagatggagtctcgctctgtcaccaggctggagtgcagtggtgcaatctcagctcactgcaacctccgcctcccgggttcaagcagttcgcctgccttagcctccctggtagctgggattacagacatccaccaccatgcccagcaaatttttgtatttttagtagagacagggtttcaccatgttggccatgatggtctcgatctcttgaccttgcaatctgcctgcctcggcctcccaaagtgctgggattacaggagtgagccacctcgcccggccttgctgatttcttaattaaaagtttattttctcctagatttgaacttttttttatagaaacatgtctctagctttggaaagaaaaaaagtcaatggggaaaaaagtgttagttatagaagtagtttgcttgatagatggttattttagagatgggaagaaaggagctcacatttgttgagcatctactgtgtcccaagtgtgctgctaggtgcctgatgtgcttccatttttgaatccttatgataacccaagagatgggggatgattttcaaatatacacaagaattttgcccaagatcctatagttttgaattggggaaactgggttttttgttttgttttgttttgtttcgtttgagtcagagtttcgctcttgtcacccagactagagtgcagtggcacgatcttggctcactgcaacctccgcctcccaggttcaaatgattcccctgcctcagcctcccaagtagctgggactacaggcacccaccaccacacccagctacttttttttatttttggtacagacggggtttcaccatgttggccaagctggtcttgaactcctgacctcaagtgatccacccgcctcagccccctaaagtgctaggattacaggcgtgagccaccgtgcccggccagaaactgggttttgaacctggccccatctgaagtgacattccatggttcttccttgactccaggaagggatcacatgccatagaatgaagcatgctttaattgttccctcctcctacaggcaagtggccaaagtgtgttatttggagattccctgttcctcccaggagacttctcagtgtcgtgagtcagagagtacagtggaagatgtgcagatgcaaagagttttcatccattttctctgtgcaccaaaatgtaagagggttgccaaaaacctcaggcatcaggataatgatatttatttatttatttatttatttattatcattatttttagatggaatcttgctctgtcgcccaggctggagtgcagtggtgtgatcttggctcactgcaacctccgcttcctgggttcaagcgtttctcctgcctcagcctctcaaggagctgggattacaggtgcatgccaccacacccaactaatttttatatttttagtagagatgaggtttcactcctgacctctggtgatctgcctgccttggcctcccaaagtgctgggattacaagtgtgagccactgcacccagcctataaatgatatttaatgcagtgttttaaaagatcaaaattaatgcagaaacatccgtaatgaacaaatatccgaagtttaaataaagtcaggaaaaataacagtgtgatgctgagccatattggactctgaagcaaaaggaaaaatcagcataaccgatcctgtctttatttaaaatttgggtattttgttcatcatggattttttagcataaattttgattttttgaaaaagtattgcctgaggaactgggcgcggtggctcatgcatgtaatcccagcactttgggaggccgaggtgggtggatcacctgaggtcaagagttcgagaccagcctggccaacatggtaaaaccccgtctctattaagaatacaaaaattagctgggtgcggtgggaatcacctataatctcagctacttgggaggctgaggcaggagaatcgcttgaatctaggaggcagaggttgcagtgagccgagactgtgctactgcactccagactgggaaacagagtgactctgtcaaaaacaaacaaacaaacaaaaagagctattgcctgaaatgacatttatcttgatgcctgggtattctggcaaccctctgacattttgcgccatcacgtgggtcccgtcctgcaatgagttttttaatctctgtgccagataatgagctaggtgctggagatacaagatgaggacacataggagccttcagactagtgggagtcagtcatgtaaatagtcacaacacagcaccataattctaagtctgtgcacaaagcgccatggggaagcagttgctgttgaatcaaggttctcttggaggagggtttgagtgcgacttgagggctgcctctgaattggccagtggacacaagagtaggggaaggatttggtgggaaacagcaggtcccttcatccctccgagcctcagtttacccccatctgtaaaatggaggaaatagtagtgcctgccttacagggttgtgtgacaagaatgagtccatcatgttaagcacctagaacagagcctgacgcataagtcggtgtatgtcagccgtgatggtgatggcagtgctgaccattgcatgcagatttcttaaaatgacagtgtctgttggccacatatgcagtctgaactttgctttgcagacatccacgacagcgatggcagttccagcagcagccaccagagcctcaagagcacagccaaatgggcggcatccctggagaatctgctggaagacccagaaggcgtgaaaagatttagggtttgtctttttcattgttaatcgggatggatgcagtgtgtgcagaagttcagatgcacacaggggagaaataggccagttcaacattgtctgtcagcgtagcactctctatgccagcttgagagttcagtactgtctatcccagcttgagggtgagactttctcatctgtcatgactgtgttggcaacgctgtcacagatgggtagcctgtttctggtttttgtgtagtgaggtgggaggggtacagggtgggaggagagagaagataccgtgcctattggtggagtctgtatgaggaattcccagctctgggtctctctgacgtgaaggcttgttctctcgtgcttgggggattctcagaatgcattgttgacagagtaagagaggctggcaatgagaacttggcgaagggacctccgagagcagggctgatggatggggaactgttgatcccatctagaaatagcttttctgaccagcagaagcccccggtgccagatggaggaccatatgtgaatttcaagaatgagtcctggttacttctgtctttaagtcttgggtcaggaataggatgagtcctcatgcagttggtgcctgttggagctcccagggagggagtggcaggtggtactaggcttctagttcctggtcgccaggccactgtgagcagtgtttgcaactcaggaggtctctgcacagcagagtagctggctgtgccatggactgcccaagatcggccataagaaaacacacatacctccaacttaaaatagtttgtatcatggtgtctttagacatacttaatgtgctttcttttcttttgtttaaaaaacagcctgattttagaggaatgtactttgtttaaacactgtctggaaggaaccaatatatcttccactttaatttactttttggtaatttattgtcagcttagaaatatgagtacattcctgcttcatttgtactcttctttacaatgtcaaaaccattaaggtcaaatgcatatgaaattatagctttaacattaaacatactcatttgtttttcagagtggggttttcgaagagtaactgaaccatgctcctctgttgaattttgccaaatcagtctttgaagggaaatgccatttgttttattttttttttaaagtagaatactgtgtgactctttttctttgtatccacaggaatttttaaaaaaggaattcagtgaagaaaatgttttgttttggctagcatgtgaagattttaagaaaatgcaagataagacgcaggtatttcctccactctgataatttttttcccttataaagttacaactgcctttccaatagattctgaagttgcctaaagaaacctgattcatattagttttgggggaagatttaagcttcagattaggtatcttgtgttgatcaaatattaatcatttttaaaagggtgagttaatccatttttaaatggagctgttcaaatggaccaatatttaaaataaaaataacaatttatgtcacttagagttcctcattgcatagaatttttttcttcatgaataagttatgaggatgttttccccacattttgacatgttagcattttggacgtggtaaaacgatacgcagatgtgtaatgataaaagcacaaggtgcatcagagggattgtcaattattcagtgtatcgtactgagcgtcccatagttggcgagcatcctgcagagaaagcctctgattgttctcctgggtagatgtgtcctctttgccttcattcccagtgtcagctggttgggtatgagggagggtagatgagattatggggaaggaggcctgtgccctgggtgggtttatgaggcctggccctgtatctttctaagaggctgctggctaaatgcctgcaggagccagtaagtcatgtgaatgaaggaggctcctggtgtgaggctggagggagtgttggggactggggccagctaaggacgttctgtctgcctgcacaggctgcagctggtggttcagggcctgtggctgtctgggcttcccctgcttcaggttccgtctccgccagcttactgatggtgatctcctagatctttgcttgccctgcgaccctggtggactttcttcccaaggcatgtcttatattccacctagtaccgcctgtttttctaaagaagctggacatttggatccttacgtgaaaccagatgatttttaaatgttggaactaattaaaaaaaaatttaaaaccttgcctaccaaacaaaacatacccatgggcagatgcggcttgcgcgttgccagtttttgaggcctcgtctccaaaagctggaatctatgggccagaagccgtgaagcgtttgcagacaactgcttggaaaatgtatatcatgggtttattcaaaggcctttccgggcgcagacacccatcctcctggatggcgcagcgcggccttttctccaccaccttcctctctggaggtggcaagggagtattctaagatggattctctttggcttgaacttcccaggcccacctcgaaagctgttactgggcgggacccttggattttgctttctggctttttctctcctctggatgacgttggccggagcctcctgggcagagaggggccccaggggaaagtgagaagcaggtggtgggggatgctttgggatgctaggattcaggctgagggccttcagaacaagagcctcattgttgtcctttgtctccagcaccgaggacagggcctggggaccaccatcgataaatgctagactgtgccaccgctgcgaccagcctcaccataaaatcctagctcagagtcaagcaagccaacagatgtccattcccctgccttattcttttgagtgttagaggtaggaggggcctgtgggtgggccggtccgcccctgcagtgtagacaaggaagtgaggtccccgcaccgtggcagagctaggacttgaactagctccctgaagtcacccgttgttgtctgcaccaccatgctgctctgtgcctccgttcagttgaattccccaaatctttgtgaagtgcctgcttggtgcccagcactgaacaggaaggcagcccagggacaggacaggtgagcggctccagggaacgggcacctcaaggggagcaagcctgtgcaagtgcaatgagtgtagagatgggaagcacatgtgtcgtgggagcaaggcgtgggcaacggggagggatccaggggaagtggctttttagctgagacttggcattgagattgggagggggttcccgggagcagggacagtgtgtgggcaggcagggctggcgacaagagctgagggaagaccagaagggctgaatggcatgtttgagggggaggccactgtgctgtgcttcaggctggcagggcagccacacctgggaatctgggtgccaaggtgagcagggctgggaaagcccctgtaggactttaatggagtggttggaaggagggggtcaaactttcaatgtgcctcttccagcctttcaggtcaggcaggtctggtgttgggttgccctgccctgtccacatcctacagagagagcttccgaatgggcagcccctttccatgcctgtacccctgacatccagcataggacttcttttccttttttgagacaaggtctgactctgttgcccaggctggagtgcagtggtgaggtcttggctcactgcagcctccgcctcctgggttcaggtgatcctcctgcctcagcctcccgagtagctgggattacaagtgtgtgctaccatgcttggctaatttttgtattttgaatagagacagggtttcaccatgtttgccaggctggtctagaacttctgacctcaagtgatccgcctgtcttggccttccaaagtgctgggattacaggtgtgagccactgtactcggcccagcataggacttcttgaaagtctgtgtccttaagcctggaatgcacccggcaattgctttagagcaatgaatgccaccctcccgtcactgcctgagaatgcagattgggtggaggcattggtgacacctggggtgtttggcctggagtgtttgggccccagtgtgagtcactgttcccattcgaagatgcagggatatgacttgagtggttaagcggcagctcgcccgaggctgggcacagtggctcacgcctgcaattataacactttgggaggtcaaggtgggtggatcacttgagcccaggagttcaagaccagtctgagcaacatggtgagaccttgtctctacaaaaaataccaaaaaaaaaaaaaaaattagctagacatgatggagtgcgcctgtagttgcccagggaggtcaaggctgcagtgaggtatgattgcgccactgcactccagcctggatgacaaagtgacaccctgtctcaacaaaaaaaaaaaagaattcagagccacatttctgactccaggcattccctagtgagtcccgctgcctaggaagtaaaaccagggagtaagctctaaattactacaaaaagtgtggaggaacataggcactgggagaagtcgcctaactgaatgtctttgtttttttttttttttttgagacggagtttcgctcttctcgcccaggctagagtgcagtggcacgatctctgctcactgcaatctccgcctcccgggttcaagtgattcttctgcctcagcctactgagtagctgggattacaggcatgtgccaccatgcccagctaatttttgtatttttagtagagatgggtttcaccatgttggcgaggttggtctcaaactcctgacctcagatgatccacccgcctcggcctttcaaagtgctgggactacagacgtgagccaccgcgcctggccagttctttttaatcctctgttgtgcacgtaacctaactggatttcacagtcaaacttatcacatctgttccagcagggagaccatgggaggatttttctctctccatcaactaaggctgttgaggagtcgatacaaatcccactctcgcctctgttgttttaataggacctgtgttggttcattccttgacgtggattatccagcattcaacaacttcacatatccatgtcatttacttgtccgtcttctgtgtggtttgtcttctggaatctgggagtggggggcctcttcttccccactgtctccgagggtctagacccatgcctgacacatggtgaacctccttcctctttgtaggatgaaggcattccatttcctggatccaagtcctcttctctcctgagtcattccctcattttgggaacagcacacgagaatgacttcttccctccagaatgactcatgagagaagagctcaaaacacagctggcaatagcttcctgagaaggggggtctggcaggtaggtatgtaaagaccttgttgagtggaaatgttatttttttccctactctcctacttcactggtaatctgacagagcatagaattctggggtgaaacacactcagaagtttgaagacattattccttagtcttctacttttgttgagaatcagtaatttatatgtaaactgttctgttttttttttttttctttttttccctctctgggatagtataggatctattttcttttctatttttcccctttcctcctttccttccttccttccttccttccttccttccttcctttctttccttccttcctttctttctttccttccttccttcctttctttctttttttttttaatggggtttcgctcttgttgcccaggctggagtgcaatggcatgatctcggctcactgcaacctctgtcttccaggttcaagcgattctcctacctcagcctcccaagtagctgggattacaggcaccctccaacacacccagctaattttgtatttttagtagagatggggtttcgccatgttggtcaggctgatctcaaactcctgacctcaggtgatccacctgccctggcctccctaagtgttgggattacaggtgtgaaccaccacgcccagcaattttcttttcttttctttttgagacagggtctcactctgtcacccaggctggaatatagtgaggtcacggctctttgcagcctggacctcctgggtttaagcagtctcaccatgttgcttaggctggtcccaaaagaaatcctctcgcctcagcctcccaaagtgctgggattacaggtgtgagccactccacctggtcaggatcttttcatcactagtattctaaaactgttcagtcaggggctttggaggcagaggcggagttcattcattgtgtgaattctttgtggagccatataatctggaaatttgtagttctgggaaatggtcttatgttgttattgttatcatcattttagtaactttttttccttccattgtctctggtctcttttccaatgatgacctttcacgccctgcattgagcccttaatttcatgttttattcttcctattttttaatttttttttttttttgcttttggagattttgactacatcttcagatcctcctattgagttttttctgcttttttatttttccagacaagggccctctagtctcttcctggggggccataagcctgatatgttcctgaactaaacatatttctaattaactgtgtcaggagaattttgctggcgcggggggtctatatttggaatttccctgaatccctttattcggttcggcgtctcattcttgccgtcctctgtgcctctctgttccggagcctccctgggtctgtttctttagataagaaaactcaactcttctgttgaaggtggcgggggagccacctgactgctcaagtttggagcaggacctggggtggaggacctgggggtctgatggcttctttctgccgccctcatcaattccgtctgggctacctgatgccctcgagctcctgccgtctccggacgcgcttctcgttggcaccccctccccacctgttcaggggcttggcttcattcttctgggtctctgcagagtcatctgctgtgtctccgactgcttctcatttcctgagccagttcttgaaaatattctcatatcatttattggatattttctttgcctcattctctttctgaaattgatgttagtaaagttagtgtcttgatcctttcattgtcctaggaattgtctcccacattccatctctggaagaagacggggtggagaggagccggaggccagcagacgggatgggggtggggagtggctacaggggatcgaagtttccagcttcccagagtaggggctacagggcctgccagccagaaggggaccactctgttcctttgtgttaattcaaggtgtcagtgggatgtccatgcccacattgctagaaaccaactggctacatgggtcagtagcttgggggagggttggtctgaaatctgggggggacatggagttagagttgtcaccaaggacagaagtctgggaaaccccagaattcacggaggggacagggagacaggagctgggggacagacagggagacagaagctgggagacagacacagggagacaggagctgggggacagacagggagacaggagctgggggacagacacagggagacaggagctggggggcagacagggagacaggagctgggagacagacagggagacaggagctgggagacagatacagggagacaggagctgggggacagatagggagacagaagctgggagacagacacagggagacaggagctgggggacagacagggagacaggagctgggggacagacagggagacaggagctgggagacagggagacaggagctgggggacagatacagggagacaggagctgggggacagacagggagacagaagctgggagacagacacagggagacaggagctgggggacagatacagggagacaggagctgggggacagatacagggagacaggagctggggacagacagggagacaggagctgggggacagacacagggagacaggagctgggggacagacacagggaggtgttggggatcctgagaggacagggctcttacaaggtgagggaagcgggaagagaagaaagtcgcaatgctgagcagggctggggccagctcactccagaggaaggtctgagaggcctcgctgcctgggcagcgtcagccggctggtggagcagcgctggctgggcggaagcctgtgtgtagcgtgaggaatgaatgggagggacaatggaggcaggggtgcatgcttttcttttaagagatttcaaaaaggaattggagactaggcacggtggctcacgcctgtaatcctagcactttgggaggctgaggcaggtggatcacttgaggctgggagttcgagagcagcctggccaacatggtgaaaccccgtctctactaaaaatacaaaaaattagccgggcgtggtggcggactcctgtaatcccagctactcgggaggttgaagcaggagaattgcttgaacccgggaggcagagcttgcagtgagccgagatcgcgccactgcactccagcctgggcgacagtgagactccatcttgaaaaaaaaaaagagggattgggggtggtgaggccattaacccccatgtagagagctgtggggtcaagggggatcttttattttccagtgggaaggttcgattggggagggcggggccagtgtgggaagcagcgctcttctgagctttgggcccctggtgactttgctgttcgtctgcatagaggtgcacttctggggctgataggaaagtgaatttgcttctcctgatcgtgcacctgcagggagccgggttcgagagctgacgtctggctgagcattgtcacagttgagccactgctgggcctcgaagaagggcctcagccttgtggggtgcctggaaggtgctcactggggtgcaggtgcttcctgggcagtccccgagttgatgggccaaggtggggccctctccagcacctgccaggacagcctcagatgctggacacttcaggtctccccagggagaaaggggctctctggtccaggctgtggccagccacatgtgtcagggccgtggaagagaagtcggccatccttccaggccacagacacagaatcaactccaccagctctgttcctacccggacagtagctagaatagggttaacaaagctctggaaaaatctatcaaaatagctccacagactgtttcttcttttctgctcatgttctcggcctagacaccaggccttcccgtgactggcttgtggtcgccgtctcagggtttcccttttcagtcatacttcctagctccgccgagataagctgagccctgcagctgctcacagtgggcatctggtcagccagggccttgaaccccacattgttctcacgcagactcaggagggacagccggtggaagagggcagggctgagaccctcaaagcttatatacctgcagtcactggaacctacttcctctcccccggcctcttctgccccacctcaaagactcaagccattcattgcacttctctatttcagaatcactcaagatatcctggattcatgtgtgtatgtgtgtgcgtgtgtgcacgtgtgtgcgtgtgtgtgtgcgtgtgaatgtcaaggggaggaggggaggtctaaagtgatttctgcccccagacctctgcatggagtttgctcatctgcctggccgaaattctcctttcatgaagtggctttaaaacaggaagtggttttccaaaagggttgcttcctgacggaatgggggtggtggagggaggctgtggcttcatggagctggtgggtcttggagaggacagcagggccagctcctaagtgccacccccttgggtctcgaggatggcccccagacctgtcccttagatagccacgcttgtctggagagactcctgtgtcactgagtctggcatcgattcattgctcctattgacagtgaagacatggctttcggtgttcacccaacctgggccgtctccctgcaagtgctggtgaggcttgctttctcgcagaacaggacatggccaggccgtggcttctcaggatcttttgtccccagtgccctgaactaaaaaagggctacccttccttcctttcatgccccagctatcaaaaccttctggtggtttccttaagggcagaaggtttgcagagcttgggatttcccaaaccaagccccacagcacatgcggagccccagttgggctcttggagagaaaggcagttttccaggccccccacacacatgtcatagctgtgtggctgcattttagaggcatttgttgtctgccttgctctgtagggtaaggtcatgctttagactctaacgttcagagaaacagccccgcttttgctgttggcgaggtatgagcacaggaagtctcctttctctaaaagaaaatcgagccctcaggggaagttctggaggagagggctcctgcgcctgcagccccgccctgaggcgcctgtcctgaagacacagttctcactgtgaagtcatctccttaccatcagtgagtgctcctgagccagcctcggttagtttcgggtgaaacaggaagccggtacctactcacggctcctgcttcccagcaggactgcactcgggacttgagggcgggcagcgagtgttttctccactgctgtgctcagtatctcgttagctaaaaggaaatgcaccctgcctgggaaggccgcataccgcacaacctggaggggccaatgtgtcttgcggaagtggaactgagcagaattcagaggccttggagccaaacagtcctaaggctcccggaagctctcagataagccatgccacctctcctgacctctgtgtcctcatggggaaagtggggctaacaagaaaatgccctttgctgcatgtccaggggattaaggaaatgggatccctccaagcaggtgcctgcagcccagtgggcgcttaataactggtagggatagtaggtgtgcatactttaacttgatttttttttttttttttttgagagacagtctcactctgtcacccaggctggagttcagtggtgcaatctcagctcactgcaacctctctttcctgggttcaagcaattctcctgcctcagcctcctgagtagctgagattacaggtttgcaccaccacgcctggctaatttttgtctttttactagagatggggtttcaccatgttggccaggctgctctcgaactcctgacctcaggtgatcaatctgcctcggcttcccaaagtgctgggattacaggcatgagccactgtgcccggccacaggatggctgtaaatggtactgagtgctctctgcgggccaggattctttctgtcatcacttctgaatggttaatgcagcaattttgttccaggagaagtggctgcaggcgcatgaaggggcgggggtaggggcttggcagtgcaggctctcccatatagaaattctctctggagtggcctgagagcccctgggctgtggggggtgcctttctcttgccacagcagctcctgtgggcctggctggaggggagagcagggctcaggccgggaaggctgtgtgtgcagatagcacaaggccccatctgtctcctccagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccaggtaacccgacttccctgcctgcaccttgatttgaaaacctacattaattccaggcctggaagaatttactgaaacacccgatgttagactccctggaaaccatctcatacggccgggcagaccgaggtacactgaggggccatggttggggagagtggggaccagaattctaagcttgagatttgccccacaggagtccccccaggcctgtttaatcttggtctacacacagtttagaccagtttatctgccttctcagtccagattagaggggaggctggagctatttgaggagcctgtactgagaaagcaacctataattgctgaaggtaagaatagacggaaaactccagaaagcaagcaggagaactcaaagtggcaggctgtttctgtgcaaatatccagacacctccacatacttctggtggcctaatgctgtaagctattaatagttcatcatgtagcccctgaggcataatgaaaaggttagcattgggcagcatattccatgtgaattctgattcacatttggctattgaaggagacttgcggagggcctcctggaagtggtgaatttgagccagtcggaaggacgcatgggcattgatttgcgctgggaaagggagtggaatgtatggtgaaaaggcagtttttgtgactgtagccatatgaggatatcgaccccaccctggacctcagaatcttgtcagagctccctagggcacttgaaagtgcagccagggttgcgaacctgtactgacctctgtgctctaggtattctcagtaatgacaacactaactaccatttcgcttttggttctgtgtttttgttctttttttttttttttttaataccaagtcttactctgtctcccaggatggagtgcagtggcttgatcttggttcactgcaacctccgcctcccaggttcaagcgattctcatgcctcagcctcctgagtagctggaattacaggcgcccaccaccacacacagttaatttttgtatttttagtagagacagggtttcaccatgttgactaggctagtctcgaactcctgacctcaagtgatccaccctccttggcctcccaaagtactgtgattacaggcgtgagccactgcacctggccttttcaggtttttttctttgaaacgaagtctcactctgttgcccaggctggagtgcagtggctcgatctcggctcactgccacctctgcctcctgagttaaagcgattctcctgcctcagcctccctaccagctgggattacaggcctacaccaccacgcccggctaattttttgtatttttagtagagacggggttttaccatgttgactaggctggtcccgaactcctggcctcaagtgatccgcccgcctcggcctcccaaagtgctgggattacaggcgtgagccaccacgcctggccctaactaccatttaggactgcccgtttgagcctgatgtcacacttggtgtgtattgtctcattttatctccaatgagtgttattattcccattttgctgatgagaaaagcaaggttcagagagattaagtgttttttttagcattaagtcatgcagggagcaaaagtgctggaagccagattccctcttgtccatctgccttcaaagaccatgctccccccatgaccatcatggcctgtgttgctctgccaggctcctgggcagcctcttgctgtttctcaaagctcggtgaggcccctggagcagagggattggaaaggctttgtgaatgcaggtcatcccacttcccaggactgcgggagccaaggtaggatgaggaatgggagagttctgactccatgcggtagcactgcaggctctgagagatccagcccgcctgcccaacagctcagaacggagctggaccttatgagtaggcgtgccccttagactcattcagtgggaggcttagccagcacagaaaggaagaaacacaggggacagaggctgattgttttttttttcttttttaatgacaaagaattttatttatttatttattttattttatttttgcgacaggatgtccctctgttgccctggttggagcacagtggcatgaacccggctcagtgcagccttggcctcccgggctcaagtgatcctcccacctcaacctcccaagtagctgagactacaggtgtgtgccaccatgcccagctaatttttgtattttttttgtagagatgaactttcgctatgttgcccaggctattcttgaactcctgagctcaggcgattctccagccttggactcccaaagtgttgggattacgggcaagagccaccaggcccagcctcagaaaaattttttaaaatagtttttatccaactgtaagcatcacacatgctcagcaaaagaaacttgggaaacaaaaatataaagaagaaatcatttctttattgcataattgcacacttggagataaccaccaaatagtattttatctgtagactttccatctttttttctataaatacacatatgcacatgcccctaacagatgtggcctaataagtgtaataataatgtatatgtttatgcacaccaaacagatgtgcagtccaaactgctgaatgtaaagcaagtactgttatactctgttgttaaaaatctattattggaaggctgggctcagtcgctcacgcctgtaaacccagcactttgggaggccaaggcgtgtggatcacctgaggtcaggagttccagagcagcctggccaagatagcgaaaccccatctctgctaaaaatacaaaaattagccaggcgtggtggtgggcgcctataatcccagttactcgggaggctgaggcaggagaactgcttaagcctgggaggctgaggctgcactgagccgagatagtgccactgcactccagcctgagcgacagagtgagactccacctcaaaaaaaaaaatttttttttaattgcatagagagaaagatccacgaactttcttcctaaggcataattgggtgaaaacaaggtatttggaatcagagccgatttcacagtgagtctccatgtgaagggcccctgtgttccgttttgctttgaaaactctgtctctccggggccttgctgtaactgtcaaaatgcgtgctcagcattagccccggtttttttcttgcaaaggctccctcgagagctctgttttcctaagtgaaggagattgaagctgaggggaacatgtttggagccacaagatttcacggaactttcaaaagcctctcccgcggctttggctttgctgagcactgctgggcttcatggtggagccgcagagcagccgctttcctgtgttcagcaccgccgcccccgaacttagcccctcatcaccacgtgcggctccgctgctctctgagcttctagtagggcagctctgactttgtagggcaccgctggaacctagaagaacgggaaaatcttccctgagccccaggctagatgagccaactcccatgcaccctgtttaaaggagagcttcaagagttttcagtcaggtcctgtttattcttggtttgcacacagttctaacaggtttttccattcatagcagatttgaagttgtggtagagactatggagtgatgagcagcaagaggtgatcactgacagctagggaggacacagaaatgacactgagtacaagcacagcaccgaggcctgagcctgggcgtggggacctccattgccacacgccgcaccatgggcatccctgtgctgtgggacagtgacatgataagtgagcctggtgaccccaaaccatcaagtagaagtgaaattgaggtcggcgtattatgtgaagagtgcattattcattttaatgagcacttcatcaaaaacattttttttggagacagtcctgttctgtcacccaggctggagtacaatggtgccatctctgctcactgcagcctctgcctcctggattcaagcgattctcctacctcagcctcctgagtagctgggattacaggcgtatgtcaccaggctaggctaatttttgtatttttagtagagatggcatttctccatgttgtccaggttggtctcaaactcctggcctcaagtgatccacccacctcggcctcccaaagtactgagattacaggtgtgagctactactgtgtccagccaaaggcatcctaagagaagcttgaggggcttaaagctttgctacctgggaaattcatgtaagtggcgagatggttctctgatttaattcagttctgcaagcttggtgtgcccagccctttggaggcaaagccaggagaggcgaaaggtggtgctgtgggcatttccctagtacgttagcctagagtcaaaggctgccgttggacaaatttaagttggaggaagcaggaaggaagggggttaccttacaaagaggtggtttcttcagggaattgcagttccttacagtgtcttttcttctttaaaaacatgtattacggccgggcgtggtggctcacacctgtaatcccagcactttgggaggccgaggcgggcagatcacaaggtcaggagatcgagaccatcctagctaacacggtgaaactccgtctctactaaaaatacaaaaaattagccaagtgtggtggtgggcgcctgtagtcccagctactcgggaggctgaggcaggagaatggcgtgaacccaggaggcagaggttgcagtgagccgagattgcaccattcaactctagcctgggtaacagagcgagactccatctcaaaaaacaaataaacaaaaatatctattcctaggagatttgattcagtccttgttggtctgctggtttgtggatttgttgttttattcattcctttatgctgcaattatgaactgaggccctactctgtaccagggactgtgctaggaactgtgtgtacaacagggaaatcagcatctgcccccacacggagggcagagaaagatcaatgctaagaaggaaatgcaacaggggatgagctgagaggtactggaagaggcctgctagggtctgtgctcaaggagggctccctggagaggtgactgggatctgaatggcaagcgggatctggatgagaggacctgggagccgggaccttccaaggagaggtgagcgcaaaggccccgaggcaggggcagcaggtgcgttagggggtcagcattgtaggaatgtagcacatgagggggtggtgaaagttcagttgggagggactggctgggtcaggccccgaggctgtggtagacagtttaattgcagggatgtgaacagtggctgtttatagaatgtgctggttgggctggtaaggcttggacctcttacagcctgagccccttggctcaggtccctagttcagggctgtgcccgtcccataccagttgggcaagagaaggcggatggcttggtgcagagccagctccgttattagaaagtcagccgtgaaaccctgacctcctgactgtggctcaccatttgtatggtgagtgggagtggcctgagctctgcccctcccctctccccccttccccctctccccctgcccatcactccctggatatggagatgccagattcatcactgttatcacagtgcatgcatgagcttggccctgagcaccagaggcagaagtgggggattctagtccagccctgccgctgtctgaccccaggagggttctgtttcttactgtggcttctgagtccccatctgtaacatggggctttgggcaaatactctgctacctctctgagctgcgctgccaagcagtctatgagcgttcaatgccctggtgttaaaaagtcactgataactacagccttatttccttagatctgactccccctgctgcccctaccccaacttctttgactttatttatatatatatttttgaggcagggtctcactctgtcacccaggctggagtacagtggtgtgatcttggctcactgtagccttgacctcctgggctcaagcaatcctcccacctcagcctcccaagtagctgatactacaggcgagcgtcaacatgctcagatttttttttttaattttttgtaaagatggggtctcactatgttgcccaggctggtctcaaactcctggcctcaagcaatcctcccatcttgacctcccaaagtgttgggattggaggcataagccactgtgcccggccttctttcactttagaatttagttactgtgagattgtggacaagacttgctccctctccgtgcctagcttttctcatttgtgaagtggaggttataataataaggtatttatgaactcctgacctcaagtgatctgcccacctcagcctcccaaagtgctgggattacaggcatgaaccactgcgccctgcctattttaattttttttatactgggtctccctctgtcatcgaggctggaatacagtggcaccatcatggctcactgtagccttgacctcccaggctcgatccatcctctaaccttagactgctgagtagctgggactataggcatgtgccaccacacttggctaatttttaaaatatatttttctagggatggggtcttactatgttgcccaggccggtcttgaactcctgggctcaagcaatcctccagccttggcttcctaaagtgctgctgtgattacaggtgtgagccacagtgtctggcctaaaattatcttaagttattgaattagtacatgcttattgttaagataaagaaaagaaaattcatgtgtccaggtgggtatgaagtgaaaagttaagatcccccagtcctgccgctccttctctcttcttagcaggaaatcgatgacgttattggtcctttcaggctgtactcaaacattgaagaatggaacacattgaagtctgctcagtgacttaaagttgttccatatgaaagatttaaaacaaaattctcctctggcacatttcttagccccagtttacacacctttcttgctcagaagcctttggtttaagttctatatacagcgcagcatggtctggaacagccatgagcttgatgaagatagaaaggtccagatcattgcacatggcagcttcgtggctttctcagtccatggaagagaagggcatgggtttggggttgtggggtgctcattcttcttccatgaatatcaggggtccccatgcctacacttaaaagcagattttgggccgggcacagtggctcatgcctataatcccagcactttgggaggccgaggcgggtggattagctgagttcaggagttcgagactagcctggccaacatggtgaaacttcgtctctacgaataatacaaaaaaattagccggacatggtggtgcacgcctgtattctcagctactcaggaggctgaggcaggaaaatcgcttgaacccgggaggtggaggttgcagtgagccgagatcgtgccattgcactccagcctaggtgacaagagcgaaactctgtctcaaaataaataaatacacaagcagagtttgcgtctgctagggtgccttcccgaggctttggatctggtgctaaactctagcctggaaaagcagagatgaggtggccttctccactcaaaaagaagtcctcagcctctggtgcttacaaaaaaaatggaaaaccagcagtttgggaggctgaggtgggcggatcacctgaggtcaggagtttgagaccagcctggccaacgtggtgaaaccccgtctctactaaaaatacaaaaagtagccggacatggttgcatgtgcctataatcccagctacttgggagtctgggtcgggagaatcaattgaacctggaagggagaggttgcactgagctgagatcatgccacagcactccagcctgggcaacagagtgagactctgtctcaaaaaaaaaaaaaaaaaaaaaagccttgggtgagatgctagtgctcccagccacatccttgacagagaaaggagccatgaatggggtccctttttagcaatgcagtttctttgagttttcccagaacgtaagaggggaaaaatgcttcctttttcaacgtaagtaagaggggtgggccagctattgagggcctcggagggtgagagaggggctgtccggcctgtggcagtcatttgggggcccattctctcccttgccccattatttctccaaacaggaccttggcctgagtgcccctgcatgaccatggtcccctctcctgggtggtggcagaggctgtggtggtggccagagccagggacttaggatgtgtcagtcttatgggtgccaggtgacatttgctccaaaagatcaaatgcagggaagaaatgggtattttccagcatgctccgctagaaagggcaggtgtggttttttgttcaaacagaagggaggttggctgtctgcgtacaccgtagccatctgcctcacgagggtcaggatgggaagggcagtattcgagatactttgagatgtttcttgcaactttaaaatggtatttggtgctgggcatggtggctcacgcctgtaatcccagcactttgggtggctgaggcgggaggatgacaaagtcaagagattgagaccagcctggctaacatggtgaaaccccgtctctactaaaaatacaaaaattagctgggtgtggtggcacgtgcctgtaattccagctacttgggaggctgaggcaggagagttgcttgaatcagggagttggaggttgcggtgagctgagatcgcgccgctgcactccagcctggcgacagagtgagactccgtctcaaaaaaaataaataaataaaagtatttgggggaagaggaggggagagtggcactcagaggagcattcaactccccttccgatggcaaaaggcaaaattaaaatgccttcacccccagcagaaagtgagtcatgtcatttgggcctggaatttgaatcgtgtggacggtagaaaaaagcggacaatccgctccacacgtgtgaccgccacacgcgtgaacccgtgagcttgggaggggatatcgtccaagcgaggtctctctgatcccgctggtgtccagactccttctggagttccaatcccacccctggcacactgtccatctctggctggtctgtcgtgaagctggagagccgtgcaaggcgacagagccttctgtgtggcccgtcctggcgctctggggcaagggctgacttgagctgcttcgtctgctcatctgctgtctgccagctgccctcagacctcctcctgggtgcagcccgttcccacttgagagggaggtggtcttcactttagggggtaggcacatccctgtttgcgccttgccccgacagcctcgtcaatgcccagccacttctgagggctggagggacaggaacttcctttcttccccctttctgtctcctcgcgtgggtacaaaagcacgtctgtagtccatgtgtgtgaagagaggacgcattctagagccgcaattcagagacggcggtgcttccaccttctttcagcgattttcatatacaagcgaaaccaagttcttaaagcagatatgatatcccgctaattaaactttcattgccttaaggaatgatttttttcttcctgtgctggattaaaataaaatggcagagggttttgaagagaagagaggatgcatgttttgtttaggtcttctgtacttgtcttctgagaagtgttaaaatatttattaggcttgaaacgcaatgaatggagacagtgacgcaatattcacagaggggccttcaaggctggttgaggtcctcgtttctgcacagatgagtatgcgtcagggggacgtcctttcctggagcggcacatttggaacagtctgaagttggggcactgcatggatatttttctttcaggaaggcaaatcctgctcagccatggcaatgtctgggatctggagaggaggtggcttggtgatataaagaccttgttctgcaggacggttgtgcagagttgcacatctgcaggaagcctccctcctcatttttgtccgagtctcacttccagcagcctgtaggattggatcccaaggcaacgatgctaaacagtttacagtccgggcgtgcagcttgcagatgtggggctgccaaaaccccaaagcttgctaagccgcagctgtcttggccaaaaaaaaaaaaaaaaaaaaaaaagatgcagaatgcagctcagccgccaacttgagttttccgcttcaccagcagccgtttgttggacggatggtggcctcagctctgttcccgtgtcttccactcacctgcggcctcctgcttagcccagatagctccattttcttctttctctgccttgtggacccttaaggagtctgaccgtgttgttcaggtgcccatcacagtccaaacctggtgaggtcatgtctccccctcagggatccctgcttgttggaactgtctgggacccctaggcccatctcattttctgtgtttgagccggggtgaggtgaaatcaacaagccaactggatgagcctccttggactgtcataagcaatgaccccaagtcaagtggcttcaaacagcagaaacgtattcgctcagcagaaacggattgaaaatatgacatcaaggtgttggcagggccctgttctccacaagactctggtgggtggtggcgagagggtgtggggtgtgcttacttgccccttcagcttacagactgctggtggctgccggcactccttagcgctccttggcacgtggctgcatcaccgatgtctccctctgccttcacacgccttcttccctcagtgtgtcccctcctcttctgataaggacacccagtccctggatttagggcctaccctaaatgcagtatgattttattttgagacccttatgcaaccctcttttcaaatgaggtccattctgagattcgaggtgaatgtaagtttgggggaacaccattcaccccactactgacctttggggacatattgtttctcacttagacacatggatacactcttaaagaatgtatttggagccgggcgtggtggctcatgcctgtaatcccggcactttgggaggcctaggagggtggatcacctgaggtcaggagtttgagaccagcctggtcaatgtggtgaaaccccgtctctacttagctgggtgtggtggcgcacacctgtaatcacagctactcaggaggcagaagcaggagaattgcttgaacccaggaggcggagtttgcagtgagccaagatcgtgccactgcactccagcctgggtgacagagtgggactccatctcaaaaaagcaaacaacaacaacaaaaaagaacgtatttgggatcattgtttttagatagggtgtgtttttaaaatttagtatcagtcatttaacattcacgggcagttttccatgttactctctttgcagccctcgtttttattgtcctgccatgcgagtggcagatggcctcatggttgggagtgggggctgcagagcctgccagggctggccttccgcccttctcttttgctcactgttatgggctgaactgtgctcccctccctaatccatatgttgaagtcctaatccccagaatgtgactttatttggagatagggctttaaaggggtaattaacattaaacgaggacattgaggtgagctctaacccaatctgactagtgtccttgtgagaagaggaggtaaggacacacgtgcaccggggagaccctgtgaagacgcagggagaaggtgtggtctacgagccgaggacagcggcctcaggagaaaccaaccctgatggcaccttgacttggacttctagcctccagaactgtgaggaacccctaagcccctcgtttcttcctctgtcaaatgggggtcttcagagcgctggagggagaactgaatgaaagaatgcccacacgctgcccagcgcagggctggagggcactgcagccgcgttggtactagccgggttcatttccccagcctctgctgctgcacagcgcacgatttctcttcagccactggtaaacacttactgggccccagtcacagctcttttccctgtgatagatgaggctctggccagtagctgggcacacgatctctggccactttcttggaagaaagttttaggtgcattctcttttttttttttttttgagacagggtctggctctatcacccaggatggagtgcagtggcgtgatcttagctcactgcagcctcaacctccgcgggcttaggtgatcctcccacctcagcctccttagtagctgggactacaggtgggtgccaccaagccctgctaatttttatatttttagtagagacaggattttgctatccgcccgcctcagcctcccaaagtgctggagtttcaggcatgagccaccgcacccggccttagttgcattctccatcctctaagtcacctttgctgagccccgtcccaggagcaccctgttgctgtgtgctcctgagccaggcccagggggtcgttggccggtggcagtcagaagtctgcccgtgcaccccatgtaaagcaatcaggcttcccacagcccaggcgcacgagggctttgggggcgacatcctctcctttctccagcctgtctgggtccaacagccacagctgcctcccagtcactgcagcagcacgggagatgggcaagggctctcagaggaggaaacctctgcctgagggacttctgcactcgtggggcatttcacacctgccccagtagggagtggcccttatgctcttaataaatagttcgcagccccctcccctcaggcttgctggcagccttgggatctcgggatctcggggtcgagtcctgccagcccggtgcagcccctgagcttcctcccagccgaagcagcctccttccctccccctcctcctctgccctgggtgcccccagcaccggccttttttcttctctactttgaagtctgagcctcagagccactacaggcaaacaggatgttcctctcccacatgcagacttcacacgagacgcttgggtcgcaccgcatcctgcttagagtggtgggtcccatctgcgtggacctggggtgggagtgggtacaggactgaggctgggtgccaggtgggaccttcgtgcaactggtttcattagtcacatttgagcgttcattgcagactttgaactaggtgagcctctgaaagtttccccttggggactcttgtgcctggaagggctgaataaggcagatggtgacgcttgcttagcacgtcggtgggaggccatgaaggagtaatggcgtttctcatcccccacctcagccctggctatgatttttgtattttctgggattaaaaaaaagtttgttttttttttctgtaaacctcagcaaattacaatcacacctggaattacaggatggctacaagatagatgactgctctagtgtggcacaggacaggggcttaaggaggcagggtcttgctgagcagctggaggactcgggcaagactagaagggcaccaggggatgggcaggcgctagtttaacagtttaaagaaaacctaaagtcccaggtctttctctgggttgtggactctgtttatagcacagtgactcaggcagttctgctgtggttgaagccatcttgggaagatgaaggtgtaaaatttgagggttccagttccctcctgaagcacctcccatcctccaagcagatgttctgagtcctttgagtccctcagatgtttgttttattttttatttttattttatttctttttttttgagacagagtctcactctgttgcccaggctggagtgcagtggtgtgatctcagctcactgcagcctttgcctcctgggttcaagtgattctttggcctcagcctcctgaatagctgggactacaggtgtgtgccaccacgctcggctaatttttgtatttttagtagagacggggtttcaccatattggccaggctggtcttgaactcctgacctcaagtgatccacctgcctccacctcccaaagtgctgggattacaggtgtgagccaccgcccccagcaccctcagatgtttaatttacaaaatagtgtatgtgtgttgggagagggcagccttaaaagatgtcagggttttaccatccacttgacaaccccgcctggcagtcagtgacattctagacatctctggaactttccacttggttgttccgtgtaccagggtgaaccatgtggatttttagttgcagagtgtactgcgagttaagtggaaaggtctgagagagagagaaatgaggggtgggaaagagatcatagcccttgacagctggaaaaggctttgtgcttctctttctctgcccctttcctggggcaagggaggagggcagatggcacaggattgggtagcagtgggggagaatgaatgctggtcacaaggactgtggcccagaaaagaggttcagtggcggccagaggaagctactgtgcctggggacagccctctgagcacctgccatgccggcgggggcagccgtctaatctggggcacttcagctctgtcgggtgtcctcttcgctcacctgacataccttagagttgtttcattctagggatgtgctccccagcctgtctgatggcacagatgttggcattctgcagctggctgctctattctttatttgggacctgttcccttgctaagattatagttttgctgccctgccctgcagtgagcacgcctcattttgactcctggtacaataataggtttgtttgagatctcggatgccagacttactgggagtcttaacaatgctggcatcatatgatatgtcagtgatctttttaacaccactgtctctacagaaatggtttctattcggctgtctcaagctcttggagaaatacatccttgtcttatctaggcaaataaagtggagagtcttgaaggacttcttggtacaagggtctgaatcagtgctgtgtgaatctatatttccgtggaaaataaaggcatatttgttcatgtgactgtctatatattccattgagattattgcataatgaccaaaaatctccaggaaatctgccttgtctagcagatgacttatttgagctttcttagtgtgttctttgcatgtgttagtattctttggcacatggtaggtattaatacatatctgatgggatgatttatggcctggattagcctcagccttcagactcttttttcttttcctccttagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggccacaaggtgaaacgtatcacactaccttttaccttgtaagtgtttgctctgcctctctggtgagtggacgcatgtccacaggtcacttggtaaattaactcaaacatgagttgatccggcaaacccaggctactgggggtatggcctgccagtcgccttttgggttaaatatttctcgagagcaagttcagtgctggaaaaagaaaatgaatcactgacagcctctaaagacttgggaagcttgtgtgtgagtgtcatcaaagggttattatttcttgtgcgtgggttggtcctggttttgaccacaacccatgacatttcatgcaacacagataaatagttcatcttgacagaaacaagatctcaaccaggaaggaaaaaaaacacaagtgggaaattgttcagggtccccatggcaactcaaggtgttgttgaatgggattgtagcacaggtgcgtactgaggttggagttggtggggctgttcccttctcctgtacccatcggggacacatcataatcctttcctctctgctcctgccctttgctgaacttgctaactctggcttgagacttcaacggggaaaagaaatgctgccttgaagcctgcccttcttgggtgaggaggctgtgaatggggcacgcttgggccaggcggggcacgcttgggccaggctgtccccgccagcccaggaactccacttttagagcagagcccaccagggccaaggtcaggctcagttccctttggtgaattgttcctgctatttgtagggggttgggtgctgccaccaggccttttccaggatgtttgctaagccctttctatttgtacaaagtgaccagcttctgttgcgtgtgagcctcccaactcagactttcctgtttgcaaaattcactaatgttgaaggtggctgtataatttatcaatcaaactaggacacttttgggagaaaagagggggtgatctcaataattagactaggataatgcctattacaagccctaatctggttctagtctgggtcagttaccctactgatggctgtcccccatatgagctcctgggcagccccccagattccctagcctcgctgtctagacactgtggtcaaatgtttcctgcccttccatccagggcctgggaaagggatggtcttcagggaaccgttcactgccaagcactaaataacccaacaacattcatcagaaacagcaaacacaggcttctccaccctcctcaggtacttcccagacaggcctactctgcgcctgtcttctctctgcctatttccagaacttaggaaggagacggttatgctgagaatgacacacaagggccccgtgatcagagaaattcagttcattgtcaagcagagcagattggtgcatttattatttatttttgagacagagtgtcgctctgttgcccaggctggagtgcagtggcatgatcttggctcactgcaacctatgcctcatgggttaaagcgattcttctgcctcagcctcctgattagctgggattacaggcatgcaccaccatgcctggctaatttttgtatttttagtagagacggggtttgaccatgttggtcaggctagtctcaaattcctgacctcgtgatcctcctgcctcggcctcccaaagtgctgggattacaggcatgagccaccgcgccaggcctattttttattttttgagatggagtctcactctgtctcccaggctggagtgcagtggcatgatctcaggtcactgcaacctccgcctcccaggttcaagcgattcttgtgcctcagcctcccaagtagctggaattacaggcacccac

SEQ ID NO: 16613 - DNA, 106315 bp, Human
gtcgcccaggttggggtgcaatggtgtgatcacagctcactgcaacctccgcctcccgggttcaggtgatcctcccatctcggcctcccaaagtgctgggattacaggcgtgagccaccgcgcccggcctacacctattttcttcaatgagtttttcactaaattccatagtgctcctaactttcatctgagaaagtattctaccactgatatttcctattataaccaaattcgctgaccaatctgctctgtaaaaaaaggtttgtgggtataaatgacgaaagtcagttcatggatcaaatccttcagttctgtcacattgtgagaggccactgttgtgaaagtaaaataacttctagttacggctctgctaagaatacgctgggggatgtcaggaagtcgctttatttgtaaaatgatgagttagaccagaatatattctctgatagaagtttacaaagatgaataaagatttataggctaggcgcggtggctcacgcctaaaatcccaacactttcggaagctgaggatccctagtgcacaggaattcgagatcagcctgggcaacctggtgagacccccttctctaccaaaaataaataaataaataaataataaatttttaaaatgtattagctgggcttggtgacgtactgaggcaggaggatgccttgagcccaggagttcaaggctgcagcgagccgtgatcatagcactgcactttggcatgggagatagagcaagaccttagctctaaaaaaaaaaaaaaaaaaaaattaatagatttataaagtccattctatggaggaaagtctcttattcagttatgaactgctgcgaacctaaaggcaggaaggcaaattcccttcagttcggcaaacacgaagaccccacattcgcgtcgtctgtgaagaaggcactccgaacctcaggcgctcactcgccaggtttaagaggatgagcaaagaataaaagtcctctcacccaggaagcgtttcgcttcccttagctggagccacgctccaaggtgccaaagcctaattgctgtccactctcaccaatccgttagcaagatgagcatctacctgctgcgaacgtggcggtgacactactacagctcccagcctgcctcccgcccgcccccactcctggactccacagaccgtgacttgtagtcccagcccacggctggcggcggtgcgggactcctgaaaactgcttttcctccctagtaggcggtgagaccgcaaattccatcagaatcctactctgacccactagggcttggcccgctcagagtcgcattccctcctccaaatgaaccaactctcctcccagcgatactccgacctctgagcaccccgggcggggccacgccccggaaatggagtcaggtctccaggccgcccgctgaagtgccttccagccactccaagcggggctggggccggcggggcgggcttgggggcgtggccgggaggcgggcggggatgcatctgcgggcgcagcgcttggggcggagccgcagcgcgaggccgcgcatctgggtggcggcggggacgcgcccgtggggagaggcggctgcggctgcggctgcggctgctggcggggggtgggggggaggaggaaccgggaagggggggcagggcgagcggagagctagctgtgttcctgaggcggcggcggcggcggcggcggcggcggcgtctccgacggaggaggagggcggggaaggaggatggagcaagctgggggttggggttggcgctagcgcagcggctcgcctggtactgtgggagagcggcggctgctcctggaagttgtggtgtcgggagcccagccggtgccgccgcagccgccgcctagggcggtggggaggaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatggtgagtctctcccctcgctgtcgcgttttcttgccggcgccggagcccatcgccgcctctcccggccgggccgccagtgctttgtgtacctctgtgaggagaggggcggagggggcgcgcaccagccgggtgagccgggtggtctcggaggccagcgggaggcgagagcgcctccccccgtggcctcctttcttctcccatgttcgcgacccccgcgcgggttcccgggacgcgaagggagcggccgcgcggccgagcccgcagcctgcaccgtggctcgcgaccacctattgtttaccgggccgggagccgtaggcaagtgaggtgcaggccgggggggggggctcgcgtttccacacctccccgcgcagttcgctcctcccaggagggtcgaggcaaggtatctggctgtgaccgggaggagtgcagatcgtggctgacagaggaacgggggtattgaggttggcactaactcctgggatccctttgctctagctggtctcaaagcgggcagggtaggacttaggccgtttctggggtcgcagtcatgatctccaacgcttgggaaaggattgcccataaggaatctcatgggtttacctaatttccatttacccgcgtcccgcttctcctctcctgaggcccaggtttgaggtggtcttggggtccgtgtgactataggttcaggggataagtgtgggtgggggaattatcctgaaggaagccagccgacttcggactccccaggggatattgccgaaggcggaggggatgtgactatcacttcctatccggggtgggggtggggaacttgggaacaatagtcctggtggggcggaggcgacgctacgggccgaagccctgaactgggagataaccttcccagcgcccccccgcctccgccaccccctactttccgccctctgcttgtgcaggcagtcttgagaggaggtgaaggttaaaagtcttgttcatgaaattgctctagatacactattgctttagcacactgtgagggggtcagatccgaaggcgtgagaccagaagtcgacttcctacgttacccacccccccaacccccgccctttttatttttctgctggacaatgttccctctagggttgtttcccggcttaggaggcggtggttgcggctgctgctcctacggatattgcgcaagactggggcgttggaaaccctgtaggtctggggaatgaaaaaggaagtgggactttgggaagtggttgctccttagtcttggcgggggttgggaatgggaaataagctggggaaaatttttatcttgggtaaggtacacctcgaagaataatcacttaattctgaaatctgattatgagaaggatacacagttaatgcctgtaaaatgaatgggcagcaaacattggctagtttttattttttgtttaaaaagtacagtagtttttatggtggaggtgatatgacttagtagtgaatactttttcacgttttaaagagactggtctagtaaagctttagcgttaaatttttaacagcttataaaataggcccttgaccatacacagtattatactagcatcgttgagctttgtgattcccgcctccccagaccaataatagaggacggaagtaaagttttctcagtatcttttgaagattgaaaatataagttaaataatctaacttattccttattaaaaataaaaatattgcttatatttaaacatttgctcttgatatttagcctatgtatttttgaaaaattactttttgatctgaaagggttaaggaaaacggcattttccctttttactattgagagtttttattgtcttggtatcttttgaatggtgtcatttacagcaattggatggagtcccttttttactactttctagcaaaagtagaagaaaatactttgaatatttaagatgtttaaaactagtttttttgggttttgttgtttggttggttggttggttggttttttttttgagacggagtctcgctctacgctctgtcgccccggctggagtgcagcggcgcaatctcagctcactgcaacctctgcctcccagattcaagcgatgctcctgcctcagcctcctgagtagctgagattataggcacgtgccaccacgcccggctaatttttgtccgaagtagccgggactacaggcgcaagctaccacgccctgctaattttgtatttttagtagagatggggtttcgccatatttgcaggctgctctcgaactcctcatctcaagtgatccatctgctttggcctcccaaagtgctgggattacaggcgtgagccaccatgcccggcctaaaactagttttttaccgtcttactttggttatggaagaagagatggtgtggtccctggtcatttcttgtttgcatgctagtcaccttgttatccctaggcatataccgtcaggaaggagcattgtttggtgatgcgggccatcaggacaggttgcccagcctctgaactcctgtactggagaagtggccttagggttcatgctttggggatgagtcagggattcctattggagagttcatttctttctttctttctttctttcttttttttttgagatgtaacacctcgctgtgtcgcccaggttggagtgcagtggctcaatctcggctcactgcatcctccacctcccaggttcaagcgattctcctgcctcagcctcctgagtagctgagattacaggcgcatgccaccacgcctggctaatttttgtatttttagtagagatgggatttcaccatattggccagactggtcttgaactttgatctgactgactttgtgatctgcccgcctcagcctcccaaagtgctaggattacaggcatgagccaccgagagttcatttctccaagagtaaatgagtttcctttttcttccatgatacctaggtatagctaggtgattctacattagagatttgatgactaaggctattcttttatagggctttttttttttttaatttcctgacttgataagcaatagctgtaattaagacagccggtagttggtgctgctttttcccctgactggaaggctggagaggaactatgttctcctggcatggaaagagaaaaaaaagattagcttatagattctattatttttaaattctgatgtcgattaaaaatgcattttaaattcttaacattttatgactgagccttagagataatgtagctgatataactgttccatcataaaataatgtttattccaaatttggaaattaatagaataataataatgccttacacttagaccacagttcaaatgaacactccacttgcctgactggtgatgatgctcttttcgctctatccagctgtcctacagtcctgtcatttaaaggctacctctgttaatattttttggttttgttttgttttgttgttttgttctgtttttgagacagggtctcactctgtcacccaggctggagtgcatggttgcgatcctggctcacggcagcgtcggtctccctgggctcaggtgatcctcccacttcagcctccagagtagctggggctatgggcccaccccaccaagccctgctgatttttgtattttttgtagagacagggtttccccatgttgcccaggctggtctcaaactcctgggctcaagcaatccacctgcctcagcctcaaagtgctggggttacaggtgtgagccaccgtagccggcctactacttggtaactatcttatatcttaattttgtttctttatgtttgagtatttaggtcattctactttctgctgttacatatagtaattctgtgattaacatttttgctgaaactgacatttttcactgttgcataagatagcttcccaggagtactaggtagacgtatataaacatttaatacatgttcataaacttgaaaaagttttgtcagtttatacaactgtcataatgtatgagtgttcatattataattttcttgatctttatttgatggttgaaaactgatatcttgttttaacttgaatttcttgattactattgaggatagaaattttccacctgtcattactattctatgagtgtctattcctggccttggttgtgccccatactgttaaagaggagacagctaaggtacccagactgtgcagaactatgttgcctagatggttatttgcatgttgaaaacatgctaattttgctaataaattagcaaatagctaatttgtggctgatccagaatttgatctcaattatctctacttttaatatttacaaaatgagagataaatgtataaagtagggtggtgcacattcatgtttgacagacctaggttttaactccacacagactccctctgatggctgggggttggggaggtggtcctggaccatactttgagaaccagtgagctaatacatggtaaatgataaaggtaatgctgggaaagttaggtagaggtctttttgtgaaggatcttacatctatgctatacttagattttattctacagaccgataatagcaattctggacagtctgcattgtaactcctagagacatggagaaagtagggaggtgttaagaaaatagacatgctggtccactccagcgtcattcccccatctcaccttctccagcctgctccttgagttgtactctgaaccttcacttacttagataggttctggtagaaaaggtgagaatcattagtctgggtttctggagcactactgagtcttttaagaaaggtaaacagtcatttgtgttttacaaagttgaatctgatagcagtatgaagggtggcattttggaagctgttgaaatataagaagtgagatgtgagggcctgaagtgaactgagatggggaaatagagtgtatacaacacatctgataagaattaagaaaggagtctcaatgattcattagatgtaggtagtaaagaagaaaagagtatagtgttatgactcgcaaaatatctagcttggtatctgtcacccaagctagagaataccatttggtagagtaaggagtgagggaggagaaacaagtagaggagaccaaacaacattgtaggaggaagtttcagggggagaagaggataaatttaattttcaacatgttaaaactgcggtgcctctgagacatccagtagaaatgtagagctcaagatttctgacaggacggagttaaagatgtaggcatcataatataagcatgtaggagatagtcgacagcatgggagtgaatgagcttattccaacaaacttatagagtgaccagctttaggttgaagaacatcagtcttaaaataacagccaaaagaaggatatactagtgattgttcctgagaaggtgtggtcaaggaggagggaggagaaccagagatgtcagaaaagccagggagagtttcaagaaaggagttattaccagagtcaaataatgctgggaggaccggtaaggtgaggttgagaaagtacctattccatttggcacataggagtgctttggtgactagaaaaaacagtttgggttggggtatgggaagaagctagattatagggtgaagggtgggtttagtgtctttccattttttttaacattttgaaagtagatggtaggagctagaggaagattggttgaaggagagtgtgccccttccactgccttttttttttttttttaaagagagaactagagaatatttttcttattatttcttgtctatgtgtatatcctctttagcctgggaagatcttatgttgcagtcttgataaatataaaaattttaatcatttgtttattcagtgttgtagcttataggtttaaaaaaactaataatagctttattgagatataagtacctaccataagatttattcatttaaagtctatgattcactagttttttattacattgatgaagttatgcaacaataaccataatcaattttaggacattttcttcactttctgtacccattagcagtcactccccgccttcccataagccccaggcaaccacaaatctaccttctgtttccatagatttaagtattctggacattttatataaatggaatcatacaatatgtggtgttttgtgactgactccacctaacatgatgatttcaagtttcatccatgttatagtattgatccgtagtacttttggcctttttatggctgaataatattctattgtatagataccacattttgtttatccattcatcgtgttgatgggtatttgaattgtttccactttttggctaatgtgaataatgcaactatgaacatttgtgtacaagtttctgtgtggacacattttcaggtctcttgggtatatatctaagtgtggaattgctcagtcacgtggtaacactatgtttaacattttgcggaactgccagactgttatccaaagctgctgcacatattacattccaatcaggaatatatgagggttccagttcctctacatcttcaccgatacttgttgctgtctttttgattataggcatcctactgggtgtgaagtggtatcttcttgtggttagcttgtaagattttgtgtgtcttaatttgtctttcaaagctagagtgataggaaatattttccagtccttgcatttgagctaatcttagtgcttacccagtgccactggtttagttatggttttcttatccatcctttgatgagtattcacctaaacatatttacatcaactaacttcagaagtggaagtgaacttttaagtaactctccagacatggttcactgagacagtaaactaaaaatttactttaagcattctcaagaatgttttactttatttactttcaaaatatattaacttttttccatcaatatttgatatttaacttggaaaaaggatttttaaaggatgaaactgaaagtaagacattaacatttaggtggctgtaggttttttgttcatatgttaaatacttctgtgtttctgtagcactgagttcattagattcataaatatttacatttctgtcttccccagactgaacgcctcccaggctagagactgggacttaattatccctgtatccccattgcttaatatagtgcttggcatttaataggcactaatgtccattgcatgtgcagacattgtagacaaacttaatgctgtaagacagatttattcttcaggtgaattcttcagtggtccaagggtttgtcttctagacgatcatgagaactgcttcttcccctcctacacagatgtgctcacataactcgttgtattttcagtatccactgaaaaagaaaatacaagataagagctacattgaattcaaatattttaaataaatatgattttattagctgcagtttcttaaggtaacttctgtatttgtgcatcccacacccaatggatcatactttgttgacattgtcttagagtattaataaaatgtcttttaaacttttggctttggacttaataaaatcaagatatcatgtcatcggtatctcttcaaaaatagtgaatttgtgggtatttagagagtgattacaagtgatatctgttgttctctacttgcctctagtttctttcctcatccagtccattcaacacatcatactcactttcaagtggcagcatctgtaggctaatggaaaccatactggttgtacaatcaggagatgtgggctgcactggaagcatggtttaatttttattattaaaaatataagttaaaaaaactcattgctccctttgatgaccattacaattattggaaattttaaatgtgtattttgaaagtcaattcaaaacatatgatccaagtgctgctcctttttcaaactgtaattatgtctgtctctctttccagagagatttgattccctgatttttcccttctcagctccctccaattttaaatatatatatatagttttttttaataattaaaaaaaaatacttcacctggaagttttcatccaattttgtaactttggtcctagttgagaatcacaggcctataggataaagtctgtacttcttagcctggcattccagaaccttcttaacataatgtcacagtacctttccagtgttaaacttctatactctggtatgtatcctctcttctttttgaaggaagctattcctggtccttgagcatacctactaaatgaatgaaatcttgcttatctgtggttgtactgttgaacatactttttccctcagaaagcttcccttttattttattttattttatttttttgagacaaagtcttgctttgttgccaggctggagtgcagtggcaccatctcagctcactgcaacctccgcctcctgggttcaagcaattctgctgcctcggtctcctgagtagctgggattacgggcgcccgtgaccacacacagctactttttttatttttagtagagatggggtttcaccatgttggccaggatggtctccccttttattttataaaccagtacttggaagatgagaaagctaaaaatttaaaatgacttcaccatgttcaccaaaaactcagaagcaaaaatgtgattaattctcaccttctagaataaatattttagcacagttaatcttaaagcactttttctcctttgtaaagtttgatctttaatatcacaagaaaaaaagcctttcattagatttgagttgaaaacttgataaggtaaatcaggtgatatgcaatttctaaaccactagtcttttccaaatatgagttgaactcctcttccagcattttatatttcctgtagtatttaagtttctttagattcatgcagtcaaaccttgacaattatctccttccttctgaaatcacacaaaaatcttgtttgcatttgtacagtattgtagggtctgtagctggcctatggcagatataagaagcaaacagtagttgctccctaaaagttttttttggagaaagtggagtgtggactgtattagtccattttcacactgctatgaagaactgcccgagactgggtaatttataaaggaaagaggtttaattgactcacagttcagcatggctggggaggcctcaggaaacttacgattgtggtggaaggtgaaggggaagcaaggcaccttcttcacaaggtggcaggaaggagaatgaacatgggaggaactaccaaacatttgtaaaaccatcagatcttgtgagaactcactatcaggagaacagcatgggggattataattacatagggattataattcaagatgagatttggtggggacacaaagcctagtcatatcgtggaccatgataatctcagaggctttgggaagtgtgctaatatctacatttcctgtaataacttttatatctaatcggcatttaaaaagctattttaacaacatttgagtgactgtcctgataggctctgaaggaatgcaaagatttgtctctgtcatccatccatggtctctgtcatccatccatggtctctatcatttatccattcatacagaaggtatttatggagatacctgagtgcccactatgccctaggtactgtgtttttgaattgacagttgaaaacatggcagtactctgttcaggaagtttactaactgaacagacctgtgagaagcagcgggacttttcctgggggcagtgggtgggcttcaggggaatctttgaacccttttaaattatatataatattttttgtgtgtaagcccattttagggggaagaaagttcatagctcttagtttctcaaggagtttgggtcccttagactagtggaaagataaggagtttaggagctatacagtcattaatttctatcctggccctgctgtgattctgagcagattatctagagaagttggggctctaatacatacctggaaagaacaagataatatatgtaaagtttctaacatagtatatagaaggtagtcaaaggaatttgagatgacatactgctccagtggaagtatattcggaatataagccagagagacaggagagcctaaatctgtctgaatagatcatggacagtttccacaaagatgctacatttgagctggtttttgaaggaagagtttgtcaggtgaactaggtgagtaaaaggcaacaacactttcaaagacttggagataaacagagatagaactgtgggttttagatgggaagaacagggtcagtgtgtataaaataagaaaatcttatgtacccaaataataggatttccaaaggaatatcagcttaaatgctattatgaaattggcctgtgttcctgagtgttttgatgaggagtgttttgatgttccattattatggcatagttgtttgatcttacagtaggaccttttaaaaattgagtccttgtcacatggtaaatgttcttaaatctggtaattttactttatctcaggtatataaagtagtactctctctgtttacacagttcttagatgactagattagtgtttctcattggcatctatcagatatgtttaaagtgccctgtagaaagaaattacatttaaaaagccttcaggactaaggcagcttatttataatggtgggtctcttgcttagtttggattcctcagcgaattgagttttccataagatgactctgaagaggttttgagactgcatttgtgaccagaaccaacgtgagaaaggaagggagttctaggtcacatgctacaaaaccatgaagaataacttctctagacaccttcttccccattgtgtatgttggttttactcctgacgtcataaactctttagtgttagaaggaacataaaaactgtttagaaattaaggagcttgttacaggtcttgccatagaaaggtggtggaactgggttagacccaagttaggaaagcagatgctttttatatgacatgatgctgcttaggccaacattttcagtcttagggaaaaagtcaataaagccccacttcctacccccctagagtagagcataaatatcctcaaaattacaaaaaaagttttctgtcagtatagatttttggttgcagcctacttccaaaaagtagcttaagtgaagaaagaatttattgcaatggaatactgcccttgagcaggttgaagcatcagaaccaagaaatagagagcctgggtgactcctctctccatgccagcctctttgtctttctatggttttcaagtttccatgtctctggggctgcttggatacttctctttgcttctctgcacacctgctttactattacctctctctgcattttgactttcactgttttggcctgcatgtgctgaataaagacatcccttatggtaatctaacctgtctcattcacttttatctcaaattatggaaagagctcagaatgactagaattgctacatcttgttttcaatttcctgaagaaaataaccaacttgccagtgagatgggtgttgtataaggtggtgagcttattcatatgtgtatggaaggaaggaactttttttagagaaaggaagggatggcttgataactaggcgggcagtccaaagagtgtctagtagagaatccttgaagcaaaattgaaaaaaaatttactattttaaggtttcagctccatatgaactccacccaccttctttcagagatggaaaaagcacaaagagtccttgtgacttgagagaacaatttgttggctctggcagagcattatttcacatttacagttagacattaaacatcaggcaaaattttaaggtttctgtgtagcaaactaaaattaagattatctataagctgcttatttatggtacctaaatttaaattataatttttcaacattaaaatatggaaccttcttgcaaggaaatcctgttttaaagtttgggtttttgtttgtttgttttttttttttttaagagatagggtcctgctttgtcacacaggctggagtgcagtggtgtaatcatagctcactgcagccctgacctcctgggctcaagtgatcctctcacctcactcctgagtagctaggactacaagcatgttgccaccatgtcctactaatttttttaccttttttgtagagacgaggtcttactatgttgcccagctggtctcagactcctggcctaaagcaatccttccatcttggctccccaagtgctgggattataggtgtgagcgactgtgcctggccctaaggatcacttttatcaaagtagtcactatgatttactccctgatcatatgtcagaaatatatcactatctgaaaaactaacatattttcttcacaataggttttgcattgttaaaattatcctaactatagttcttttagttcatgaatcatctaaaatttatgtgttactatattcattgtgtttgcctggctattagtgtgcctgtctttgtgcctgtgtgtctgcctgcctgcctttgtgcctccctttgaaattctatttgcctactcacctttctctacctactcagtcagttggttgtctgtgcccaagatttattaatgtgtgttaacgtgtgggtagtagagatagactggaaggtactttgtagtttagaaatgtctgtaatttacacctagttgtttgtaattcatctaatacggtaaatagattatacaaggggacttcaaaaagctcatggaaaaatggaattaagtaaataaatgttatttattaataaatttataaatagattaaaattaaaatataaagttaatttctgaacataaactccatcagtttacttttataagtgatgatacaccaaccattttgtttatccctaagaactgagggtcctagaaatttaaccatttcaatgcagtttttttacattattaactgaagagtaatgaatgccctttaaagatttttttgagattaggaaacaaaacgaaggcagaaggagccaaatcaggactgtaaggtggatgcctaatggcttcccatctgaactctcacaaaattgcccttgtttgatgagaggaatgagcaagaggcatttttgtgggtagaaaaggactctggtgacgctttcttggatgtttttctgctaaagatttggctgactttctcgaaacactctcataataagcagatgttgtctttccttggccctccagaaaaatcaacatgcataatgccttgagcatccccagaaactgttgccatgagctttgctcttgactggtccacttttgccttgactggaccactgccacctcttggtagattgctttgattgactttgtcttcaggatcatactggtaaagccatgtttcatctcctattacagtccttttaagaaatgcttcaggatcttgatcccacttgtttatttatttatttatttattatttttcattttgtttttgagatggagtctcgctctgtcacccaggctggggtgcaggggcatgatctctgctcactgcagtctccgcctcctgggttcaagcgattctccagcctcagcctcccaagtagctgggattacaggtgtgcgccaccacacccagctaatttttgtatttttagtatagacaaggttttgccatgttgtccaggctggtcttggactcctgacctcaggtaatccacccgccttggcctcccaaagtgctgagattacaggcatgacagtttaacatttccattgaaagctctgctcttgtctgtagctatctgggtgcaatcattttggcaccaattgagtggcaatttgttcagctttaatttttcagtcagaattgtgtaagctgagcaacttaagatgtctgtggtgttggctattgtttatgctgttaattgcaggttctcttcagttagggcaagtgacaagatgaatttttttctcaaaaatcaatgtggatggtctgctgctacaggtttcttcaacatcacgttgtcctttcttaaaaagaggcatccatttgtaagctgctgatatttggggcattgtccccataaactttgcttcaccattcttccatccaagctttgccataaatttgatgttttgttcttgcttcagttttttagcagaattcatgttgttctgataggggctcttttcaaactgatatcttatacttcttagtgcttcaaatgagatcctgttcatcagacatgttataagaagttagtatgagtttattttggtgcaaaacaaaattgaaatccatgcatagttttttccatggtacatattttccatgaactttctgaagaccccttgtatgaatgccaaggagaaacatagggtgggtggttattagtaataggattttgcaactgaaataattaaacatgttcagatatttatctccacacccattcactgacattattagatggtgcacaaaagtaaaaagtttattttaaaattactttataatttagatagaagattattaaaattcatttttaagaaacagagtctgtctctgttgctcaagcttgagtgcagtggcacaatcacagctcactgtagcctcaaactcctggactcaacagatccgcctgccttagcctcctaagtagataggactacaggcatgagccactgctccctggtggattacttttaaagtatgtttttttttttttgaaaatgcaacttaaactagaagtacaggatgaatatttaaccaatacatttaatttcttgtcattgctttattagatgctgtttttgtattgtttataaggtctcagcatcatatgtatgatattttcaaatatgttctaaaatgacctcatcatttatttctctagttgttaaagaaggtatagaggttttatcattttttaaaataggatgtaggttggattagatctataaattattattttgcctttaaaacaggttatagataaaagagggaaaggtaatctggtgatactactgggcaggaatctttaaattatttaaagagggtgtaaacgaaggaatgtacaaaagtaaaaataggcagggaagaaaagacctgatggaagtaacatatctttgttaggaatttgagtgtctagcattatagtggacagtccaatgatatggtttacaacagttatataggtattagacctggccattacttactatgtaatgttgagtacatgatttgaaccactctcaatcttagcttctttatcgttaaaacagaaatagtttgtaatgtttgaattagtaagaataaaggacacagtgtcagatgtgtcagaaggaagcatgattagggcattaagtgagaagttaaataaataggaggggaaaaaggccaccccttgctctttttctcttttggacctttttggtgacagagacagaaagaatgtgtatagtatatttaattatctgaaaatacagagctgagcatccctaatctgaagtttaaaatgcccctacatccaaaattttttgagtgccattatggtctgagagcagacattgtgtatgattgctgttttaaatttgttgaggtgtgtttaatggcccagaatttggtctgtcttgttgaatgtttcatgtaaacttgagaagaatgtgtattctgtagttgttgtcttaggtagtctatagacgtgcattatatatccagttgattgatgatgctgttaagttcatctgtgtccttactcatttcctgcttgcttgatctgtccatttctgatagaggagtacggaagtcttcaactataatagtggattcaaatatttctccttgcagttctatcagttttggctcacatatttttatgcacaattgttagacacatatggattaaggattatgctgtcttcttggagaactgacccctttatcatgatgtaaagccaccctatccctgataactttacttgccatgaaatctgctttatctgaaattaataactagtctcattttatttttgtgttagctgatatatttttttccatccatttgcttttaatctgtgtgtgtttgtatatttaaagtggatctcttgtagacagcatatagttaggtcttggtttttaatccactctgacaatcttttaattggtacatttagaccattcacgttcagagtgattactgatagcattggattaatgtctaccatatttgccactattttctgttgtcattgttctttgttcctatttttttttttgtcttccactgtttttctgccttttgcagttttaattcaaaatatcatatgactgtcctttcttagcatgtcagttttacttcttttttttttactttttttgtttttggtcttttctaaagagacaaggtgtcgcttagttgcttaggctggaatgcagtggcatgtcatagctcactgtaacctcaaacttctgggctcacgtgatcctcctgcctcagtctcctgagtagctaggactacaagtgtgtgccaccaaccctcaagtaatgttttttattttttgtagagagaaggtcttaccatgttgcccaggctgtcaaactcctggcctcaagcaatcctcctgccttggcttcccaaagtattgggattataggcatgagccactgtgcccagctgggtgttttcacttttttaagtggttgctctggcatttgcaatgtatatttccagcaaatccaagtccattttcaggtaacactgtaccactttatggatggtgagattactttataatgacaaagtaaccctaattctatcccttgtatcattgctggcattatctcacttacaaataaacatacacacacaagcatatataaccaaatacatgtttgctgctattctgaataaacgtatcagatcaattaataagaaaaataaaagttttaattttactttcatttattctttctctcatttcttcttcctttctttatgtagatgtgaattccagactagaataatttgtcttctctctaaaaaatttattttaacatttctcacaaggtaggtctgtggcaacagattctcttaatcttttctgggggacagggtcttgctctgtctgtcatccaggctataatgcggtggcatgatcatggcacactgcagccttgacctgctgggctcaaccagtccttttgccctagcctccggagtagcagagactacaggcatgcaccgccatactcacttaagtttttttttgtttctgtttttgtagaaacgaggtctcactgtgttgcccaggttggtcttgaactcctgggctcaaaccatccacccacctcagcctcccaaagcattaggactacaggcatgaaccaccttgcccagccttaatttttgtttgttgagaaagtttttatttctctttggtttttgaaggataattttgcaaggttcaggattctaagttggtgggttttttcttctcaatatgatattttgtcactctcttcttgcttgcctagtttctgaaacagagtcagatgtaattcttattatacttgctcctctttaggtaagatgattttttttcctctggctttttaaacgatttgtttatcttttttttttttttgtagtttgaaagtgatatgcctacataagttatttctggcatttattctgatcagtgttctctgagctgcttggatctgtggtttggtttctgacattaatttggggaaattttcaatcattatttcaaatatttcttctgttcccttcttctctttctgttattacccttatgcatatttacatctcttgtagttgtccccacagtttttgcatattccattctgttgtttcagtttttttctagtctttttaatctcttttcagttttggaagcttttattgagatatcctcaagttgagagattctttcctcagccatgtctagtctactagtaagcccaccaacaacattcttcatttttgttacagttttttaaaaaaatctctagcgtttcttaggccgggcacggtggctcacgcctgtaatcccaggactttgggaggcagaggtgggtggatcgtgaggtcatgagatcgagaccatcctggctaacacggtgaaaccccatctctactaaaaatacaaaaaaattagctgggcgtggtggtgggcgcctgtagtcccagctactggggaggctgaggcaggagaatgtcgtgaacccaggaggcggagcttgcagtgagccgagatcacaccattgcactccagcctgggcgacagggcgagactccgtctcaaaaaaaaaaaatctctagtgtttctttttggttatttctttgaatttctgtctctttgcttatattgattgcccatctattctggcatactgtctactttatctgttagagttcttaggatattaatcatagggtgtttgtttgtttgtttgtttgtttgtgtgaaacagggttttgctttgtctcccaggctggagtgcagtgatacaatcatagctaactgcaacctccgcctcctgggctcaagcaatcctcccacctcagcctccccagtagctgggatcacaggcatgtgtgaacatgcctggctaagttttcatatttttttgtagagaaggggtttcgtcatgttgcccaggctggtctcgaactcctgggctgaagagacctgcctacctctgcctcccaaagtgctgggattacaggcatgagccacccagagccaaggtctcagtcttttagtgagcttgtttatggattttgaactatatcctgtttctcagcgcctcacccccaggatggcttgaatgacctgtagttgggtatttcccttacctcatgtaaataaggctctgttaaaaccccagcaggttaggctcaggttaaatcatttctccgcagggcagaccttgttaagaagaatggaatattcggccaggcacagtggctcacacctgtaatcccagcactttgggaggctgaggctggtggatcacaaggtcaagagatagagaccatcctggccaacatggtgaaaccccgtctctaataaaaattagctgagtgttcctgtagtcccagctactcgggaggctgaggcaggagaatcacttgaacccgggaggtggaggttgcagtgatccgagaccgcaccactgcactccagcctggtgacagagcaagactccatctcaaaaataaaaaataaaaatacaaaaaaagggattttctctaatacttactatgagaacctggtagagctcctggaggtaaaacaaaaatgtggggtcccctttggattgggtacaccaggagtttttgtttgtttgtttgtttttgtttgttttttttttagagcggtctcgctgttgtccaggctggagtgcaacggcacagccttggcacactgcagcctcaacctcgtggcctcatgtgatcctcccacctcagcctccctagtagctgggactacagatgtatgcaaccacacttatctatttttaaattttttgtagaggtggggtctcactgtgtttgcctaggctggtctcgaacccctgggctcaagaggtcctcccgcttccacctcccagagtacttggattacaagtatgagccactgcatccagcctcccctggagattttaaccctcatagttgttcacactgagcctctagcagttcatcaattacagttcaggtttcttatggaagtttgctgtgtgagtgtttctgctctgattactcgtgattctccgtattcaccttctgtctctccagtttgggggcagctgtttgacctgtgacttaacttctcttacagatctaagaaaagttgttgatttttcagtttgtttagctttttacttgctcttaagattgagtgacagatttttttttgcatttttttattgtgataaaatgtattaatacaaaacatttatcatttaagtgtacagttctgtggcattagatacattcacactgtgcaattaggactcttaaaaggaaaaagtcacatactgttagaagggtcatacaaggctttatagaaaggatttttaagatgagcttctatatatcaattaaaagaacatttcagtagaaacatgggcgtatggtatgataattaccagaagacaaatgcaaataagtgctgaacacaggaaaaaaataatcaacctctccaataatcagaaaaattgaagttaatcatcattaactgttgggggagtagctaccaaatttgataaaaactcaaaaattcgtaataattcagaaattgagaatagcggccgggcgtggtggctcacacctgtaattctagcactttgggaggctgaggcgggcagatcacgtgagctcagaagttcgagaccagcctggccaacatggcgaaaccccatctctactaaaaatagaaaaattagctgggcctggtggtgggcgcgtgtaatcccagctattcgggaggctgaggcaggagaatcgcttgaacccatgaggtggaggttgcagtcagccaagatcacgccactgcactccagcctgggcaatagagcaagactccatctcaaaaaaaaaaaaaaaaagaaaaagaaaaaagaaagaaaaagaaaatggtaaggatatagaaaactagtgtttctaggtccattaaggggagggtaaactggtgaagcctgttttggaaggcagtttggccacttctaatagaattgataaatgtacatactctttgatccagcatgtcaactttagggatctttccgtaaaaatacttgcatatgtgcataaaatagtatgtccaagtatgcaacaatttttgtgaaacaacctaaaatagctattagtaaggagactttgcataactggttacctaaaaggaaacagatgtggaggggagagagtttggctttttcattttatacctgtatgcagaaaagagtaacatagcaggcctaagactactatccttagaaaggcctgcttacaatgttatcccttggctggtgtctgggaacttagacttttgggagaatttccattatcccctgataagagtggttcactgtgcccaaactgtacaaacaatgtggtttatgagctgggcccagtggctcaattgtgtaatctcagtgctttgggaggccgaggcaggaggattccttgaggccagcttgggccacatagtaagacctcatctctacaaaacatttttaaaaattagccagatgtcatggtgtgcacctgtgtagtcttagctactttgggaagctgaggcaggcagataacttgagtccagtagttcaaagttgcagtgagccttaatcatgccactgcactccagcatgggtagcagaacaagactctctctctgaaaaacaaaaataaaaaataatatggtttatgttgaacatctactttttttctgggagtctggaattttggtatattcttaggcagagtgcctgtgtaaccagcctccaataaaagccttgggcactttatttctaatgcgcttcccttgtggacaacgtttcacacatgttgtcacaacttatttctgcaggaattagaggatcgtgtgtaatttcattagaagaggatttttgaaagcttgtgcctagtttcttctggactttgcctcttgtgcctttttctttgctgcttttactttgtatcttttagctgtgataaattatagctctgagtatggttatattcagtgatatgttggatcagttgatatgctgagttttttacatgtgtgtattatctaacccctttattgtgcacattttcccttgatggtaaaacagtgaaagctttccttggtaacattgtaggtgatataataaagaagtgaatcaaaaagtgagtgtctttaggtatgttatttaggacaaggagatactactttaggtaaattattttaaattacacttccagtttttattaccttcatatgtcaataggatgctaaaccacagatgttaaatttcaaatagcattttaagttttgctctctagttttataaatcatattacataaacttactgaactaaatgtgaaaatagggtgccaattcactgactatgtgatgttccgaatgggttatcaatgtctattacgtctagcagacttgccctgctttgttgaatgtgtatttggaagacactaggctctgtgggggaagaaaaagaaataggttattatctgtgaggcagtgaattataatcttgggtgatggcggcattggtagtgatgggataaaatgtgtaaacatgatggatattaaaggcaagaatgacaagtactatatgactaggacatgtttttggaatatatgcctcattagagcagggattttgtcctgttcatctcttatcactagcacctaaaacagtccctgggcataggataggttaggtggagttaatgtgaagccagtcgtcgtcataaaagtgataattgagtttgaagaggaagttctttttattataaatctctgaatccagtatgtcagcaaacttaaaaatattttttgggaatatcataacagttaattcatgaataggtcagaactttctaatgttgtatgaatattatgtgacctggtaatctgagacactttaatggcgcttgcctgcaactagctgttctttttgatactggataggacatttaattctgtacaaacaactactaagggtttctttcccttaaaaaattttttttaattgtggtaaaatacatgtaacatgaaaacctatcatctaagccatttttaaatgtacagttcaatagcgttaagtacattcacattgttgtataaccaatctctagaactcttctcatcttagaaagctaaaactctgttcccattaaaccaccctctttattccaaactcattctcctccttcctccaacctgtagcaccattctattacactttctgtctgtatggatttgacaattctaggtgcctcatataattaggattataaaatattgtctttttgtgactggtgtatttcagttagcataatgtcctcagggttcatccatgttgtagtatgtgtcaaaatcttcctttttaaagggttgaaaaatactgcattgtatgtatatactacattttgtttatctatttgcccatagcatgacacttaggttgcttccaccttttggctattgtgaatgctcctgctgtgaacatggttgtacaaatatctgttcgagaccctgctttccgttctttggggtatatacccaaaaatggaattgctgaatgatatgataattctacttttactttttgaggaaccaccgtactgtttcctatagtaactgtatcattttacatttcacaacagagcacaagggttccagtttctccatatccttgccaatacctgttattctggcttgttttgttttgttttttgttttttgttttttatagagttgaggttttgctgtgttgcccagactggtcttgaactcctcaagtggcacaagcgatcctcctgccttggcctcccaaagtgcttgggttatagttatgagccactgtgcccagcctattttggttttttgatagtagccatcacaatggttcgagtggattgctaagtcatacagggatgtaaaattgtgtctgttgaatcatctatatgaaatacttcataggaattgaagctattaagattttgatgcctgttggagattattggtgacttgctaaaagtaattttagtagggtaataaagggaaaaatgaaattttcagagggtgtaggagttagtggttcaccaggaagtgtagtttctctttagaaagtttggtcagctgaccacagcactgtggcagtctccggccttgcaaaaataacttttttccatatagtggtcaataagtattgaggtctcttaaactacacaagtgactcttcctgtgctatatttgtttttgcagagagaagtgtgaattctgaatctctgctactaatttgggagtctttgttttatatttgtaatcggaggtaaagagaattgatgtaattgtggcttaatatgttaatactagaacttaatattctcaattttactgtatgtttttaattaattaattaattaattttatttatttatttatttatttttgagacagagtcttgctctgtcgcccaggctggaatgcagtggcacgatctcggctcactgcaagctccgcctcctgggttcatgccattctcctgcctcagcctcccaagtagctgggactacaagtgcccatcaccacgcccaactaatttttgtatttttagtagagacggggtttcaccgtgttagccaggatggtctcggtctcctgacctcatgatctgcccgcctcggcctaccaaagtgtatttatttattttttgagacagagtctcactctgttgcccaggctggagtgcagtggtgcagtctcggctcactgcaacctctgcctcctgggttcaagcgattctcctgccccagcctcccgagtagctggcattacaggcgcatgccaccacgcccagctaatttttgtattttttagtagagatggggtttcaccaccttggccaagctggtctcaaactcccaacctcaggtgatccacccacctcggccccaaagtgctgggattacaggagtgagccactgcttccggcctgctgtatgtttttattatatactatgagataatgagattagtgatggattgctttgtaatactttgggagtctgggtttggcagagtgtgcccctatgaagactaagtgggactataatgattgtgttttcttaaatcagaatcaggatgcataaccagatgaaggaagacatagtcgggagccatagttttaatatctagattttggaattttagggtgatttactatagggacaaagtatttgaaattgggattggcggaacatcagtggaaccagcgattgctaagttaaatatatacagggacattagataatggatgatgaggaaatgggtaaaagaaagtgagggccttgtgagttgaaacaaaaataatcaaacctggaacactttccatttattgtattagatatcttcatttcaataaaattaatgtatatgacaaaattttattgtcctcctagttcaagtggtattctacttttatttccataaaaatatactttcaggatagggaaagggtaaacttgcattataagtttgtattttctcacgaagggacaggagagaagaaaaaaatcatttgcttattgtctaggctatgcaaaaaaaaaaaaaaagaacagccttgtttttttattacattttttcatttagtttatgatttgccatatttattattttaaaacatgaagtctgtagtacaaggttttatttaaaaacattctcaaaatcaaggactattactacatgcattcagggaagattatctagctatattggagagatctccttcgctagtaattgatgaaacctaggaattgaaccccagcttctctgacttaaagctgccctattgtgaagtagaaatgaagtgtaagcaatatattcttaagtatactggtcaattctgatttacatagaagacctaacagtttatttactccctactatttgttatgggattatgctgatagtagctattactaatagaagatacggtctaaatcagggaattcgtgttctatcagggatggcatatgtgcatatctaaataattactgtacactgggatatgttctagataagaggtgtatataaagtagatagagatgaggaagtggatgatgggcctgtatgccagtactactatcaggaaaaatttcatgaagatgatttctgtattgggctagtaaaaagcagggagtttcttggcagacaattaggggaataagtgaagcatacattttgacatgagcaaagcacagaatcattttattactccaagactcataagactggccctgtttacttcaaagttactttctttattatcaatcctgagttggcttcaaatgaggaggcatagccatgcatttctgaaaaaaaagggagagaattagtctgttaggcagcagtgggtgaacagtgagcaaagataggaagatgaattttgataggcagagttgcatattttgcaactaaaggtagacattgcagttgtatagttgaaagaccctttggttattttagctgcttataaccattatcgttagtgatgtgcattttttctttttttttgagatggagctctgtcgcccaggctggagtgcagtggtgtgatctcggctcactgcaacctcagcctcctgagtagctgggactacgggcacacaccacgaggcttggctaatttttgtattttttggtagagattgggtttcaccatgttggccaggctggtcttgagctcctgacctcaagtgatctgcccaccttggcctcctaaagtgctgggattacaggcacaagccaccgtgcccagcccatatacatatttttatgtaagtatgtttgtaaagttagagataaaatagtgataatacagtgttactttgagatagtatagtgttactttggctggtactctaattttactgtatgctgctattaatttatatttggggttttaagaaattttggtttggttatcatgcagtttgtagggttaaattaatactattaagatggtgtggtttttcttactgaggacagttaaaattttcaaatataaagccagatgaatttatttatttaacaatggttattgaatgtgaactatgtcccaaacctgctaccgtttaaaattcagatgaattctccagtaattgcctcagaaattttccggagcaattaggtaaaaggagtatgattttatgggttaggtagccttaatattttgccacagtataactcttaagcttaaagtaatttccatttttatttactatacaaagtatagttttaatatttgtatattcttatatgcatatttactaaaagttgtgccttatgaaactcatactgtgttttgttgttgttttttgttgtcgtgttttttttttttttttttttttttttttttgagacggaatctcgcccttgtgccaggctggagtgcagtggcacgatctcagctcactgcaacctccgccttactggtttaagtgattctcctacctcagccttccgagtagcttggattacaggcatgcgccaccatgcccagctaatttttgtatttttagtagagatggggtttcaccatgttggccaggatggtctcgatctcctgacttcgtgatctaccagccttggcctcccaaagtgctgggattagaggcatgagccaccgcacccagctgaaactcgtactgtgttttaagtgttataacattgaggaatttgaggcagtggtgtgtggtctaataacagagcatgagagagcttcagctttgatacttaatttctatatatcccatcttattccgaaaggaatttcagttagcttaatttccattttagtgctgtttctttttgtgttaatttattgttttcttaattgtgctgatttaaaatccagccaacaaattaatttaacgcttgtctgtctaaatgtattttcacttcaaagtctcttcagtgaatatgaagacaattagctatatttttgctaacaagatttgctgatggggagaagagcgagataaaggaacaaatcaaggatgagtgttaggtttttggcttgaactactgttgaatggtggtggtttttggcttgaactgctgttgaatggtggtgctatttgggcatgtttgtgatgcccattacacatccagtggacaggccaatagacagctctttgactctggagagatttaacaaactttaaacattctcaggagcttagatgaacaatgaactgttccactcttttaagaacttgaatcttgacacacaagtgggtatcttaaagtcacattgcatgtgattttggaggcttttgagaatccatttattgatttaggattaggggaatacaaatttagtgttttaggaaattgtttaaagcaaagtgaatattaaactcgaattttgtttgtatcaaaaattctaagtattaaaaatgtttctctgacttgtctgagaaggctcagtaaataattcttcaatttgtaatgagagttttgctttgcattagctattggtctataaagtccagtaagatagtctaatctctgccttcagttttatagattagtggacgagacagacaagtactgaaatacttaagaaatacttttcacaagtggcaatagaacaatgtgttatggactcattgcagaaggctgaggagcagtaaaggagggaaggttcaagaaagccttcaaaaaggaaataacactttagccagagccctgctcaccagtaagagcaaaaattgtgcaactttgatatttaagaaatggagggttactgctagtcgtagtggtggtgagtaattctatatgactaaagcatcaaactctaataagagcattataaaaagaggctagaaaattggacaggcaacattcaacatatcttataattaaagatttggtagtttatgttagaggtgatagacacataggagagtttttaaatgtgggagtaaaatggtcagacttgactttttagaacagtaataaaggagtgcagttatttttggaattcatttatgtgactttttaaagacttctggggtaggctggtgcagtggcttatggctgtaatcccatcactttgggaggctaaggtgggcagatggcttcagtccaggagttcgagaccagcctggacaacgtggcgaaaccccatctctacaaaaaatacaattagccaggcgtggcggtgcgtgcctatagtcccagctactcgctaagggacgctgaggtgggagaatcacctgagcccaggagtttaagactgcagtgagctgtgattgcaccactgcattccagcctgggcaacagagtgagtccctgtctcaataaagatctttagggtagacttaattgcaaatgctttcttaaaggatttgtttgttttcttagcttttttttaaaaagtcacacgataaagggtgtggtgggtacctataacttaatacggacatcatttagctatatttttgcccagttaatacagtaaatgattaaaaattctttcttgctttaggattatatgaaataattaaattatataataaatgaattattttattaatgtttagtgctattctcatacagtctatgaataaggtttcttagtatattatgtttctcaataatacagaatttttttgtttctttcttagtaatagcttcatcagagacaatagaatagtggtcgggaagttaaaatgaaattatatgtgtagataattctgtttcatagagtttaaatgaactttggtgctacttctattcaggaactatttagacattaatgttgatgtgttaaaaaaaaaaaaaaacctgctctaggccaaatcagatcttaatctggtggtaattttgtacccacagagtttattgtttaacagggcaaattagatgtattctctttatatatttatcataagagtaagaaatgtaagtgttctaaaagtacatataaaggtaaaacaattcagaggggaagattatgtctggaggaagggcatcagaaactctgtaggagctagggcttaaaattaaaagataagtaagctttggaggtgtgcaagtggggagaccaccaacaagcaaagaaaaagcatacacaaagacacagaaaaatgattatcatgggattttttttaaagtagaatcttagcaacttttaaaaagacaaattatcaggcaattaccacctcagacctactgaatcagaaactactgggatgaggcccagcaatgtggccctccaggtgattctgaagcacactcaaatttgacaaactgctttgcaatttcaggcagataaattgacctggaatatgcaactctttctgatctttgatctaggaaaggttttaaagaaataaatctgaagtaacaacatttaaagagttccagtaattagttcaataataatagttaacatttattgagccattttatgtactagaccttttgctgagtaaaggttattatctcagttttatagatgagacacagagaggttaaatatgttaattgtcacacagctaagaaagtaccagatccagaattttaatttatgtagcttactataaagctgacatttttcggtgggaaataagttccaacttgtagatacctttttaaagtacaaaacaaagtttttacttgttttatggaccacttttgtatctctgatgggcatgaaaattgctaagaacactattgtagatttttattttaatagagcattctccattttaaactttaattatagaaagcattttaagaaatggcatgctaggctttaagaaaactggataaatgaaaatccaaacttaaataagataaatatttggacgcaaaagttctcaaggttcattatgagaaatgtagtcatttcacataaaagctttgttttgcacatttctcaataacgtaatttgtcatgtaaaagaagaaaagtctggagtgggccaggcatggtggcttacacttgtattccccagcactttggaatgttgaggcaggaggattgctggagcccaggagttcgagaccagcctccgcaacatacatggggagaccccagccctacaaaaaatagtaataataattagctgggcatggtgacatgagcctgtggttccagccactttggaggctgaggcaggaggatcatttgaacatgggagtttgaagctatggtgagccatgatcatgccactgcattccagtttagacaacagagtgagactccgtctgtgaatgagtgaatgaatgaatgaaaaagaaaaagcttagagtgattgtaccaggcattcctgaggtacattcacattttataattaaactcaaccactctttgtactaaattttttctcgctgacattgacctaagatatattcctttcccctctgtgtttctgcaactatttaagttgatatccttctctaagtcagattcaaaataatattttgaaatgcactgatactataagtatctaaaaatacatcttttcagatgcttaatctttgagcagagaaaatacaaacattctaattaaatgtgcaagatgcgtatataagtaaccatgaggatctttgttaatatggagtaacgacatcataaacaatcttttctactgtccttttttatttacgttcaattttttgaacaggcaatacagtcatacaatccaaaagatatgaaaagacataatagtaatgtctcattctcatccgtttcccttaggtacccatttcccttccccacagacacatactttgttaatagtttttcttccagagatgatatatgcatatgtacaagcaaatgcaaatgtttttatttctttttaacaccagtagtaatatattacatatatacatactgcactgtgtatataatgtacactattgtttcctgctttttacatttatacttaatatgtatttttcagatactgtcatcttactatatataaaaagctaactcatttgtttttcagctctctcatatttgatggtatgaataaaacaaatttagccagttttgtattaagaggtttctttgattgtagttttttgctgttactaacaatgctgcagtggttgggcgcgtggctcacacctgtaatctcagcactttggaaggctgaggcgggtggatcacctaaggtcaggagttcaagaccagcctggataacatagtgaaacgctgtctctactaaaaatatgaaaattagctggacctggtggcacgcatctgtaattccagctactcaggaggctgaggcacaagaattgcttgaacctgggaagccgaggttgcagtgggccgagatcgcaccactgcactccagcctgggcaacagagtgagatcctgtctcaaaacaaacaaacaaagtgctgtggtatgtaactttgaatataaatcatttcatgtgtgtcccatttttatctggaggacaaagttgtagaagtacaattcagagacagggtcttgcattgttaagcaggctggtcttgaactcctggcttcaagcagtcctcccaaagtgctaggattacaagtgtgagccaccatgctcggcccccacttgcttttgaatacagtttttcctctgacacatgtatatatttggagaactctattaccacaggaaatcacaagaaatagcatcataaatgtggggaattttactttgacattgtgccagtgcagaataagattctagtaaatctttatcataaagaaaaaaatgtattcctgttgtaggtctctagtattgtgatgataaaatttagtcgtttttcaaagaaaaagaaaggtttataggcagttttagttccttaaatatcagtatcacaagtagcaaaaattaatgagaaagttaaattttatcagatttatttttcattttatttgtatttaataatttgttgaatggtaaaaccagaatgctttcaatatgtcttgaggcctgaaagaaagttcctttgaaattaaatttcagcaatgtagttgtgtagaatttgaacaattcacaatactgactttcagtgcttctgaaagcaggaagtgtattactgacacgcagaaatattccagcccaaagaacatccctactgccatatgtggtaagaatttgtcactaacccacaaactagttctgtaatgcagtgaataagcagaattggtctttgttggacatttccaattcaatatgaaagaactttgttttgcagtgtcttgtaagtaattattagcttatgccttgggagaaagcctggcacatcatgggtgcgtgctcatggtttattgagagaagaaaattcttttaggcatgtttttaaaacttggttattgtgacccttagttaaaacactgaaattactcgaatatgttaaagactgagttaaatattctgactcagcttattaatgatatctttaaattatattacttttattctgttttccctctttgctgctcatgtgaaataaatatgaatcttatgtttgcacttatgctataaaagaaattatccttggggttaattattaagggatggggaaattaagagctaagagacaggaaaatgagttgtgaggaattggggtcaccagatttcattaaaaatttgaaaatatcactgtttctctaaactttaatttttatttgttgtattttaagcggttaagaagattgtctaccaaatatagaacagaaaagatatatcccacagccactggagaaaaagaagaaaatgttaaaaagaacagatacaaggacatactgccatgtaagttggaaatgcccttgataaaatacatagaaatgctaattagccttttgtaacctaactagttttattcttcctgagtttcactgttaaggaagtagtaattaacctatctttcaaagtacatggaaagataataattcataattgtgctttttgtttttccttctgatcctaatttttgtttaatttttttcctgtaagtatcacagttgctctaatactaaattacttttaaatactgtaaatccaagtgaaaatatcttctgtcaactctctgttcaaagatgttatttcattaaaataatagacaactgaatacattttataaaatgctaacaatgttgatttttcatatatctatacataagaaccttaattgattaattatgcatgagaaaatgaagcataggatgactcaaacatctgtgtgtctactattctcagcagtctgaatatgtgcctctaagtatatgtcttagactgattgcattacattctaatgatattttatttatttatttatttatttatttgtttgtttgtttgtttagaggtgggggttctcactgtgttccccaggctggtctcaaactcctgagctcatacgatcctcccacctcagcctccccaagtgttgtgattacaggtgtgagccactgcgccctgtctgtattcttaaatagcacagttttctggcaagataactttaactctgaaagtatacttaaggtgtgccatcactttatccagtaaaagctatacgtcatacttgctatcttttaaagctgccgtcgtttttctttcttcataagtattttgaaatatctacattccatcacatcatttcctcaattcttattcagtcttaaaggttgttctctctaaaatgcctttaaagttcttggtgacttttttttttttttttgtgacagtcttgctctgtagcccaggctggagtgcggtggtgggatcttggctcactgcaacctctgcctcccaggttcaagcgactcttgtaccttagcctcctgagagctgggacagctctaatacaggtgcctgccaccatacccagctaattttttgtattttagtagagacagggtttcaccatgttgcccagggcccagtggctttttaattgccagatttggtggtctttttttactgtttattctaacaggaagaatattgattattcaagaatgttgaactattttgatgccattgatcaatccctatttttgaaattttcttcttccatgataactcttttaaaacacctcttccctctcatctctttccctcttttctccactaacttctttgcctcaatttaatccttcatccttttgttgttctacattattatcagctgtgggatatgtggatagcctgtgttggcagaattaacaagtggcaacataacataatggtatagtgttctgattctggaagttgaaatcctgactccaccagttgctagctatatgaccttggactgatcctctctgtgccttggttttgtcatccttaaaatggagattataataatactttttaggattatttgcacaataggttaatattaaatgcttaaaagtgtacccagtggccaggcgcggtggctcacgcctataatcccagcactttgggaggccgagactggtggatcacgaggtcaggagttcgcgaccagcctgaccaacatggtgaaaccccatctctatcaaaaatacaaaaattagccagatgtggtggcacgtgcctgtaattccagctactcaggaggctgaggcaggagaattgcctgaacccaggaggtggaggttgccatgagccgagattgcgccattgcattccagcctgggcgacagagtaagactctatctcaaaaaaaaaaaaaacaaaaaaacaaaaaaaaccagtgtacctagcacatagtaaccaatcattaagcttttgcaaaataaccagtatacctagcacatagtaaccaatcattaagcttttgcaaaatacactccacttttctcacctgttgtcttagtctgttcaggctattacagaaataccataaacagggttgcttattaataacagacatttgtatcttcaaattctagagactgggaagtccaagatgaaggcaccagcagatatgctgtctagtgaagggtcactctggctcatagatggtgccttctcactgcacttcacatggtggaaggggcaaacaagctctctcgggcctctttagtaaaagctggtaatcccattcacaaggcataatctaatcatctcctaaaggccctaccacttaatactgttgcattggaatttatgttttaacttatgaatttgggaaggacacaaatattcagaccatagcaccagtctgcctcagaataggggatgacatggctttctggatacttcgtattaagcaagataattttaaggtgatcctacattgctctggaattattcatgcacacattcaaagagttagcctgtccactttctttttctgtcgtctagccgtaggtttctcttttcatatgatgtttcattttcttctttgtttttgaaacggtgtcttgctctgttgcccaggctggagtgcagtggtgcgatctccgcacactataacctctgcctaccagcttcaagctattttcctgcctcagcctcccaagtagctgggattacaggcacccgctgccacatccggctaatttttgtattgttagtagagacgtggtttcaccatgttggccaggctgctctcgaactcctaacgtcaggtcatccgcctcccttggcatttactcattttacagaaagcttctgagggtgtactgtatgctgggaatgcaacaaaaaacaaactggcaaaaatccctgcccttgtggagcttatatgttagtcaaggtgatggacgatacatattaacatatatggtctgtcatgtggtggtaattagtgttattgagagtgtggttcgaatgagggatagggagaaagcagagaatagaagggtaagtttacagttttggctggggtagtgggaaaggttagtggtgtagtgttaaactggtcctctgaaagttctgatttgtattgtttgctgatttctgtgataaatggattatttaccataatcatcacagcaaaactctgaggtaagtactgttatgtgccattttgcaaacaggaaactgagacagagaggttaaaaagcttgtcacacagttaaatattgtggggtaagaatttaaacacaggcggttttaaagccttcactagggtgattttgcctctcaagggacacttagcaatgtctggagagatttggttgtcacaactggggtacgggagtggacaggctgctaatggcatctaacaagtagaggctaggaatactgctacacatcctgcagtgcataggatgcagcccccttccccaaacaaagacttctcgccaaaatatatgagtgtcagcgttgagagaccttgtccaagagcttgagttcttaattactgtgcagtaatcagattgacagtgccttttttcctttaagttatttaaagtttgataagtaggtctccagtaaatttctagttattttgacttgggatttttttttcttttttttgagacagaatctcactcttgtcgccctggctggagtgcagtgtgggatctcggctcactgcaacctctatctcccgggtttaagcaattctcgtgcctcagcctcccaagtagctgggattacaagcacctgccaccatgcccagctaattttttggtatttttagtagagacagggtttcaccatgtcggccaggctggtctcaaactcctgacctcaggtgatccacccgcttcagcctcccaaagtactaggattactggtgtgagccactgcacctggcctggaaatttatattgaaagtaattgtactgagagatatgtgcttatttactgttagataactatttaattcattgcccgggcacagtggctcatgcatgtaatcccagcactttaggaggccaagctgggcagattatttgagctcaggagttcaagaccagcctgggcaacatagcaaaactcaacacacacacgcacgcacgcacgcacacacacatactctctctttctctctctcgtgtgtacacttgtggtcccagctactcagtaggctgatgtgggaggatcacttgagaccaggaggtcaaggctgcagtgaactatgattgcaccactgcactccagcctgggtaacagagcgagactgtctcaaaaaataagatggagaagaatttaattcactaacttcctttgcatgttttaacatgtgcagtgcttgcagaaatagaatttttaaaacaggtttgaggtataatttacatacccatgaaatttatccattttaattgtgcaattcaatgatttttttaaagtaaatttatagagttttgcaacaattaatacaatctagttttaggacatttccatcacccctaaaagatctgagtcttcagccctgggcagctgttaatcagctttctgtctgtatagattttccttttctgtgaatttaatataaatgtaatcatacaatatatagtcttttgtgtctagctcttttaacagtttttttttgagatgaagtctcattctgttgcccaggctggagtgcagtggcatgatctcggctcactgcgacctccgcctcccaggttcatgagattctcctgtctcagcctcctgagtagctgggattataggcgcacatcaccatgcctggctaattttttgtgttatttttagtagatacagggtttcactatgttggccagactggtctcgaactcctgacctcgtgatccgcctgcctcggcctcccaaagtgctgggattacaggcttgagccactgtgcccagcctcttgttaacacattttaaagattcattcacgatgtagcatgcatcgatagttcattcctttttgttgttgaataatattccattgtatgaatgatgaacatattgaataatgctgctatgaacatgtcatacaactctctgtgtggacctatggttttgtttctcttggttggatagctagcaaaaccatggagaggaataattgttttcatttttttgatatttagattatttctaaatatgcttaataagagcaccaatctggcagggcgaggtgactcatgtctgtaatcccaggactttgggaggccgaagcgggcagatcacttgagatcagatcaagaccagcctggccaatacggtgaaaccccgcctctactaaaaatacaaaaattagctaggcatgatggcacgtgcctgtagtcccagctacttgagaggctgaggcacgagaatcacttgaacctgggaggcagaggttgcagtgagccaagatggtgccactgcactccaacctgggtgacagagccagacactgtctcaaaaaaaaaagagcaccaatgaagaatattaaaacagccacccaagttctttctcgctacttctagttcccggcgctttgccgggtgttaatggtggcccaaaatcatgggtgctgtggctttctccctaaggtgtcacaggagctaagggtgccacttaacaaactgcagaagatgcaggcaggtgaaggacacccagtctgctgtggcagtggaatgtggcagaaaagccagctgggagggcggggagcaatcctggaaggcctggctgaccccacaattgaacagggtttggtgtgtcattgcttttaggccttttcagtggacagaactggggtggatatacactcatttatttgaaatcatgcatttgttccatactccaattccagcccaccccttctttgctctatggtcaagtgagtgagaacaggcggctacattttcagccttgttgctcaccgcttccttccagtagtcccatgttgcttcatatctcttcagtacatgtattatttagacccagagccttggcttttaaatcaggcagccccagtttcaaatgtgtcactgccatctcagttttgtgatttgggcatacctctgtctgtgcatagcgatattaacttctatctccatgggtgtgtggtgaggataaaattatgtgcttagaggaaacgttcattccatggtagctattttttattaattctatacttttgaacctattatgctacctataatgccctattttttttttctttttaatcattggcaaacttctcattccctgagacccagcttgtcacacctctgaagactgctgatatcctcaagatgttccttactccctttccttgctactactttactatggatatatgaacaacattattgtgcttattacatgcaataaatatttattggatgaatgatactaaaattcacatttaaaatgccaaaatcaaaatacacatgatatgctgtataagtagcataatgttgatttttaaatctaatgtgctgtgggtacatagtagaaagcagtgactaccaaatttgcctgtgttttagaatttaaatggggagttttaaaaagggtatttctgtgccccatttttaatttactgaattgaacttactacaagatgtagtactccagaaatcttggattttaatttgctttccccagctgttgaatgattggggatagatgaaataagattggcaaaatgttgataatgaagctgggtaatggatatacaaagattcattatactgttctattttggtgtatgcttaaaattttccatcttagaaaattttttaaaaaaagaaattaccagcctgcatgtagccagcctggcaccagtcctaactatcatttgggagccactattctcatttggatttacagtcaccagaaactttactgaggacccagtggtaaaccagctattgtattctgcctttgagatactttgaatagaggctaatatgtcatatgaataagggtaattaactgagaccccttattactggcaaacatggtaagaggaagcttcctgtagttattcagccatcattatcctaaccactgaatattctattctcattttccagagtcatagcttttttttgtatgtgtatttcctatcccaaatggcatataaaaagggggatgggacatgtagggtggcgtgaaataaatgacagagcattgacaaacatattttaaacattctgtttcttagaatacagtgaggagatgaataattttcaccagaagcaagtatatcttccttatatgtgtcttctacaaatttctaaagaagacttttttaaaagtaaatttatcaattaaattagcagaactgggcctttagtgctatgtataaaatttgagccaatgaaaaataaattagttactattagttgttctttaatactttgctaagaagtttattcatgtctgttaacatttccgtatttccttttgtatttttactgcctttgatactcattcatggattagaagggattataatttgataataataatggcattttacatgttatatgttatggtcccttctaatccagaaacaatgaatactaggcaattctactttaggatttcataatctgaaagcgtctaacctcaaatacttactaactataaaagggaaaggcagtaactttcccttttggtaaccaagcaataccatattaaccaagtgaccaaggttaacatcacaagtactaaagcatatgtatatcatgtatcctctgatgtgttgtgctgagaaggacacaatatcgttctgtggtattaccaaaaattcataacttcgttccagtcatttaaaaaaaatcaatcagagaaacttttttagattgaaggagactaaggagaaataaaaattattattattattatcttgagatggagtcccactctgtcacccaggctggagtgcagtggcgcgatctcggcttaccacaacctccgcttcctgggttcaagtgattctcctgcctcagcctcccgagtagctgagattacaggcatgcgccacgatgccctgccaattttttttgtatttttagtagagatggggtttcgccatgtgggccaggctggtctcaaactcttaacctcatgtgatccgcccaccttggcctcccaaaatgctgggattacaggggtgagccactatgcctggccactaaaaattaaatttaatatgagatcctcgaaagagaaaaaagattagaaaacactgacttgtatagtcttgtttaattaatagttttataagtgttaattttgtggtattattgatcattgtcttatggttatataagatgttactattagaggaagttcagtgagaggcatgggaattctctgtactatttttacagtttttctataaatctaaaattagttctaaataaaaagttttaaacatcagcacaaactggaaaaaactatttgcacttcctgtgacagagggctgattttttctttttacatagatctcataaaaatcagtaggacaaaacagacgtggaaaaatgggcaaaggatataaacaagtggtttatggaaaaagaagtacacagaaccaataaatagattaaaacatacaatcctttgcataattcaagaaatggaaattaaaacaagatatttttactttttggtttgtcagtgatgaaaagtttggtaatacccagtcacccttattacataaccctgtataaattgtttcataccttttagaaggcaagtagcaattcctctgttaggaatttaccctacagcaatgctggtaacagctatatatacattagtgttcattgtagtaatgtttttaataggaaaaaaatggcccatcagtagagtagctaaataaagaatgaaacattcacatgatggaattctctgttacactaaaaagagtgagatagcctagtgcaagctgagtgcaatggttcacacctgtaatccaaacacttgggagcctgagccaggaagatctgtagtccaggagttttaggttcgaatgagctatgattgcagcactgcacttcagcctgagtgacagagtgagaccttgtctctgtattttaaaataatagtaaaaataataaagtaaatctttctgtgctttgggaagagttccaggatatactataaactgaaaagtaatgatacagaacagcatgtataggatgcttgcatttgtgtagtagtttttcaaagtatataactatatgtgtaataagtacacttggaatgggaaaagtaactttaatatagtatcttgatgggagagagccctggaattgaagggcaggggaggcttacttttcactttatacctttctttaaggtctaatttttaaaaattatatacatattcctttaaaagaaatcaataaaaacttaaaagaaaaatatacttcataaaattttttaaagatttttttactctattacctaataataactattattagccaagagcagtgttgaacactttttatatataatctcaattcattaatttgttataatttgctttttatagtttcttgtgaaatatgaaagttacattttttaaataagaattttagcatatgggcttgtgtatcactggttagtattcatcagccacttggtatgtttgttaaaagctgcagaggctgaaaccctagactctgctctagtaaatcagagataatgtcctggaatttgaattttaaaagagttccagagatgattcttattgcaactttaatacactgctttacgtcactggtggtggtgtttttttgttttgttttgttttgttttgtttttttgctgttgttgttttgttttaagacagaatcttcactctgtcgcccaggctagagtgcagtggcgcaatcttggctcactgcaacctctgcctcccagccagtttcaagtggttctcctgccacagcctcccgagtagctgggattacaggtgcctgccaggtggtggttgtctgaaaatttatttcatttcctttcagtttaatgttagaaattaccctgctggtacctagagtccattttcatccattgttttttaaaataaatgttcttaagctgtctatttaaccttacttacgcttcattagaaaatacctgtgtgtcaaccatacatattttatgaatttttttctcgtagttgatcacagccgagttaaattgacattaaagactccttcacaagattcagactatatcaatgcaaattttataaaggtatgtactaactttaaatggtgtttctctgccatattaatgtctttctacatactagttttgtaaaaactttttgaattgctcaaacatgataccaacagcaaaagaaataaaaataaagccactgccctggcacaatgtttttatatgctttccttctagccttcttattcatatagataaatagtttctacttagttttgtgatagcagagataacattttcttttttatttcttctttcccatggaagtcttacctattactaaattattttctcagttatccctttggacacaaatgaacatcatcaatccccgttgttgacccatataggttgtttccaaatttttaaaatgataatattgcagtaaacatctttgttgttttgaataatttcttaggataaattactaggggtgggattactggataatactgatttaaaattctagaacatagctttaaatgtaaaacttttggcagttgtcactgtttcaggtggcaacccaaaatccaagattaaatagtctcttttataacctttgtttggataccctttgatgaaaagcagtcaagttcttttttttttttttttttttttttttttgagacggagtctcgctctgtctcccagtctggagtgcagtggcgctatctcggctcactgcaagctctgcttcccgggttcacgccattctcctgccttggtctcgatctcctgacctgtgatccacccgcctctgcctcccaaagtgctaggattataggcgtgagccactgcgcccagcgtcaagttctttatggtagcagtagagatagatgcaaagtgctacttgattcagtttaaataaaaggctttttttccatcagctaatctgtgatttttaatctttcaagtgatatgatagtataattttcatttattttatatatggtgtttatacatattttcatgtttttgttgataaaaatgttaactgataaaagtttatgccaggccgggcacggtggctcatgtccgtaatcccagcactttgggagacctaggcgggtggatcacctgagatcaggagttcgagaccagcctggccaacatggggaaacccagtctctactaaaaatacaaaaattagccggtcatggtggtgcatgcctgtaataccagcttctcgggagactgaggcaggagaatcgcctgaacccaggaggtggaagttgcagtaagccgagatcgtgccaatgcactccagtctgggtgacagagcaagactccgtctcaaaaaaaaaaaaaaaagtttatgtggtaaaattattatctatgtcaatattcagcagtcatggttttaaataaaaatttctttttttaacaaagttaaaaaccaaaatgaatacattaaataaaaactaataaattgatagtttgctatttcagatgttgtcaatgttcatattctttttttaaggctgtttgttaaaagttatagtttttacttatgcttaatgacactgattcattgtatgagtcagttatgtaccagtttagtattttagtcagtgacattgtttggtttatattctcatgttcattattaaaaacctgtatagtagatgcttgataaacttttgagttgaatagataatggaaggtagctatggaagaaactaagaaagagctcttcactagttttagtattgttttagaatcagagcatgctctgtatttctgccagttagctttgttgagtaggtattagggcttttgttattaatgcctagataagtaataatttttaattagcataaggcggttcttaaatacctattctgtgcaccatatccagtaaacacaaagtaatagcagtcatcaaaagcttaagtgaattgaatatattttgccatgctttaatatactatgaaagacacattatttggaaatggtttaagttaaaacaacaatattactaatacaatttgaaaccttatattttgggtaatgaaatatttttggtaatcaaaataaatgtgaaatttgcttttaaccatttttagggcgtctatgggccaaaagcatatgtagcaactcaaggacctttagcaaatacagtaatagatttttggaggatgatatgggagtataatgttgtggtaagtaatttacttttcacaataaattttgagaaatacttatgtaataacataggctattttactgaataaggaatgaggggatttttaaaaaatccataattatgtttacttattgctgatgtttactaaaaagatggacccatttttaggatgtctcattaaatttttacaaactaggctaaatattttaagaaggtgtgataataatttaaatcttgtcctaagtcagtaagtaatgatacagctatcaaacaacttataaaaagcagaaaaggattagtgctctaataggtcagtaaaatacttgatagtacagttatactcatttgagtccctcttctcaggaaaatatatataaacacataactataaatagactataaatatgcagtataagagaatttcatctatccctggagttcattcagtgccctcttgttcttttggatgaagggaaataatatgcccttagatttagaagcagagaaattagaatactgcgaagagctaccctatactgctctgtagtattcttgaaacctaaccatgtgcattgatacttttcattgtgtggatgtggaaaatcagtaatgtgaaactttcatttttgtcttacggctttttaatggaattgtaatgattctaaagcattgacatcctctggtctttgaaagattaataaaaggggggaaattttccagttatttatatttgctgtacttcactttaaaaactagatgtgcttggggattgagaaagagcatgaagaaactttctggatgatgggaacatcctgtatcttgataagatttgtgttgcacagatgtgtgtatttgtccaaactcggagaatgttcactttaggatttgtgcatttcattatatgtaaaatttgcctcaagggaaaaatactggaaacaatataaaaattatgttctagattggccgcgtggggtggctcatgcctgtaatcccagcactttgggaggccgaggtgggcagatcacgaggtcaggagatcgagaccatcctggctaacacggtgaaaccctgtctctactaaaaatacaaaaaattagctggacgtggtggcgggcgcctgtagtcccagctactcagcaggctaaggcaggagaatggcgtgaacccgggaggcagcgcttgcagtgagctgagatagcgccactgcactccagcctgggcgacagagcgagactccgtctcaaaaaaaaaaaaaaaaatttattgtgttctagataataatatgcatgctgaagtattttggggagagtgtactgatgttcacaacttactttgaaatgcatttttaaaataagatggattgatagagggatagctatgtgataaaacatggtgaaatgttaatgatagaatataggtgatggctatacaatgtttactgtaaaattctcaactatgctgtgtgttggaaagtttacattataaaatgggaaaaagcaggtgtgatcaacttttaaaatggtgttaaacgcattcaatatttaaataattataaatatatttttaattaatagtgctatttataattaggtaaatatcctaaaagtgatattttaatataatttcagaagtcacaaagtaaatctgtaagatttacatgatttaattcaaaccaaaaacatcatgttaattggaaccaatttaatttgttgctgtatagttagcccttgtttggaaagtctaattttgataatttctttaacttacacatttaatattgaaactacttttttaggcaagccaattatacttctcggtgcaaaattcttgaaatctgtattttattaaaaagtaaaattgtgtttaactgatacgttctttatctcactccccaccatcactttttagatcattgtaatggcctgccgagaatttgagatgggaagggtatgtataatctattcctcttactatttcatttttacggataaatattcttagtcttttattattatagtcttaacataagcggttaatgtagatacttcttttattttggggtactgctgttgcttttatttcatacaagggacaaaataatctctcaagcatgttgttttcttttatattttgtaagtatgttttatcacacacaggcatacctcagagatattataggttcagttccagaccaccacaatagcgcaattcaaacaaattttttgttttcttagtgcatataaaagtcatatttatactgtattatagtctgttaaatgttcagtagcattatacctataaaacacttcatgccttattttatttttttattttttctagacagagtctcgctctgttgcccaggctggagtgcagtggtacaatcttggctcactgcaacctccgcctcccaggttcaagcgactctcctgccttagccttctgagtagctgggattataggcatgtgccaccacaactggctaatttttgtagttttagtaaagatggggtttcaccatgttggccaggctggtttcgaactcctgacctcaggtgttctgcccacctcggcctcccaaagtgctaggattatagacgtgagccactgcgcctggccttccatgccttaatttaaaaataatttattgctaaaaaatgttaatgatcatctgagccttcagctagttgtaatctttatgctggtaaagggttttgttgacgttgatggctgccgactgatcaagttggtatttgctaaaggttggggtagctgtggcaatttttgataaaatacaagacaggaccaggaacggtagttcacatttgaatcccagcactttgggaggtggaggtgggaggatcacttgagcccagaaggttgaggctgcggtgagctatgattatgctactgtactccagcctgggcagagggagactccacctataaaaacataaaataagaaacagtgaagtttgccacattgattgtctcttcctttcatgaaagattgctctgtagcatgccatgctgtttgatagcaacagcagttgctgttctacccacagtagaactacttggcaaattggagtcagtcctttcaaacccttccactgctttatcaactaagttgatttaatgtcctaaatcctttgttgtcatttcaagtgctcacagcatcttcaccaaaagtatattccatctcaagaaagtagattccatctcaagaaaccactttattttcttatccgtaagaagcaactcctcatccattccaggttttatcatgagattgtggcaattcatttccatcttcaagctccacttctgattctctttgttgtttccaccacatttgcagttacttcctctactgaagtcttgaacctctcaaagttatcacgagggttggaattaactttttccaaactcgtgttaatcttgatatttcgacctcctcccacgaatcatgaatgtaattaattgcatctagaatgctgaatcctttccagaaggttttcagttcactttccctagacccatcagagtaatcatgatttatggcagctttagctttacaaaatatgtttcttaaataataagacttgaaactcaaaattactccttgatccatgggctgcagaatggatgttgtattagcaggcatgaaaacatattaatctccttgtacatgtccatcagagcttttgggtgaccaggtgcgttgtaaacggaaatattttgaaaggaatttttttttccaaccagtagtccccagtagtgagcttaaaatattcattaaaccatgcaatagggatgggctgggggtggggttgaaaaaacaaaaacatgctgtaaacagatgtgctgacatccaggccttactccatttatagaggacagacagagtacatttggcatgatttttagagcccttaggattttcagaatggtaaatgagcattggcttcaacttaatgtcaccagctgcattaacccctaacaagagagtcagcatgtcctttgaagctttgaagctagacgttgacttcttttctctagttctgaaaatcctagatggcatcttcttccaatataaggatgtttcatccatactgaaaatatgtcatttagtatagcttgtttcatcagtgctcttagcttagatctttggataacttgctgcagcctctaaatcagaatttggtgcttcatctcgcacttttatgttatggggacagcttctttccttaaacttcgtgaaccagcctttgctagcttctaactttccttctgcagcttcctcacactttatagaaatgaagggagttagtgccttgctctggattaggctttggcttgtagaaatgttgcagctggtttgatcttctatctagaccactaaaactttctccatgtaagcaataaggctgtttgacctacttaatttttgtgtgtttcctggagtagctcttttaatgtcctccaaaaacttttcctttttgttctaaacttggctgataagtacaagaggcctacctttctgcctatctcagttttcaacatgccttctttactaagcttaatcatttttagcttttttatttaaagtgaaaagtttgtgacccttttcacttgaatactttgaggccattgtagggttattagttagtctaatttcaatattgtgtctcaggaaataggaaagcccaaggagaggaagagagactgtacaaaaacttgtcaatggaacagtgagaatgctcacaacatctgttgattaagtttgccattttatatgggagcagtttgtagcaccccaaaacagagtagtaacttcaaacatcactgatcagattacaataacagatatcatcataatgaaaaagtttggaatactgcaagagtttccaaaatgtgacacagacctgaagtgagcatatgctgttgaaaaaatgataccgatatacttgcttggtgcagggttgccacaaaacttcaatttgtaaaatatgcagtgtctgagaaacacagtaaaatgaggtatgcctgtacttaacaataattaattaggtattgttacttagtaaacttcaaatattcagtggtgttgtaactagaatgctatctatggactgaaatagagaggtatttttaaataggaataaaattgaacaagtggaaatacattttaaaaatctggttatcattaatatatggtttgaatttttgtttgtttgtttgttttgagactgtgagacagaatcctgctgtgtcagtcaggctggagtgcagtggcgcgatctcggctcactgcaacctccatctcccgggttcaggtatatttcctgtctcagcctcccgagtagctgggactacaggcgcctaccaccatggctcagctcatttttgtatttttagtagagatggggtttcactgtgttggccaggctggtctcgaactcctgacctcaggtgatccgaccgcctttgtctcccaaagtgctgggattacaggcatataatcccatgtaatccaccgcaccaggcctgaatatcttgattagtctgtttgttaataccacagtatgttttgtttgtttcctatcttcaaaactgagagaagataatttcttaccctgattttctaacattggtatttttatgctatgtcgaagtaaaatttatttcaaagctattctggtatcctacagcatcatattctgtcctcactgtaggaggtaatgatatatttacagataattcatatttaaataaaacttataaagtgtggtcttctataaatatggcatacaaatcaaacttacaaattacatagtgattttatttgaagttttttaatactaatgtagttaatatatttaaaattatctttagtttgtaaatatgttaattttttcagtaagcaatatattgcaaaagatacatctttcagttatattacataaataattgggaagccttaatttattccattactcccaactatttcctatgtcagtattaagtaatgttggacagaaagtgaataaaatgagaaaatataaaaactgagaaattattaagtaatcaagttatctatttaagggttgtcaatatatacattaatattattaatcaattgtctaagagaatttaaatgtcattctcctaatgttttaagttactgttaaggtttaggatgtatttctcttttcattatattagtaagctcatagtatgtatcaagttattgatgaaaaatcaagtagcattgagtacataattttttgaagcgaaaggtttttgtgattcactgtgtcttattagtaatagattatgagcaagttaggaactatgaaattatctgataaccttgactttgatcttgactttgaatgtgacctggtggaaaaagcatagataattaaatcagacaaacctaccttttacaagcattttgaccatggtgcagtacagttcactctgagcttcagtttcctcacatttgaaaggaaataatacccaccttgcagtgttagagattatgtatgtatgatatttaacacatagtttttgatatcattattagttttataccaggaatataagtaccaatataatcttattactgctcatctgaatgaggggcattgttagtcacaccgctttctattcttaactaaattaatctcttacaacttgttttctatctgtttcaaagtattaaagttttgtcaggtaaaagattaaaaaaatgttttttaaactctcaaaaataatttaaggtccaagtgtaagtatagtggctcacacctgtaatcccagctacttgggaggctagggtgggagaattgcttgagcccaggagtttgagaccagctttggcaacatggcaagaccccatctctattttttttaaatcttttttttttttttgtggggagagacagtctcgctctgtcgcccaggcttgagtgcagtggcacaatctcagctctttgcaacctgcatctcccaggttcaaacgattctcatgtctcagcctcctgagtagctgggattaaaggcatgtgccaccatgcctggctaatttttttgtatttttgagtagagacaaggttttgccatgttggccagtctggtcttgaactccttgccttaagtcatccacccacgttggccttccaaagtgctgggattataggcatgagccaccacgcccggcctccatctattaaaaaaaaaaaaaattagccggttgtggtggcacacgcctgtggtcccagctactcaggaggctgaggtgggaagatcacttgagcccagaaggtagaggctgcagtgagccgtgattgcaccactgcacactccagcctgggtgacaaagtgagaccctatctaaaaaaagagagaatttaatttaatcattttctgtaaacatctcttggaaaatgagatttggaagttacctgtgtttttaagcctctaaaatgttagctaacccaacataccagacagttctactttgtttctctgtgagcattactgtcaacttatagttcattcagcctataggtaataactccatttactgtatttggaactgtgaagatttaattaggaattcattaaccaatgcatttcccactgcttaaaaggtttatttaagctagatggtcacttagagactttgattttattgggccttgatacaaattgcatcatttcttaatacctgaatcattctattttccataaagttaggcttttcattcacttaactgattttctaaaatgatgaggtgcttgatattagaaactgatgaaaatttatcattctttttctatacctgtttaaaataggaaggtaagaggagaaattatttgactacactttctgtaatctctaataaaattgaatagttaatacatcatgtttgtgtaggggttttaccatctgtggtacatttgaaatacactgttatttaacaaacatgcaacaactctgtaagataaggattattattcctatttttacagataaagaaactaaaggtcaataaaggagtagaattagtacttgcaaaattcttctgattccaagtagaatattctttccacttcatcacatattttacatttaatgagaattcagccagatatttgtagagattgtcatgttacaagcaatacaacttacctagcaacctttataccaaatacctccttgtaccagacacttttttaaaattagtttttcttgtctagaggaggatctttggtctactctgtagacctggcagatagcaatgaacagttatgcacttaagtcagtaaggttcttatgactattcttggagaagacacagtagcctattttttaaaacaactgggtaaatctaagctctctcagctccatgcctgctaatgtgggtttttctgttttggggaagtagaagtaagcagaacctcaggacacaaaatatttataacagtttaagaaaaacttacatgaattacttactaattttttttttttggatgacagaaaaaatgtgagcgctattggcctttgtatggagaagaccccataacgtttgcaccatttaaaatttcttgtgtaagtatccatttttgtaaacacttttttcagaaaattggcatgctatactgatgaataattaaattataatgtggtatgaacccaggcttatagacgccaaggactcacaaacctatgcttacatttaaaaaaattttgtttatatactgcttttaaatttggaagcttttgggttgacttcataaatgcatattttccttgtatcttactatattgattgtgtgttagtctttgtatatcaattgatagtaggtgtttacatgtaaatgaagtaactgtgcttttaatatttggaaatcgtgtattcatttcaaattgattaaatgggaaagacttggtaactggagtacagtgtatcatattaacccttcatatctaattgtgctctcaaaaattgttataattatatataaagataagtttaagacctaccatactggaagtaaagattggtcctgtctggcagattatttgatatgaaacttaaaatgttttcttaatatgtaatgacctctggaaatgaattaaattcaagctcaaaagctaacacagcaaaaatctgagaaaatgaataaaaaaatgaaaacagtgaaggaaataggagtaggaaaaagaaaggcatggacaaaaagaaggaaaatataagtgaattttaaaatagaaccaagttttctttaggtgccataaaaagactgtaattgaacataacctaaaaatcaattaatttaggccaggcacagtagctcatgcctgtatcctaccactttgagaggccaaggcgagtggatcacttgaggtcaggagttcgagaccagcctggacaacatggcaaaactccttttctactaaaaatacaaaaattagctgggtatggtggtgggcacctgtaatcccagctacttgggaggctgaggcacgagaattgcttgaatctgggaggtggaggttgcagtgagctgaaattgcaccactgcactccagtctgggcgacaagggtgaaactccatctcaaaaaaaaaaaaaattaatgaatttgcctatattagggttctccagagaagcagaaccaatagaataagagtgtgtgtgcatgcgtctgtgtgcatgtgtatacatttaaggagatttattacgaggaattggctcaggcagttatggaggctggccagtccaaaatctgcagggtaggctggagatcctggagagccaatgctgcagtttcagtctgaatgctgataagctggagacccaggagagctgatgttcagttctagttggaaaagtctgttgtagaatcaggatgagccgatgttgcagatgaaggcagcctgctggagaattctgtcttgcttcaggaggctggtccttttgttgtattcaggccttcaacagattggatgaggcccaacaacattatggaggacagtttgctttactcagagactaccagtttaaatgttaatcttctccaaaaacagtgtcacagaaataactagaataatgtttgaccaaatattctgggcacactgtggcccagccaagttgacagataaaattaaatatcacattccttattcagagtttcttgtttttgactttgttttccatgattaaacgaaatataatttctgtggttttacttgtcattgctgagttcttgaactccataattttatgacttagttatactcatgacttctgaattcctctcatacatacccaaagtttagtgctttctaggttgacataaaaaaggacaggactgtatctgtattatgctgtctactttataaatcaatgttgtttttataatgttaactataactcaccattgaactttttggatgtagtatttagtcaatattcttaaggtgctgattagaattaactatttgtggggtaaatgtaaaaattttaggccaggtgcagtggctcacacctgtcatcccagcactttgggaggctgaggtggggaggattgcttgagcccaggagtttgagacaagcccgggcaaaatagtgagacattattaacatttttaaaaacgttaaaaatcccactgcatttccttttatttggcttgaataatacccaatacacaccacactgtctacttcagtggggaaataccaaccctccttcaccaatccagaaagaaatctgtaatattagattcctcgacagtgtagaaacctagttctgtgtagtatggttgttttggacatttgtaaatttatttttaaagttttatttgtatatatctttttgagacaggattttgccctgtcagccaggttggagtgcagtggtctgatcatggcccactgcagcctcaatcccccaggctcaagtgattctctcacctcagcttcccaagtagtcggggctgctggcatgggccactactaatttttgtctttttgtagagacgaggtctccctgtgttgcccaggctgattttaaactcctgagctcaagcagtttgcccgccttggcctcccaaagtactaggactacaggccaccacacccggccaaacatttgtaaatttagatgtaataagataactatagtgaatattataattcaagagaaaatacagtgcttaacatcaacaacaaaccaacttgaaatttttgaacatttgagagtcaggaatagtaaacaatttacaataatggatataaggcagaatgcaatagtttataatgtagaaaatgaattgattcttgggggatggtttttcaattaaactaaaaggtatatctctataaatggttcacaaagaaaaaacaaaacatggagaaagatttattaaaaagaaaacagataacttgaaaggtctctagataagtggtttggtttgatttgattagtaacgacttggtttaatttgtcagcgtcaggattgatccatgctgaagaaatattttctttgataattttaaaatggaaggtaatttgtttgtcttataattggttcagacaactcgggatttgttatcattgacttaactgcaaagaaaaatcaaatttataaatagcatgttggtaaaaatattcgtagtaagtcatttgactacttggcagtcagagtttgagactgagaaatgactgtcttttctagagctctctctcgatgtgggatgaggacaagggtaaagtggtggtgaaagggtgaagactggttagcaggagctcaatcacatgttgccacatgtaagcacttagactggatgtcagcacactacccatggctcagatctagcccactgcctgtttcgtaaataaagttttgttagaacacatctatatgcattaatttatgaatttgtctatcacaatagcaaagttgtgtagacaaagactttgtggcccaaaaagccaaaaatatttactatctggtcctttacagaaatatttgaaaaagttcaaatattatttgaaaagttcaaagtaaattactgtaattttaaaaattaaagcaggtataatagtattatttttattaataaaacaacatacactgttgttcttcataatccttgttctaaactatctgtagttttaaccaataaggcaaaaagaataatttgcttagtgatagactgatgtagattaacactttgactaaatcacagtaagagacctttaaagtggttatgttatcaacaaccacaataataataataatttggggtgttcttccctcttccttcttcagttgctatccagttaattgaaacttgaatgttagggaaaatcatgtgttatggaaaggtaaaatggttgaagataggatatggtggttggtactgaggaatgacatttctatgtatatttacatgattctgggggtggttactactttgcagatattttattgggtggtagatgcttaagtaattcgtttagacacttttttttaggtataagtaaaacttacaaaagcaaattgatgtttttttctttactgtctatacaaatttttttaatgaattttttttcttcaagtttcttagtttagtaggtaacttgattcccaaattcacttctcttatttgtacatattgtttgggtctatctgttaggagactttatctgataggagacttcattttaaggtttttaaaaaaattttttttttagtgttttttgttttgagacagggtctcactgtgtcacccagactggaatgcagcgacgtgatcgcagctcactatatagccttggcctcactgctgggcttagtgatccacctacctcagcctcccaagtagctgagagcacaggcttacgcctcaatgtccagctagtttttgtatttttttgtagagacagggttctgctatattgttcaggctggtcttgaacccctaggctaaagcgatccgtccacctcagcctctcaaactactggcattacaggtgtgagccactgcctaactttttcaagactattttttttagagcagttttaggtttacagcaaaattgagaggaaggtacagagatttcttatatacaccctgtccccacacatgtagccctcattatcaacattccctaccagagcagtctctttgttacaattcacaaacctacattgacaagtcattatcaccaagagttcacattttacattagggttcattcttggtgctatacattctgtgggtttgaagaaatatatgatgacgtgtatccaccattgtggtatcatacagaatagtgtcattgctctaaaagtcctgtgctccacctattcattcatctcacccccttcccaaccctaggtagtcattatttttactgtctccatagttttgcctttttcagaagtcatatagtttgtttttgtttgtttgtttgtttgttttgagacggagtcttgctctgtcgcccaggctggagtgcggtggcactatctcagctcactataacctctgcctcctgggttcaagcaattctactgcctcaacctcctgagtagctgggattacaggtgcgcgccaccacacacagctaagttttgtattttcgtagagatggggttttaccatgttggccaggctggtctcgaactcctgacctcaagtgatccacctgcctcagcctcctgaagtgctggaattacaggcatgagccactgctcccagctcagaagtcatatagtttgaatcatacagtatgtagccttttcagattggcttatttcacttagtaatgtgcatttagggttcatccatgtcttttcatggcttactagctctttttttccttttattatttttaattgacacatagtatctatacttattaatggggtacatgtgattttggtacatgtatgtgtaatttaaaatgtggagtgactaaatcaggataattagcatgtctatcacttcaaacatttcaaatgtttgatgacttttagaatttttttataattatcaggtacatctggaattttaaagattaattttatattgtggactttgatacaagtattttatttgttttgatgtgtctttttgttttaacgttttcactgacttagaaatgtttctctttatttaggaggatgaacaagcaagaacagactacttcatcaggacactcttacttgaatttcaaaatgtaggtacttaccatttatagactatctgtaagaatagttttcaggctgggtgcagtggctcatgcctgtaatcccaacactttgggaggctgaagtgggagggtgacttgagtccaggggttcaagactagcctgggcaacatagtgagatcttgtgtctacaaaaagaaaaaagttagccgggcatggtggcatgtgcccatagtcccactcactcagaaggctgagcccgggaggttgaggctgcagtgagccatgattgtgccactgcactccagcctgggcaacagagggagactctcaaaaatggttttgagaatagagaatagttttcaaagagaagacatagagagggaggggagcgtgggctgaaaaaccacctattgggtagtatgctcactcctttggtaaggatcatttgtattccagacctcagcattatacaatacacccatgtaagctgcacatgtaccccttaatccaaaataaaagttgaggccaggtatggtggctcactcctgtaatccccaacactttgggtggctgaggtgggttggtcacttgaggccaggagttcaagaccagcctggccaacacggcgaagccccatctctactaaaaaatactaaaattagctgggcatggtggtgcacacctataatcccagctactcaggaggctgaggcacttgaattgcttgagcctgggagacagaggttgcaataagccgagatggtgccactgcactctagcctgggcaacagagcaagactctgtctcaaaaaataaaataaaaaataaaataaatgttttaaaaatagaaaatataatactactacctaaatgttttatttggtaaaatgggtttgctagaaaattattttgctttatatctgcaaaatgcaaataatatatataatatatattattattttgctttatatctgctttatagttttttgtaagtaaaaaaagtaacagcaatttttatttttaaagcatgtgaagttagtttttgtctttgcaaactaatcaacttttagctactaaaaaaataaaacaagctatataaatagtatactatgttatttaacataattaatgaaatttggtaattttttagttacgaagatgaaatgagagtgtaatatttagtcttgacatttatgcttatcacattacataaaaagtaatattaattataacataccctaaatttgttaaatttggaatagttatagcttctttgcagcaaatatttttattctattgcagtaagcaggttattgcattgtttatataattattaccctgttttactggtttacaatttgttaaagaaaagtcactatcaaagctaagtcttcatttagatatatattgtttttagttgaaaccccccacagcgccccgacttttttttttttttttttggcaacagggtctcactatatattgcccaggctggactcaaactcctgagctcaagcagtcctcccatctccaccttcctagtatctgagactatagggatgagccaccaaacccagctaaattttttatagtttatagagatgaagtcttgccatgttgctcaggctgctgtcaaattcctggccttgagtgatcttgccttttgcattggccacccaaagtgttgggattacagatgtgagccactgaatctggactggttgctaattttttaatctacggtaataataataagtaccttaatgaatttctgtggtagatcaggcatcttaattctgctaactgcatcatatccagatactgttacgtctgttgcacatagatgaagatacagaagctttaagaagttaaatagcttacctgaagttatttaggaaatggccaaagtaggaatttgagtatggtttgcttagattccgagtattgctctttctgttaaacacctgcaataaccattctcaaaacatttgacatcagtactcctttacattcttcaaagttattgaggatcccaaagtttttgtttctgggggttgtatctttcagtatatactatatttgaaattaaaactgagaaatttttaaaaaacatgaatacataagcatatattgtattggctgttaaagaataaggcacgtgacattttagtattattctgagaattatttaaagctcatagactccctcaaaagggttgaggggagggggtacccagaccgtatattgagaaccactaatctgtaagaagactagtgagtttggcattggacaaattcatctctccattctttttcagtttaatgttctgttagtcttctgattacaatggatactactctaacctactctaacatggtgcttacggtatattgctcatccatttaatagtgtagattagttaaatagtatatatagtgttatgtttacagtacatgctctggaagtagaactgcctggtttagagcccacacttgtcacttcttaggaaagtttgggcaagttattttatctgtatatctcagttataaaatgaggatggtattaacagtactttcctcatggaaattaaattgttacatgtgaagcccttaggtatttggcatgtgtttaacagtcaataagtgttggctattatttatttgggtttttttaaaagcagtgctaaatgccacacaaatttcttagaaatggcagtttaaatgagctgtgcaactttaaactttgcaaagtattttcataattgttgactttctgtttttcttgaaggaatctcgtaggctgtatcagtttcattatgtgaactggccagaccatgatgttccttcatcatttgattctattctggacatgataagcttaatgaggaaatatcaagaacatgaagatgttcctatttgtattcattgcaggtacaaaagaatttcccaagtttataaatacattatttaagtttgatgttacacaaggttttatttctgcattaatatgttagtaatcttgaatttctcctagccttgatacaatgtttgggactagggccttgtaagttgatgtggtctcatttggttgacagaccgtttagagtattgttgcattaaaacacaggatcatctatttgaaaatagtattcacatggtgggaagctatagaacatactctttttactgttcactgattagagcatataatctcagatcctcatcatactctactttctaaagtcagtatggtagtattttcttttaatcaatttccctgaaacaatgaccaagcaattttcattcctgataaacactgacatgagatttttaaaaacaggatattgctctgatgcccaggttggagtgcagtggcacaatcatagcttactgtaaactcaaactcctggcctgacgtgatccttctgcctcagcttcccaagtagctaggactacaggcatgtgctaccacactgaactaattttttttaattaaaaaaaattttttttaagagaccaagtcttgctctgttgcccaggctgatccgaactcctgtcctcaagtgattctcccactttgctctcccagagtcttgggcttacaggcgtgagccactacgcctggcaacatgactttctttttttaatatatgtaagatgtacatacgtaggtcttattgatctaagatatcatcaattctaagacacaccattattatatatattaacagtaaaaaaatcactgccaattataaggggacaatgtcatttgtaagaagccattggtggtaagatacataccaatctcagagctgttacattgagatgaaaaagtgtgttttagtttgatgaaaaactaaatgctgtttttattcttggggaacatcagtttccacgtttgcaccacttcctgtcatatcatgaaattttataatttatagctactgaaaaatttaaagccggaagcaagcattcttgtagtaaagtaataaaaactattgatacacatttactagacatttttattatgttttatagtagattacttcattataaggattacataaaattcaatgattactgacctagttaagctacctctgaatgtgaaaggacaagtataggtgcacctactttaaattgcacaatataaatcttttcatttattcaaataatatttgaagttcagttaggttttgcaaaattactcgtttggatgtgttaagaaatcatgtaaactcttcctttgactttgggggaatgaacatgagatttgtttattcttggggggcagttaattttgtattctagaaggggggttaatgtataatatattttagctaagagaaatcagtttaagataaccaacttttcttaatctaacattttggcttatttctgtcatctggtcattctcatacaaataatacaaagctaaatatacataatacatatgcacatatatgtatatgtatacattatatgtaatacataaaacaaagctaaatttgtattatggatttaggagtgtaatggaaaatacccctttaagaggaaaagcacaaaactgaattagtcaagaaaataataaatgtttgcaataagtgtcatgaccgggtatagtggctcagtgctttgggaggccgaggcaggatgattgcttgagcccagaactttgaggctgcagtagacaccaattacactactgcactccagcctgggtgacatagtagaccctatcttttaaaaaaaaaaaaagaatataggtatcattataatatgggtgatacaggatattttgaaacctaatttttggaatttcattatataggtatgggtttctacatagtagaagctacttgaatccttagacagtttttctactctgaatttttagtttacattagattcttctaaaggccttacagtcatagtacttacttcataagactgctatcaatttattcctctaagggacttgttatctgcattcacatttgttataaaaagtaaatgagatttttcaaacttaagagatttattttttattatttacatagttaaaatattttttcagtggagttgaagcattgaagatagttttcttattcacttggtttgaccgtaatgctcataattaacgaagtaaaagggctactttttattcatgggccaggaaagtaacttgctggtggagatgtgggaatcagttaacaacttggttcattaaaactatttttttctgtggttaattcagtggttagttgaccatttaattaagtaggattgaccagttaaaaataaacaatatgtttaattatagaattaaaagataaagaaattgctttcactttgacttcttataagttagttaaaataatttcctgttcaatcataaatccatttgtataggaaggcttttcatcaaaaactaaattgaccgttaaatatttttagacaatcaaaacagtacgttaactgtaaggacttagaaaacacatccataaaagcaagaaaattcttttgctttccactagttccactggagataaccattgttaaaactcgagaatgtgtcctttcagtgtgtgtatgtgtacatacagtattgttttgttttattttgtttgacggagttttgctcttgttgcccaggctggagtgcagtggcacaatctcggctcactgcaacctccgcctcaactattttaaacagcagtttaaatgcttagtggccactctgtttttttgtttttaatttactttaatggccatcttattgttaaatctttgagcacatctgcagttattaggacaaagttattattggataaatatccagaagtgagatttgttggtcaaggacataaacttttaaagtattttaatgagtattttttaatgtgttatccagaaaattgatgctacttaattctgccactggcagtatgtgagagtacctatttccctataccttccccaatactgtgtgttatctttttgtttgctttttttttttttttttttttttgagacagagtcttgcactgtcgcccgggctggagtgcaatggcacgatctcagctcactgcaacctctgcctcctgggttcatgcgattctcctgcctcagcctcccgagtactgggattacaggcacacaccactacacccagctaattttgggtattttttagtagagacggggtttcactatgttggccagactggtcttgaactcctgacctcatgatctgcccgcctccacctcccaaagtgctgggattacaggtgtgagccacggttcccagcctttgtttgcatttttttcttccttttttttttttttttttttttttgagacggagtcttgggctgtcgcctgggctggagtgcaatggtgcgatcttggcttgctgcaacctctgcctcctgggttcaagtgattctcctgcctcagcctcccgagtagctgggattataggcatgcaccaccacacccggttaattttatatttttagtagagttggggattctccatgtttgtcaggctggtcttgaactcctgacctcaggtgatcacctgcctcggcctcccaaagtgctgggattacaggcgtgaaccactgcgcccggcctcatcttttaatagttatacaagtgctttatatattgaggacattaacttttattcatgttgtaagtaccatggtttttcctgtcttctgcctgtttgcaatacataagtttcattttgtcatgtcagatttttgaatggtttttgtccattgagatatttgtacatagaaagtctttccctaacacaatagtgtatatattttgcatatatttttagtactttcatagatttactttttaacatttatcattggataaatatccaatatgtttatatcatatatatatatatatttttatccacctggattttttatggttaaggtatgtgatcagaatttaattttttgctcttcattgatagctaacttctcctttgccacttactgaacggtctgatctctggagaattcactgttatgtaagaaatgttacatgtactcagatctgttcctgaactttctattgtgtttcattgatctggttatctgtatctttatgttatacttttaactatcaaattttagatatatataatttatcccagtaactcaactaaaattctataaatgttttgatgcacagaattcacaaatgtatcaactaaaaattaatataattgattatgtttattaagagttttaaaaaatctttctaggttgtttatagtgtacttttatcaggaattttaggttacatgtttaacaaactgctgataggtatacatttcaaaatatgcattaaaatgttacacaactttgtgggggtttttgccaaagattattctggtgatgtcagtaacatcttataattactcatagtgattttcaattctaagatgcataagcctttctctagttgagaagcagttactttaaaatacttttgtcatgaggtttttttttttttttttttttttttttgagacggagtctcgctctgtcgcccaagctggagtgcaatggcgtgatctcagctcactgcaacctccgcctcccaggttcaagtgattctcctgcctcagcctcccaagtagctgggattacaggcgcccactaccacgcccggctaatttttttttttgtatttgcagtagagacggggtttcaccacgttggccaggcttgtctcctgacctcaggtgatccgccctccttggcctcccattgtgttgggattacaggcgtgagccactgagcccagcctgtcatgttttaaaataaaaaaacctatggtatgttactctaaagtccccagctcccattagttttttgggatatgagagcatatcattgtcttgttcttttgtggaaatcactgctgttgctcaatccgttttctagggcttatagcattcttcacctttcctataccttctatagattgaaatgatgtaccatttcctcctgtactctaaaacaagagccatcttttttttttttttttttttttttttgagttggagttttactcttgctgcccaagctggagtgcaatggcacgatcttgggtcactgcaacctccacttccccggttcaagtgattctcctgcctcagcctcctgaatagctgggattgcgtgtgtctgccagcacgcccagctaattatgtgttttcagtagagatggggtttcaccgtgttggccagggtggtctcaaactcctgacctcaagtgatccaccggcctcaggctcccaaagtgctgagattacaggcatgagcccctgcgcccagccacaagagccatcttgaacatagaataaatgtctctgtaagacgttgttagctagtcacattttctgatgtagcattagacttccagagtgacaacttagtagctattctctgtgtcacttactcttggaagttccttaaattaatttttgtttttctttttgagatgaagtcacactctgttacccaggctggaatgcattggtgccatcatggcttactgcagcctcgacctcccaggctcaagcaatccttctgccttggcctcccaaagtgctgggacaacaggcatgagccactgcgcccaaccccttaaaaatgaaatgtttaaaagatagaagacaataggccttccttattcaagacttcactgtcctcagtttcagttactcatagttcaaaaatatcaaatggaaaatttcagaagtaaacactttgtaagttttaaatgctgcaccattctgagaagcatggggaagtatgtcctgcttgcaagataaatcatcccatggtccagtgtgtacacactgtagactctaccagcccattagtcacatagtagatactgcagttaccagacggactgtcatggtgtcccagtggttatgttcacatgacccttattttacttataatggcccaaacctcaacagtagtgaggtagtgactagtgatagattgttataattgttctaatgtattattagttattgttgttaatctcttgttgtgcctgatttataaattaaactttatcataggtatgtacatataggaaaaatcatagtgtatatgtatatgtattctgtgtaacagatgttgccatgaacacactgtaagttgtattttgtttattactaagtagaattttgtcaaacttcttaaatgattttttgtttctgaatattaacatgtctatccacatttattttatagttgttttatcacaaaaatcaattgtttttcaaactttatatccttagtgcaggctgtggaagaacaggtgccatttgtgccatagattatacgtggaatttactaaaagctggggtaagaataattttttgtagcattatgttcaattgatctattatgattttcaaacttaattataattgcagtaaattatagtgtatattttattatacatgttattttttccaaagtagttttattaagtaagaaataaaggtagtgaaggccgggcacagtggcttacgcctgtaatcctagcactttgggaggccaaggtgggaggatcgcttgagccctggggctcgagaccagcctggggaacatagggagacccccgtctctaaaaataattaaaaaataaaatgattataaaaaataaaggtggagaaaaggtataattgctgcatattgcctttgataggatgcattgggcaacaatgtgacagtgttctaggtgagtgaatacttgcattaggatataaactgttactgacttttccaatactaaattttcattgcctttttttttttttcttttttttccgagatagagtttcactcttgttgcccaggctggagtgcgatggtgcgatctcagctcactgcaacctccacctcctgggttgaagccattctcctgcttcagcctccctagcagctgggattacaggtgcctgccatcacgcccagctaatgttttatatttttggtacagacagggtttcaccatgttggccaggctggtctcgaacttctgacctcaggtgatccactcatctcggccttccaaagtgccgggattgtaggcgtgagctacggtgcctggcccattgccttttatgtttactctaggtataagtgtatttcactcagtatgtatttatgcctgctggagacattatagtattgtagtctatgaatgctgactcgagccaaattgcccagattataattctggctttctcatttactagctgtgggatcttggtcaaaatactaatcccatagtgcctctatttctttatcagaaaataggggtcatagtagtagtaatgcataagaattaaataacttttgtgaagttcttcagaactatgtggtaaattgtaagtactcagtttattgttagtgttgattactgttgctgttgtgattgttgttcctactactgctttttccaagaaatagtgtttgatactgtggatgatacagagataaataagatacagccttcattatagatttgaaaaacaagtctcttcattatgtatacatttgattcttttgctggttccataatgtgttcatttctagagaggcgcctttaatccttcatagctttatagtttccatgaattgttcatctttgtcttgtacagagtagaattaataaaatgtttattttttctttttcttccttcttccccttatttctcttttttccctgccatctctccattttttattgttgcaaggaaatatttacatgttaaacagttccttaaaaagccctctggggttaaatatttttttcctcaaaaactataatcatctaattctcaaatgaaaatgcttaagtgaacaaaatttaactggaattcgatcacattttaacataaaagtcaaagattaaaattggaatgagaagggacacataaatgaatgctagcaaacaaaacaaacatttggtcattttaaaagttgtgtattttggataggtgccatggcttatgccataattccagcacttttgaaggctgaggtgggcggatcacctgaggtcaggagtttgagaccaacctggccaacatggtgaaaccccatttctactaaaaatacaaaaattagccaggcgtggtggccggcgcctgtaatcccagttacttgtcaggctgaggcaggagaattgcttgaacctggaaggcagaggttgcagtgagccgagattgtgccattgcactgcaaactgggtgacagagcaagactccgtctcaaaaaataaaataaaataaaagttgtgtattttgaacatagttctctctctctcttttttttttttttttgagatggagtctcactctgttgcctaggctggagggcagtggtgtaatctcggctcactgcaacctctgactctcaggttcaagcgattctcctgccttagtctcccgagtagctgggattacatgcacgcggcaccatgcctggctaatttttgtatttttagtagagatggggtttcaccgtgtttcgggctggtctcaaactcctgacctcaggtgatccgcctgccttggcctctcaaagtgctgggattacagacatgagccactgcacccggcctagttgttaagtcttcatgtaaaaatcttggctgggcgcggtggctcacgcctgtaatcccagcacttcgggaagccgaggcgggcggatcacgaggtcagcagattgagaccaccctggctaacacggtgaaaccctgtctctactaaaaatataaaaaaaatcgccaggcgtagtggcgggggcctgtagtcccagctactccggaggctgaggcaggagaatggcgtgaacccgggaggcggagcttgcagtgagcggatatcacgccaccgtactccagcctgggcgacagagcgagactccgtctcaaaaaaaaaacaacaaaaaaaaaacccaaaaatcttatgatgtatataaggacttccaagcagcaaacctggaaatcatttttaacccttccatcttaatcactccaaaatattcttgttgataacagttatgatatttctgcttctgtaaacctccgccagtttctcactctttcagactgtcctcttccttgatacaaaaattgtgtgaatatcagatcttctcatgtcaacattgcctattgcagtagtcgcaattccatatacacaaaagaattgtctaggtcgtttcataattagttccccaacttggagccaaaggatctatatttttacctaggtcttttagctggtccttatatagccaatccaggagatactggccaatagaataaattcagtctctttattatgttcacagtctgatcctaaatatccttatcttctctcctcctttgagtaccttctccttcttttagtcttaggctttgtttacatcaaacttctcaattccccacatagattatacattgaatctgctgtgcttatgtatatttccttcactttttatgggataaccttcttttgatatccaactatgttgtagctgcacacactcaacagttagccatagcctctttattccctgtatactgcagtcatactttggctggacataactgtctccccatcttgaatgctgagggtcaagaacagttttgtttccacagtgccaagcacagtgtctgagatgcattaagtggtgttcaataaatgtttgcagtaaaccagcaggtatttaagttttatgtgaaaagctgaagaagattttactattttctgaatagatacacaaagttgatgtattaaattttctgttttagaaaataccagaggaatttaatgtatttaatttaatacaagaaatgagaacacaaaggcattctgcagtacaaacaaaggtatagttgtttgtttccctttataaactgctattttataaatgctttcttcttttttaaaatgttgttttcattttgttttttaatcatttttctccttcataggagcaatatgaacttgttcatagagctattgcccaactgtttgaaaaacagctacaactatatgaaattcatggagctcagaaaattgctgatggagtggtaggtgttcttggtctattaattttaggaaacttttactctttgttaagatgtaatatttagccttttttttgttgtcttgtgttttgtctaacatgagaagaatatccaggacacttaacatttttacttaaactcatttccttcttattcgtatctgtattatgatggctatttaatgactccgatataaggtaaattatgttctaaatgaaataaagttaggaaagatctcatgtcaaaaatcatataattcgttaatgttttacttttttaaaaaataattgcattgttctctttactcttcccttccacccccacccaagtaattctgcattgattctacttgaatttcattttgtataaagtgttttagttatctgtgtatatgcttttcttttcttttcttttttttgagacagagtttcactcttgttgcccaggctggagtgcaatggcacagtctcagctcactgcaacctctacctcccaagttcaagtgattttcctgcctcagcctcctgagtagctgggattacaggcgcacgccactgtgcccagctagtttttgtatttttagtagagacggagtttcgccatgttgaccaggctggtctcgaactcctgacctcaggtggtctgcccgccttggcctcccagtgtgcaatgtgctgggattacaggcatgagccaacactcctggccttgtgtatatgcttttcagttaagcagaattaaagagccacagttaactcccttttgttgtgttataattcagtgttattttagccttgtaacatcttactggatattcaacttctagacctgacaaaaacactgtattctcttagtattctcatttctgcctttgttttctaaccaattgtcttgcttcaattctatatataaccaccttgtccctgaaggtgctgagattttttttttttttttgtagaatttgtttacatctttgtcattgagtctatgataactattacattgttaaaccaagtatgagaaaataagttgcaaaatttataaccttcattttccttttctccctttaaatggttttgtcagttcccagaatatttgtttgaattttcttggttttccaaatgacagatttattaccaaatgctgatctcagtttgttaggataatctaatatcggtccatgagttttaggaaatatgcatttcttttattagccaagtgacaatttcacgtttttaagttttatgtgacatcgttcttattcctttattaacataggaattattgtgcaaggaaatcctcctacaatgcctttagcttaattaaatcctattatgacatgctctgaatctagccaaatattttataatgtagaatcaaatgtgtttttgttttgttttattttgttttttgaaatggagtttcactattgttgcccaggctggagtgcaatggtgcaatcttggctcaccgtaacctccgcctcccaggttcaagcgattctcctgcctcagcctccctagtagctgggatcacaagcatgtgccaccacacctggctaattttgtatttttaatagagacggagtttgtccatgttggtcaggctggtctcgaactcccaacctcaggtgatccgcctgcctcagcctcccaagtgctaggattacaggcatgagccaccgcgcccggcctcgaatgtgttttttgtttgttttgtttgattggttttttttgttttttggttgttggttttttttttgatgacgaagtctcaccctgtcacttaggctggagtgcagtggcgcaacctctgcctcccgggttcaagcgattctcctgcctcagcctcctgaatagctgggattacaggcatgtatcaccacatccagctaatttttgtatttttagtagagatggggttttgcatgttggccaggctagtctcaaactcctgacctcaggcgatccccctgcctcagcctcccaaagtgctaggattataggtgtgagccactgcacccggccaaacatttgtattattttgtataatttaatctaagttgagatatttaatatttcgaaaagctgagtaggctataaacagttttctttaatttttgggtttttttttttttttttttttttttgagatggagtctcgctctgttgcccagaatggagtgcagtagcacagtctcggctcactgcaacctctgcctcccgggttcatgtgattttcctgcctcagcctcccaagtagctgagattacaggcgcccaccaccatgctcagctaatttttgtatttttagtagagacagggtttcaccatgttggccaggctggtcttaaactcctgacctcaagtgatccacccacctcagcctcccaaagtgccaggattacaggcataagctactgcacccagcatctttaaactttaattgaaaagcatttctgttttattccatgaattcaagattaatttcaaagctaaagtttttatatctggaaatacaggtttttaggctggatgcagtggctcatgcctggaatcccagcactttgggaggccgaagcaggcaggatcacctgaggccaagagttgaagaccagcctgggcaacatggcaaaaccccgtctctaccaaaaatacaaaaaagattagcctcccagactcacgagtacatcaccttgccgagtttattttttttatagagatgaggttttactatgttgcccagcctggtctcaaatccttggactcaagcaatccatccgcctcagcctcccaaagtgcaggaattataggctaaagttcttttattgcaatattcagtgtttgggttttgttttgttttgtttgagacgaggtcttgctatttcacccaggccagagtgcagtggaacaatcagggctcactgcgccctcaacctcccggactcaagctttcctcctgcctcagcctcccaagtagctgagactataggcacatataccacacctagctaattaaaaaaaaatttttttttgtagagatgttgccaggttggtcttgagctcctgggctccaacagtcctcccccacctcagcctcccaaagcactgagattacaggcatgagccattgtgcccagctattgttgtattttttaaaacttttaactatatttaaataatctccagaaaatatgtgataaataccgcatcaccttttcatctttttctaattagatcaaagtctgatctttgtaaggttttattccattgaatcaatccttttttaatatcctgaaatctatactaggattataattctatcataggctctttctgtctaataggtcagagctttacgggaatataataaaaaagtcatactttgtaggagatgagatgaaataatacccatagcagataagtagttaacttcaaacctactttcgtacctcattgcatggtacatagtagacataaactaaatgtttgagagaaatctctccatagatgaatggataaatagtaaaaaaaaacagaagaaaagatggattatcattccagataactttttagtattttcttcttaagaaatcatgttttctgtaaacttgtaaatataggtgactctttttataggatggctgtctgtggttgcagaccataaatcttaaagaaaatgtggaatctgaaaaattgagaaaaatcatcttagaactgtgtggttgaatgaaatgacttgaaaggtgtattaactatttagaagctatgctgtgagaagtaaaaataagtccccacttactacttttctgacaatttaatcggtaaaagttttgtttaaatgttctgtgttccagtattatttctgtagaaattttagtttgatatactagttggttgtttaagactttaaaatgaatagtgttttttagagatatttataactacagtgacttcctggagtgagagatctaaagagaaaatttattctgtaagcctgtatcatattgactgaggatttagaggtaccttaataagcaaacatctgttaagttgtgcagtgtgcctttttatcttgtgtgtaaaggacaccgttacaagtactgtcaacaccagtatttcagttctagaatgattaagtaatagcaataacagtttgtattatcgtccttttattgtgtttgtatagtacattttagatgtgataatgaattctggattttttttcctaaaatataatttttttatttttaaagcaccctgatttataatttattttcttctgcagctgataatattcttaaatattagataatttgtttcttaatgtttttgtagcatttcataaagctgttatatggaaaataacagtacgcaagataactttagaaagttctgtttaaaacaagagaacacaggctaggcgccgtggctcatttcatgcctataatcccagctctttgggatgccagggcaggagaattgcttgagaccaggagtttgagacctgccagggcgacaaagcgagaccccatctatacaaaacaatttttttttaattacctgggtatggtagcacgtgcctgtagtcctagctacttgggaggctgagatggaaggattgtttgagcccaggagttcaaggctgcagaggtatgatcatgccactgcattagattatttaattcctaaaattcttttccatttcaaaagttggtgattgcttcagcaagttgtatacatgacaaatgtggactcaaaaattataggtaataaaagagagtcagaagatgtgggtgtgtaggagacattaactaggaaatccaagaacattgtgaagtccagtgaccaggaggttttgtacatgctgtttaggtagtggctctttatcgaattgcagttctgcattgtcacattgattcctttcatcagaggaaactcagtatgttctgaaagctaatctctcccagaagctctcttttggttcttcctgttaatggcttcatcctgctcttactcacccagaatgaggaatccttcatgaaacctttactttctcacatgtagtgtttgcctaaaatgtccttactatctcttctctttacccttccacctgttttccttcttccaatcctcattcattttttgtcaaaatcttaccaatccctcaatgccattctgcattttaccttaatattgtcaacttactttttctcaattatattcttaatattctcaactatagcttttttttctgatttcatagcttcatagtactgattatgccactttggggctgtagtattacccttctactttttttctggggattttaccagactacattttgaagttaaagataataccatgtccttcttacattttagtatcctctgctttgctgactttattcagtgcatttcactagatgtccacattgccttacctgcagttccaaaatccaaagaaaacatagttttgttttgtttttgtgaattcaatattacactcacttggcaacaaaatatttcattgacatgacatgagtttatgtgtgctacaaaagaaaaatgctgttttgtatgttagaaacagttcaaaaggagtttcatatggtttgcctttaatttttatttaacctacttaatgcacattttggtacaaaatatcaagtgttacagaattatggttatatcattaatggaaataataagcagatgatcaataatatgttgggggtacttttttgtttttttttgagacggagtcttgctctgtcgcccacactggagtgcagagacacgatctcagcttactgcaacctctgcctctcaggttcaagtgattctcctgcctcagcctcccaagtaactggaattacagacgtgcaccaccacgcctggctaatttttgtattgtagtagagacagggtttcactatgttggccaaggctggtctcgaactctagacctcaagtgatccaccagtctcagcctcccaaagttctgggattacaggtgtgagccactgcgcccagcctagggggtacctttttgatgcagagtctctaaattctggtggtacctgaggatctgaaactttggcgaccaaaagtcctgatttgcgtgaggcacaccagttcacactagttgtctaggtttaataattaataatgcttctttttcattctcaaaagagccctgatttagacaataaattatatggtcaccctacctatagccagatatttctgcaccaaatgcctcgattttggtgggtggctttaattaaggaagaatgctttaagttttatgacataactctgttgttcttgtcaggaagtgatatgtataaaactattaattcatcagattatatataaggagatagggtgcacttaaaattgctaggaagttgagatctctagttgtttagttggaagtaattgaagtaacagttggacaagctgtcatgatggacatagtagaagtgccttttaattaaaaacaatgataacaaaacaaaatgcagctacggtttcagagttccttagttgatagtatgtgtaacgatggctgttgtctaaaattatctgagatgttggcaagggtgaaaatcattcctctcttctggacataacataccctagaattaaaataccctagctagataaatatgagatatgttgacagtgaaactaattcaaggccgtattttcatttcaccgctcccctattcacagtcctaaacctaaggttcttatacctgtattgactctgaaacatcaatgttaatgatgttattggtccttgtgaccagcaagaaccaaggatattctggggatgggctctgtctgcctttttgaggtccatttgggtagccagtgatataggagctatattccctaatggattagagcactccacatagtgacagagtgagagtgaggcaagaaatggttaaaatgaatcctaggaccaccagtttaaaagtactaggtagtaatggggagtcataaaaagatactccattacttggtaaatggtataagccttatttgttggctttttttttgtctctgcatatattaagttcctagtggtagtgatggcggggcggggggatactacgttctttaatccacattatcttggggaatctgtttttttacggtagcatttgagatgtgttgaaatgctgctgtacaccttgatctttccagtaactgtgatgcgctgtttttttgatacaatctctccattgaagtctggtccttcaggctaaaatatagagccagaatataagactttttttttttaacttggcaaaattggcattgtttaaggattgaaaagcacagaaacaatttagttgaaacatgaagaggaaaaattatttttctcttaaccttagtgaagtattttttcccttggcagaatgaaattaacactgaaaacatggtcagctccatagagcctgaaaaacaagattctcctcctccaaaaccaccaaggacccgcaggtattgtatgtcttcgaacattttctttaaaagcatacttgtttctactcactgttaattaaaatgacaaattctgaatatttctaaattacttttataacttttattattattttgttaggatgtaacatacgtatgacaactgatttgttactggtttattaaaaatttggtttcattttggataaaatttcaataatatactgtagcagaatgtggatactaccatgaattgactatggtttatgttttgatatgtgatataactaaaattttagttattctaaagattcccatttttttcctgatgactaaatatgcttgccaaaaattgcatgcatgttgaagtgtgaggatatttaataacgttactagcaaagatgagtttatttctttaatttttcttgcttttctaccaagctcatttataatagttaaaatcatatatattcatatctttcttttccttcccttcttgttcagggtagctgcttagtcagtaacatggtagtatggagagaatacagaggcagaagaagatagtttcaactcctttttagccatttagctctgggatctaggattaatttacttaatcctggggagaaggagttgtttaaatattgtcctaaggattaaataaaaaactattagaatattttatagtgtctttcttgcacatagatctgccaaaactgatcgacttcccatcaaaataaattcttttatacaggatacaccaattgtttccatcttaaaactttggggaaagttgggtcagacggccagggtcatgtcttagcattgagttgctaattccaagagatcattctaacgaaatcatctctctgaacaaaagaaaaagcctgcagcttccctcagtaactgaaggtttggttagaatccctgcacaccacaggaataatttattctcattttgaccatgcaagattctaactgcctgggaaggaagctgctgagtacagaaagaggcagtgtactctggtataaagaggctttttacataaataggtcccattccaaattttaactttagcatttgccactgaatgaactttgacaagccacttctctgaaaatactttacttcattgtagtgagagtactcgtattctccgtttttaaaaattagtgataatgtatataaagcatgtagttacatgcccggcctatagtaacagattttttaagtgtggtggtagttatagtctctagaatacctttgcatacttctcttaggaacctcaggaagcctatatatagatgaggttaggtctcaacatttaaatgttcgagatgttaactgtgtgctatcagaacttttagtagttctttcctgttcgatttccactttggtatccaccaaaactggttggcattttagccgtctgtggaaggtaaccagttgaaacctataaaatattaagttctctaacttctctgttccatataggagccctagaatcctaaaagaaactactggccctaaaaaaattaaggaacatttttgctgccctgtgttttaatttggtttttgagattgagccaatatagaggttttcaaagtctacactgatatttatgatttgtatgttcttctacctctaactacatgtagcagcagtctcttcttaattttacaggaaaaaagaatagaatatctgaatttaaagcctttttcctatacctgttgaaaagttttacttctgttactctctaataaacaaaaagataataaagaaaaaagcaaatgcatattaagaaaaaatattcaactcaagacagatttttattaggcatacattctaaaagttctttgtgtgtgattttataatacatgcataggtcaccttttttcttcttcatgtaatggagtcaaatgccagaatgtcattatttttgacaaagagaaccttgtgacttctaagttgggatgatttttagaactattataaattgttccaacataactgaaaataaaatcacaaaatcataagattgataacaagtaaaatagtatattttgtttttcagtatggctacagtaaacacattaattgtttgtttaaagtacatgatggggccaggcgtggtggctcacgcctgtaatcccagcactttggtaggccaaggcaggcggatcacaaggtcaggagtttaagaccagcctgatcaatatggtgaaaccccgtctctactaaaaatagaaaaattagccaggcgtggtggcacgcgcctgcagttccagctacttgggagactgaggcaggagaatcgcttgaacccaggaagcgaaggtgccagtgagccaagttcatgccactgcactccagcctgggtgaaaaagcgagactttgtctcaaaaataaaaaaagaaaaataaagtacatgttggctgggcatagtggctcacgcctgtagtcccaacattttgggaggctaaggtgggcggattgcttgaatccatatatatatatatataaaaatatgtgttgtgtgtatatttcatttttatttatttatttatttatttactttttaaacgtttttgttaaaaataagacacacacacacagtagcctaagcatacacagggtcaggatcatcaatatcactgccttctgcctccatatcttgtcctgctggaaggtatcgggcagaaacacacatggagctgtcatcccctatgataacagtgccctcttctagaatacctcctgaagaacctgcctgaagctgtttaacagttaactaattttttaacaattagaaggaatacactcaaaattaacaacaaaaagtaagtacgtggccaggcgcctgtaatcccagcattttgggaggccaaggtgggtggatcacctgaggttgggagttcgagaccagcctggccaccatagcgaaaccctgtgtctcctaaaaatacaaaaattagctgggcgttgtggcgggcacctgtagtctcagctacttgggaggctaaggcaaaagaattgcttgaacccgggaagtggaggttgcagtgagccaagattgcaccactggactccagcctgggtgtgacagagcgagactccatctcaaaaaaaaaagtacataagccaataactattttctttatcattattatcaaggattgtgtcctgtacgtaattacatgtgctgtgcttttatatgactgacagcatagtagctttgtttataccagcatcacaacaaacgtgaatgacgcattttgctacaaattcatgggaatttttcagctccattataactttgtggggccaccatgttatgtgtggcccatcattgactgaaacgtcacatgactgtacatgtctttcagtaatttttaatattccaattctttctgttttattttgttttgttttcagacagagccttgctcttttgcgcaggctggagtgcagtggtgtgattatggctcactgcagcctcgacctcaattgaacctcccaccctagactcccaactagctggaactatagacacacaccaccatgcctggctaatttccgtattttttgtagagatgggttttctccttgttgcctaggccagttttaaactcttgggctcaagggatccacccattttggcctcccaaagtgctgggattgcaggcgtgagccaccatgtcccaccagtattccagttcttccagttcttaaaagtgaacagaactaggaatgactgggcatttgacagaagcctctaatatgaaaaaacagaggaaatggagacaatacagagtaaaatgaaaaagatgggggaaaaaagaaacaacagtccacttttctcagtcattgggaaatgctgcaaccacgaaataagaactgtgggtaataagtaagaagctcttagaaattaagaatataggccaggcgcagtggctcatgcctgtaatcccagcactttgggaggctgaggcgggcagatcacaaggtcaggagtttgagaccagcctggacaatatggtgaaacccagtctctactaaaaatacaaaaaaaattagctgggcgtggtggtgtgtgcctgtagtcccagctactcaggaggctgaggcaggagaatcgcttgaacccgggaggcggaagttacagtgagtcgagatcgcgccactgctctccagcctgggcaacagaatgagactcttgtctcaaaaaaaaagaaagaaagaaattaaaatactataaatttaaaaattaagcagaagtttggaaaataaggaactccattttccaataaaatttccaaaataaagaaattcattcatttcaagaaaatgaatggataaagaaaaagtaggagagaaaagataaggaaattagaaagcaaaactagaagatctgtcactgaactaataatagtctaaaaggagagtagggaagaagaaattagcaaaaaaaaaaaagaagaaaaaatgtgttagaattaaagggcataaatttttatatagagcgtatacaccaagcttgatatacaccaccaaatgtgatggataaaaataaaattgttaaaaaatatagttttttaagttacattatgaaattatagaacatccaacataagaaccttgcttaggtttagagtaagataaaaataatgctgaaatttggagtaagtttttttaaattaaaaactttgaaaatactcgattaacaaacccatatatcatactcgatatctgtcaagcactgttctaattgttgttcagatgttaactcatttaattctcctaactaccctgtgaaaaaggtactgttaaggatatatggggtttgttaatcaagtaaatctgtaaaatactggtcatgaggccgggcatggtgtttcacacctgtaatcccagcattttgggagcctgaggagggcggatcacttgacgttagaagtttaagaccagcctggccaacatggcgaaaccctgtctctactaaaaatacaaacattagccgggcgtcatggcgcgtgcctataatcccagctacttgtgaggctgaggcaggagattcgcttgaacctgggaggcggcggaggttgcagtaagctgagattgcaccactgtactccagcctgagtaacagaatgagactctgtctcaataaaaaatatgtaaataaaatactgattatggaaaagtggtctcaccatgtacacgtagggaaaataatacacctcaatttatatcaaaattttatctcatccttttaaaactcatattttctatttgtattataatatgttcttaggataacctattggtctttgcatatgctttataaattgtaggaggtgtctgcaattatttttgttttagatcgcaaaaatttgacagccactctttcagattaagaaccaacttgtaggccaggtacaatgcctcacacctgtaatcccagctctttgggaggacatggcaggtgaattgcttaagtttaggagtttgagatcagtctgggcaacatgaacatggcaaaaccacatctctacaaaaaatacaaaacttagccaggtgtggtagtgcacacctgtagtcccagctgcttgggaggctaaactgggaggatggcttgagccctgaaggcagaggttgcagtgagccaagatagtgcaactgtactccagcccaggtggcagagcaggaccctgtctcaaaaaaaaaaaaaagaatctacttgtaaaacttgaacagatataggaatatcttatgagagtattgctgtcattttaatatgatcagtattctggagatattcatttatcttctcatgtcctaggaatgtgggaatgtgtctagagaatctgaacttcacagagtctttatttatttattttatttattttgagacagagtcttgctctgtcacctaggctggagtgcagtggcgtgatctcagctcactgcaacctctgcctcccgaattcaagtgattctcctgactcagcttcctgagtagctgggattacaggcgcacgctaccatgcctgactagggttttgtgtttttagtagagacggggttttgccatgttggttaggctggtctcaaactcctgatcttgtgatccgcctgccttggcctcccaaagtgctaggattacaggcgtgagccaccatgcctggcccacagagtctcttttaaggggaaacctggtgtaccatgtgattactgccagttatctggttggataaaaaaaggttgatcacctggggggagaaaaaaaagcaaaaactctgaggtggggtccagtggctcacccctgtaatcccagcactttgcgggggccgaggcaggcaaatcacttgaggccaggagttggagaccagcctggccaacatggcaaaaccccatctctactaaaaatacaaaaattagccaggtgtggtggcatgtgcctgtagtcccagctactcaggaggttgaagcacaagaattgctggaacccaggaggtagaggttccaatgagccaagatggtgccactgcactccagcctgggtgacagaacaagactctatctcaaaagaaaaacagaacacaaaaacttaaatatacaagccctcaagaagtttgcttcatataaagttcttaaaaagcaacaaagcctgggcaacatagtaaaccctatcttcttctttggtttttttttttttttgagacaggatctcattctttcacccaggctggagtgcagtggcatgatcagagctccctgcagccttgacctccccaggctcaggtgatcctcctacctcagccttcctagtagctgggactacaagcatgcattgccacatccagttaatttttttgtatttgttaaagacacagggttttgccatattgcccaggctgctcgctctctctctctctctctctctctctctctctctctctctctctctctctcactctcactctcactcgcgctctctctctcgctctctctctctttttttttttttttttttttttggagacagtcttgctctgtcgcccagactggagtgcagtggcgtgatctcaactcactgccatctccacctcctgggctcaagcaattctcctgcctcagcctcccaagtatctgggactgcaggtgtgtgccaccacacctggcaaatttttgtattattagtagagatggggttttactgtgttgctcaggctggtctcaaactcctgagctcaattgatccacccaccttggcctcccaaagtgctgggattacaggcgtgagccaccatgcctggcccctatttctttaaggaaaaaaataaaggcaactagagggtataacccacccgaacaaaggagtatacccagaaagaggaaaatgagacctgggaaacaggagaatctgaaaccagagagaacattagctctgtgatggactagggaaccagtagtccacactggagcaggaggccaaaagttactaacaaggatgtctgtggtattgatacttactatgtgtgcttgtcattattgagaggaggtataccaatctgcaagaaagttagaagaaaagctgagtaactgatgatgcatagagagctaagccatcagaaatccaaggcagtcattaggggaaaacaagacactatagaagaaaagatacgaaatcatggtgtcatagatgggaatactatctgcagtcatacgactgaggtaatgaaaaattacaatataacagtattggaaagatagagaaggacacttccacagtaggaagtcagtagaaaatgtgtgaaacaaagatcaagaaataacttttgaaatagtctgaaatacagaggtgtaaattttagaagcagctataaaaaaatgttgaaagttgatgcctctggctaacaggagggctgcggggcagagactatgtttttcattcaaagtcttgtatttgactttttaaacagtatatgtgtattaccttgatgaacattaaattttcttagtctgaaaaactgcagtttttattcgcaaccagattgtaatggctcttaatatgctactcttagctacataattctcaggtatcaacttgtttaacagtcttaaaatgccctttttaaatgtttgtttttcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaaggtaataatatagtgtcaaatacttaaatgtctttcctatgtgctagtcactgttttaagcactttagctgtattgatttattatgttttattccacactctaccatagaacctacagcaaaatctgtcttagatactaattttttaatataagcttttaatgtattgttaacaatttggtcacattatattactgggttttgtgtttctaaattattttagtagttataactggataacttattttctttttcttctgtattatagatcttagtgtttttgtatcggtcaaaaatttatctgactgaataattagaaataatttagggaagaatcacttaaaataacagtggcaaaaatactgtagaatgtcttgattggccatataatgttactcgtttttcctaaatgtttagtcattttttactgttcctttaactacagattacatttttttgtttgtttgtttttactgtcttcacaaatgcttccaaatatggctgcttccaaccctgagtttaacccaggaacaatactgcaaactgctcaattcagtagtgagtgggctatatgcatacctactcatcaaagctattatttaaagaattattatttttttagcactcttagcatttcaagataatgcatgcactcagttcccaaagtgtattattgcttcttgaaactcctctttgatctgctgaaagtaatgatggctaccatcttaaacagaccctaaggttgagagtaaacatataaatttgaaagctgtttattgatatattgattatcagtggtcacttacctatcagtgaactttggtagtgacacatacagactggtatttataacgtgcaggcaaaataagtactgtgaccttgaaagatttttttttttttttgagacttgcactcaaaagattttttttttgagtcttgcactgtcacccaggctagagtgcagtggcaagatctcggctcagcctcccaagtagctgggattacaggcacccactaccacacccagctaatttttatgtttttagtagagacagggtttcgatatgtttgccaggctggtctcaaattcctggcctcaagtgatctgcccacctaggcctcccaaagtgctgggattacagacgtgagctaccacacctggccttgaaagattattttctatttctgacccattatataccacccatactgtagtgcttgtattttctctcacacatactgtattttttaacttgagagagtgtatttggtagactagatgacagtctttttgagacagagttttgctcttgttgcccaggctgaagtgcagtggcgcaatcttggctcactgcaacctccgcctcctgggttcaaggaattctcctgcctcatcctccctagtagttgggaatacaggcatgcgccaccatgcctggctaattttttgtatttttagtagagacagggtttcactgtgttagccaggatggtctggatctcctgacctcgtgatccgcccacctcggcctcccaaagggctgggattacaggcgtgagccaccacgcccagccaggtgacagtcttaaactatttgcttaaattacagaattatcttttcttgatttatctttgttttatttgaaggatctttagaagataatgaatagtataatattactttaccagtttaccataattttaaattgctaatgtcttttgttcctcagcttcagaatttgaaatataactgcccagctgtaactatataagaaaatatgtagataagaaattttcattttgagtttttagtatatcaagcatgtggtattgtacctaggaagttttattgtttttttgttgttgttttgttcttttgcttttttttttaaaaaaaaccaaaaaaccattactggaaataggatttggtgagggccagaaagatgtatgatgtgatatgcttattaaaagttactactacatgacgagtctgttggtggctcatgcctgtaatcccagcattttgggaggctgaggcaggaagttcacttgagcccaggagttcataaccagtctgggtgacatagtgacacccaatctctacaaaagataaaaaactagccgggcatggtggtgcacacttgtggtcccagctactctggaggctgaggtaggaagatcacttgagcctaggagctcaaggctgcagtgagccataattgcgtcccggcactctgcctgggcaacagagggagaccctgtctcaaaaaaaaaaaaaaaaaaagagtaagatatagctaaaagcaccctactatgtgccagctcatttctgtttgtttggttttgtatttcaaagcaaaaatcactatacatgtgatttctggtttctttttactcaaccttaactatgttattggtttgattttaaccgaagattttcctgtgtgtaaatgttctttgttgcagcataactacaagtagtctcatttttaatgtgttgccaaatatttaccatatggattatttactttatagattgtttatttaccttatagattattatttcctttgtagatcattatcttatagagccattggcaccagaattagagttttggggggttttttggtcctagaacttgttagtgaattacagtcacacatttcttaatggcagggatatgttctaagaaaaatatgtcattaggcagttttgccattgtgtgaatgtcatagaatgtatttacacaaacctagatggtatagtatatactacacatctgggccatacaatgtaacctcttgctcctaggctacaaacttgtatagcatattaccatactcaacaattgtaacacaatggtaagtatttgtgtatctaaacatagaaaaggtacagtaaaaatatggtatcataatcttacaggaccgctgttgtttatgcggtcttgttgatgaaaacatcattatgtagtgcatgactataatggaatacttttgtattgatacctaaaaaaaacttttgcataagttactgcctgacaaaaattcttagctatcaattctaatttcagtcttgacttaggcctcctgaaagatttctcagattcaactacagaaggccccatacagtgtatgatttgcaaaagcctatataaaatacgcaatatctggttggataacctctaaaacaaaagtttttaacaggaaaggcagcccaaagttccagggagaaacatgcatttgcaaagcaagggccacgcttagaaaataaaagtttttaagggtgagaactgccatgagagaaaaagcacagagtttctggaagataactgatagaaaaagggctgaactgccctttttgttttgttcatttaatttaagaaatggtaccagaatgccaagattatgtgtcccttccttccaacagccatctcttcactgtgcgctgttagtagcaagagggcaaggagacatatggtgatgactcagactaccactactggataaggtagatagttctttagtggcaagagagagttctggtactcttggtagatgtatcaagtattggactggaactcctctttcaggaggacccagaagctgtattttcttgcgtctccagctaaataaatgtaggtggggcaaaagcaatcatactcacctcatgcgtgttgaaaattgacaagacctatgcatagccatcaggtgtggtaaaatagcagagtatcatggcagaactgtgtgttcatttaagaacaatgggcaaggctcaagacaaaataatacaggaccgtcgcatttctttttctttatcccaccctccccaacctgagagttcacacacaggattgtattcttatattttctttctattcctccagtgaaaactcaaagatcaaatacactcatttaccttaagccataataaagctaaccaatgaggcttacttaatgcactctctttcccaagagctaattttgtttttactagtgaaaaacctgtatatagcttcagtcagcattctcaaagtacagccatgtgccactgtacacaaaatctttagcaataaataaatgaagattttttaaaaaactttaatagctatatctttatctgttttggaaaaataactagtatttccaatgttatttcagttattgctgtttaagacatgactgaggtacacagttaagtttaaaatgagtcagattttaaaagtgaataggacacatgttacatagtatggcaaaaatcatgaaaggtgttaagcaattgaatcctgtttgggaaacactggcttaggcgtttcataacgcaaatgaccaaagctttcctttttggacacaaaacatcatcagtaagctcagtagagaagtcacttgccagctgacttctctactgaagattcccttcaggcttggagaactgaatgatgtctgtagagtgacaggaaagtcatgggagagagtcatttctgtatacattatctttgctcaataagcatcataattcttgataatgagtggaaaaggtttcttgcatttttttgcatttttaaaaactgatctagatatttgtgacaggaatttttagaatgtcaagaaagctctctgattttgtttagatgacatgttaatttgtctaaatttttatgtgtttaatttagatgttgatgttagtgaagattcacctcctcccctacctgaaagaactcctgaatcgtttgtgttagcaagtgaacatagtgagtgtctcttttgcttttacatttacttcatattctaataataaactccgaaaaacatacctgattttaatctattagctattgtgctacataattaaattcaaaaacaagtaaattgatgttgacatgcttttaattctttgtttgaaaaatgcttttaaattatattttttacttgctaagatcgatagaaattactgcatttatgttagatatcagaattcaattcatttaaatgtaattataggctgggcatggtggttcaagcctgtgatcctagcactttgggaggcctaggcaggtggatcacctgaggtcaggagttggagaccagcctggccaacatggtgaaactccatctctactaaaaatataaaaattagctgggcatggtggtggacacctataatctcagctacttgagaggctgaggcaggaaaatgacttgaacccgggagttggaggttgcagtgagccgagattgcgccattgcattccagcctgggcgaagagcaagatttcgtctcaaaaagtaaataaataaataaatgcaattacaaagccaggtgcagtggctcatacctgtaatcccagcaccttgggaggctgagatgcactgatcacctgaggtcaggagttcaagaccagcgtgaccaacatggagaaaccccgtctctactaaaaatacaaaattagccaggcgtggtggcgcatgcctgtaatcccacctacttgggagactgaggcaggagaattgcttgaacctgggaggtggatattgcagtgagccgagatcacactattgcactccaacctgggcaacaagagcgaaactccatcttaaaaaaaaaatgcaattataagtgtatttgcaatctggtgtattttcattcattaaaaatagcacttattgactcatgcctgtaatcctgccactttgggagaccaaggcgggcagatcacgaggtcaggacatcaagaccatcctggctaacacactgaaaccctgtctctactagaaatacaaaaaattagctgtgtgtggtggcatgcaccagtagtcccagctgctcgggaggctgaggcaggagaatcgcttgaaccccggaggcagaggttggagtgagccgagaccatgccactgcactccagcctgggcaacagagcaagactccatctcaaaaaaaaaaaaagtagcacttatttatgaaaacattaattgctttccttagatttaggtcagtaaacatttctgttgggtgggcgtcactggattggtgttaactgaaagacatttaacaccactggagtagactgagcacattggctcatacctgtaatcgcagcactttgggagtccaaggcgcgaggattgcttgagcctaagagtttgagaccagcctgggcaacacagtgatacctcctctcttctaaaaataaaataactgtccagttgtggtggtgggcgcctgtaatcccagctgcttgggaggctgaggcaggagaattgcttgaacccaggatgcagaggttgcagcgagctgagaccacgccattgcattccagcctgggcaacaagagcaaaaaactttgtctcaaaaaataataataacaacaaaaaattagccaggtgtggtggcatgtgcctgtagtccttgctactcaggaggctgaagaagaaggattgcttgatccctgtagttggaggctgcagtgagccatgatcgcaccactgtactccagtttggtaacagtgagaccccgtctgtggaagaaaaaaaaaagaccactggagtatcagaactgggagaaagtgatgatactttaaaacattgataatatacttctccctattaatcctctaaaaaagagtgcagaaacagcttgattgtatttacagtgtctcatgctcagtggaggtgctcacttgtctaagtacattttaccaatatattaattttgactgatttttgttttgtttcatttggttttctttttatttatttattttttatttattcatttttttgagatggagtctcattctgtcgccccggctggagtgcagtggcacgatctcggctcactgcaagctccacctcttgggttcatgccattctcctgcctcagcctcccatgtagctgggactacaggtgcctgccaccacacccggcttatttttttgtattttttttagtagagacagggtttcaccgtgttagccaggatggtccatctcctgacctcatgatccgcccacctcagcctctcaaagtgctgggattacaggcatgagccaccacgcccggctaatttttttgtatttttttagtagagacagggtttcaccatgttagccaggatggtctccatctcctgacctcgtgatcgcccgcctcagcctcccaaagtgctgggattacaggcgggagccaccacgcccggccttgttttgttttatttcgagttggagttccactctgtcactcaggctggagtgcagtggcacgatctgggctcaagctgttctcctgcctcagcctcctgagtagctgcgattagaggcatacaccgtcactcccaactaatttttttattagagatagggtctcaccatgttggccaggctggtcttgaactcctgacctcaagtgatctgcctgcctcagcctcccaaagtgaattttgactgattttaagataaatgttaaagagccaagcacaatggcttatgcctgtgatcccagcactttgggagaccaaggcaggtggatctctgttccatttgccctaggagtttgagaccagcctgggcaacatggcaaaaccctgtctgtataaaatcaaaaattagccaggcgaggtggcatgcacctatagtcccagctactcaagaagctgagatgggaagattgcctgagcctgggaggttgaggctccagtgagccgagatcgcgcctggtcaacagagtgagaccctgtctcaacaacaattaaaaagaatgttgaaagcaatgaaacggtatacttcagttgtctaagtctgtcacgttgtctgtagattaagcagtatacttcacttgtctgtcacattatctatagactgtaatacactgatgactgaatttatttacttaggttttgaaggaaggaaacagaatgttctcgaattaatagaaactacaattttttttttttagaaacttcagaaatatgcttacccagaaactacaaaatttttgtggaagcgatagtttctaaaatctttaggatctgttttttgtattactttaatgcaaagaaatttcagaaattcaaggtgttaataacaataagatttcatttttctcagatacacctgtaagatcggaatggagtgaacttcaaagtcaggaacgatctgaacaaaaaaagtctgaagtaagtccttttggaattggaacagttatagcttaacatttctactcttttgttaactaatcttgcagttgttgaaatagctgtcatcttaagatcgttaaatatagtttgtaatttttgatcggcatttcttatactaagatttcagatgaaaagcccatataaaaggtaggttctgaaattttttaaaagggtaacctgatctacatacaactatcactttaaagtattgttttctcaagctgtttttgaaatatgtaaattatgcttcaaataattttgaaggtatgaatgaaataggagttactattttcagggtcctaattctttcttacatttctagatgcttcccattataacactaggcacatagtcgcttcttttgtttttttctggctacctggcatttctttgacattcgagaaatgttttggcaattaaatattttgagggcgtggcatggtggctcatgtctgtaatcacagcactttgggaggccaagcagaaggatcacttgagcccaggagttcaagaccatcctgggcaacatggggagaccttatctctacaaaaatttttaaaattagccaggcgtggtggcgcatgtctatggtcccagctttttgggaggctgagatgggaggattgcttgggccccagaggtcaaggctgcagtgagccatgatcacaccactgcactccagcctgagtgacagagtgagaccctgtctcagcaacaacacatttgtccataggagataacattttttattaacattaatactttttgtattttctcccatactttaatatctctgaaatttagctacatcttatatttgattttaagacatgatgtagtttaattgacatataaaatacaataatgatataattagtaatagtggctggcaaaacacagctgtatgttccttcatgcagtagcccatgcttttcagtgctcatccagaaacatttactccaaggagaaatagcataacattttaaaattttaagcctaattaaaaaacaattgtttgcttttcctctgatgctgaaaatgataggccttgatttcttgggatatatacccataacagacccagctttctattatttgtatataaaatgaatgtattgtaataggtattaaatgtcttcctcgtagggcttgataacctctgaaaatgagaaatgtggtaagttgttagattttttttttcctttttactgtagattttattgattaatttctacaaaataacatgcttcatagttcatgctatatagttatttctgtatgtgaaaatgtctaggacaactcttgtagaagcttaatattgtactataattcttccaaattaattattaccaccagatagtagtattgatctggaaaatcatgggagcatttactatcaataattacaggctaatgggaaagagattttttaaaaatatttttctgttttttattttctgtttttaaaaacacctagaagttagatcccgacttaaataaatgatggaattgcttctgtagaaacctattgttttagaaatcttccttttagtactttttcatttatttgtgaagaccaataaaattgtgaaagaatgaatgaattttagtagttaacatcttttgttactaatcttaaacactggtaattaaagagtaaactacaatctaaacaacataaaactttaaaagtggagttattaggcctggcgtggtggctcacacctataatcccagcactttgggagacccaggcaggcaatcacctgaggtcaggagttcgaaaccagccttgagcaacatggtgaaaccccgtctctactaaaaataaaaaaaatagctaggcgtcatgccatctgcctgtaatcccagctactagggagactgaggcaggagaatcccttgaaccccggaggcagaggttgcagtgcgccgagattgcgccattgcactccaacccgggcaacaagagggaaactccgtctcaaaaaaaaaaaaaaaaaaacaagtagagttattatttcaaggtgcaaatagtgcattaattaaccctgaccttgttgatttcttaaattttttttttttttttttttttttttttttgagacagaggtcttgctctgtcgcccaggctggagtgcagtggcgcgatctcggctcactgcaagctccacctcctgggttcacaacattctcctgcctcagcctcctgagtagctgggactacaggcgcccgccaccacgcctggctaatttttttgtatttttagtagagacggggtttcaccatgttagccaggatgatctcgatatcctgacctcatgatcggctcgcctcggcctcccaaagtgctgggattacaggcatgagccaccgcgcctggcctgaccttgttgatttctatacaaagacatttcagttgcaactattcccttagaacataggcatatagtatagctaccttaagggaatgtaatatgtcaagacctagatttatgaagtaagaataacgagaatcctcacattgcagaagtactcactgcagatttctgtgtgaccacaataatacctgacatgattttctgtgcacactacacttgtatttatattgttcttgacctgtaaaattatggtgcccaggagagaaagttttctcttttcatgcttgccaacatttaaaaaattaaagagttatatatatatgatgctacaaaggatggtgattaacaaaggctttgtgttgctacttagatcatccagcgggaggtattcactatgaaatgtgcatagaatgtccacctactttcagtgacaagagagaacaaatatcagaaaatccaacagaagccacagatattggtaatttgtttaataaataatttttagtaagtagttaacactggcaggaatgagaaaagctcatttgccattgtgaaatgacacttgccaagaataaaacatgattttccaaagttgcttggactagtcatgaaataaatgaaatacttaattctatttcacattgagattaaaaactaaaatagaaaactgcagtataaaaaatcttttgtgttggaaagactaaattatcatggatatttttcttacattgtgataaaattggttttatttccagcataagatttttaaaagaagcaatcattttcagttattccaaataaatttacaattgttttgcatttaccaagttttgtttggcttaaattctaaattcccttgtggaaatttatttgttccagaaaatgagaatgtctgtggacatggtttttagtagtttgaaagtatttctgaacactgactagttattgtggtgttttcactgtaggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgcctacttgttgccttggcttttcatttctcattcctaggatattggacttaactatcagcctttttgctggctcagtcttggtatgaaatgaatgtgaatggggtttaatttctttttttttttctttttttagacagagtattgctctgtcacccaggctggagtacagtggtaccatcttggctcactgtaacctccacttctgaggttcaagtgattctcctgtctcagcctcccaagtagcctgccacgacgcccggctaatttttgtattttcagtagagatggtttcaccatgttggcgaggctggtctcaaactcctgaactcaggtggtccacctaccttggcctctccaaatgctgggattacaggcatgagtcaccatgccaggcctaatctcttaattaaggaatagagagtaccttctgcaaaaaacatggttctgcggattctaaatacttattgcccctaggcattcctcatccttatcattattagcctaccaaagtcctagtagaaaacccaacagagggggccagaccgggtggctcacgcctgtaattccagccctttgggaggccaaggcaggcagatcacttgaggtcaggagttcaagaccagtctggccaacatggtgaaaccccatctctactaaaattacaaaaaaattagctgggcatggtggcacatgcctggaatcccaggtattcaggaggctgaggcaggagaattgcttgaaccaaggagatggaggttgcagtgagctgagatcgcaccactgcactccagcctgggcaacagagcaagactacatctcaaaaaaaaaaaaaagaaagaaaaccaaaccaaggggatgttgagaacgggaactggtttcttgtcatcccatgactggagcacagattccattcctcaatactaagtctgaattttcacaaccatagattggaattgttggatatctgtattttccatctgcatacaaaagattgaagaaattgtaaaactaaagtacatggaaaaccttatatgagtagaagggggattgttgtggaggagaaagtaatactacaatttcatgttaaatttgttttaaagctaactggtcttcatgttgatccctgttgatcccttaggattttttttttttttgagacgaaactttgctcttgtcgcccaggctggagtgtaatggcgcaatctcggcttactgcaacctctgcctcctgggttcaagcaattctcctgcctcagcctccttagtagctgggcttccaggtgcccaccacaaagcccaactaattatttttgtatttttagtagagacggtgttttgccatgttgaccaggctgttcttgaactcctgacctcaggtgatctgcccgcctcagcctccgaaagtgctgggattacaggcgtgagccaccacacctggccaatcccttagaatttgaaaattttctgtatgctttggtaataaggaagtggtaatacagtagatgcttgacattttcaagacacaggcactcttgtaatagatctattcctaatacaatgtaaactgaaataaaagcataactgaaaaaatttttagccccttcacacacttgatgagttatcgtagactactaaaatcataaggatttttgtggttggggtggggtttcttggaataccttcactgaagtatacatgtattcagaagtatgcaaaaatcgtattaattgccaggtgcagtggctcacgcctgtaatcccagcactttgggaggctga

SEQ ID NO: 16614 - DNA, 7716 bp, Human
cccttgcaaataataaatggattaataataacaaggtatgaagttctttttatagaaaaaaaggagagaattgaaactaaatgcggcagttagacaaccattttgataagaggataattgaggcgacactggtgtataattagaggataatttatgctatatccacttttattccacctcccaaaataaacccagtccataatcattacaggcaaattgttctgaattttatagcagcaatttgaacaaagtactgcagttaatcatgggagatttttgtgtattcctgattagaactctaattgcctccttccagaaagtaaaaataactgtaaaacgactctatttttatcattaacaatgttgacaataaaataaaatcaattggaattgtaatcgagagacaaatttaggacgaaggcacttttacttgggtagtttatattgtaatcaagatttgccaaaccactaaccgcatgtatcatttgcatatatttgaaagcattacagtagcttctgttttcaataggaaaaaatgcattactgtcagtcctccaacgattcgttttcagaacacgctgctgcgttctgaaaagaaaaaaaagacgcccccccccccacaaccttttgtacaatatataagaaatacggcctgaaacggcagggaccgagccagaacagggtctgatttttctttttctttaccaccccccagtggggtggagcccaggtgtgagggttcgtcttccttctgtggtttcaataaaatacgtctagaaaaatccacggtgacaaggagctcccacaagagtgtagtaggaccagagtggcagggacgtcaagaaaggggggcctggatttaatgcgggggtggggtcactgcttctaagcacaggcaacctacaagggtgcaaagggattgaaagagagcagcccccagttggctgtttcaaggctgagatattggcaactggggctccgggatttggagcacgagctgcggcgggaagcatcggcggccggccgggcagaggcgcctccctccccaacggccccgggcgccacacagcgcggcccccggctgcagctccggctgggattggaactgcggaaggtaggcgaagaactctgcaagtcgcgcacacgccagtagaagccgtgcgcctgtgacgtcagggggcgactgaccaatggggaggcactgccctttggagacaaaccattcgactcgtggcgtctgcatcaagtctgaaagcagacgcgcaactttcgcagaatccaccttaaaatctctgccttaaactgcaccagcccccaaaaaatccaaggggggaaagcaggcggggggagagcagattcccccctccccctctcctctcccatccctcctccttcctcctccctttgagttaacaaggccccgctcactatatctctttatattaaatatatatatatattagagaagagcgagggagagggagaaccacctccacccccctctttaaattcttttttttttttttttttttttttgcaaggatccaaagagctaaggtggctgcagaggggagagcggcgcgagccaagtgggggagggtggaggaaacccgggagaaggctttctccagcccccaaagtttttgatgatgaccatgactacgatggctgacggcttggaaggccaggactcgtccaaatccgccttcatggagttcgggcagcagcagcagcagcagcagcaacagcagcagcagcagcagcagcaacagcaacagccgccgccgccgccgccgccgccgccgcagccgcactcgcagcagagctccccggccatggcaggcgcgcactaccctctgcactgcctgcactcggcggcggcggcggcagcggccggctcgcaccaccaccaccaccaccagcaccaccaccacggctcgccctacgcgtcgggcggagggaactcctacaaccaccgctcgctcgccgcctacccctacatgagccactcgcagcacagcccttacctccagtcctaccacaacagcagcgcagccgcccagacgcgaggggacgacacaggtgagaggccgctggggcagctcgcttctcccgcctcccgactgccccctaccccgcccgcccgctcacttcctcgacgcccgggcctccgccggccccctcccccaggcggccccgcgcgcccttggccgggccccgtgcgcgcccgctcgcctggcgcctgcctgccggcctctcccagccgggccccttcccgccgccgcggaccctcagcttccgacgcgcagttcgggctgagtcccgggcccggcgcaggcttcgttcgacgagttagtccacactgcgctctccagcctcctgggtctgtgcgcccttttccttgctccttccctccaggctgtaacccacgtttgacccggctggggacatttctgggccggaactggggagcgtgttttgcttcccagcccacgctgggcaggcagtggcctactttgcgtggggcgccccgtgctcctcagtgactcggagggaagctggcctggctttcgctctggttaaactagtaacagtcaggctctttccagtgggctttaaagtgtccctcaccttcatccctgaccgggccccctatctagcttttcgctacagtgttggctgctcctttgttcgtggaggggaagcaaagaacctcgggctgatggttctcagcacccgagggggacaaagttgccgtgagaggcgcagcctgctcgtgggctggtctgagctgttggttgtgttttgtttgaggatttggtcctcctcaggagagtcatttcaaaacatgccgaggatgcttgatgcactgagcttggagctggtgacatcaagtcaactggccgcgtaaacacctgggtggctcaagcacagcttcaggtactgttaagccgggcacaggggccccgctccgcccggacagctgccgccttgctgcgctgcgcaccccagagagcctccggcaccgcctccgctgcggcaaagcgggctgtttgtctgagggcctctggcgctcccttggcccagacgctgcacattgttcgggccagggactgggtcaaggagattacgcagacgctgggagcacacgggcagagtggaccaagagaggtcggggcatcatagggatttttcgaggtaacccttattgggctttggggagactcgttgcatgccacgccaggagcagggagatggcagcagtagcctcccgggtgaccgctcctctgtattatttgcttacagatcaacaaaaaactacagtgattgaaaacggggaaatcaggttcaatggaaaagggaaaaagattcggaagcctcggaccatttattccagcctgcagctccaggctttaaaccatcgctttcagcagacacagtatctggcccttccagagagagccgaactggcagcttccttaggactgacacaaacacaggtaattcccgagaagcccaagtatccctgaaatgctggtaccgcttgcagatcgggcagggagcacatcaggaggaattgttggcctagtcaaccaaggatggaaggagcttaatgacaaatgccttttgctccagttatgcactttcctgggacaacacagtttggaatgaatgacctggtattgaatactggattggatttgcacatcctcccaaccctcggcgaccccaccccagcctagaatccttttgtgaccaaactcataattcaattgagtgttattccagagcagaacaacatgaaagagaacaaacatttaggagaaaaaggtgtacaagccaggaggcagaataaggttcaacttttttaaggatccttttgtaggccctgggaactaataaggttttcaacccattgacacagaaagaaaacttgtgaaatgaactaagaaaaaacaaagtaggcataggttccaatgaggtttagtaaaggctccaaagtgcaatctatttatcctaggagtgtcaaggtgggtttttctgaagatttccctaagcacggtggttaagtcatctgggtgacagactgatgtggtctgagctgcctccctggagcacaggacttgggtgcagtggcagagttggagatcaaagagaaatgttaccaaaattgtaacaggtgaagccacagttaagtacagttactgaagttctcccatcctactaatttgaaagccatagaaggcatttcagatttcacaagaaggagcttaggtgagtatattaggaccctggtcaaaaagccaggctgcaatcacctgcagtttttgttgattaatttacctacatggagtaagtaggcctcatctgatgtaggtaatcttcagcaaggggacctcaggttttatgagactgttgctgcagactgattgtgtgttgacttaagacagttgttccttaagctctttttcaatttagcctgttttctctttccatattgctattcataatatttggggtttgatatgaagggattccggctattcagtgacttgtatgcgtcttgaaaaagtagattcttatggctagggagttttaaaggtaaaggaagctgcaccataaaatttccttcttcaaataaagtagatctgaaatgttggcctagatatgctcccatcccagattcccgattcacgtttaattttcagaagccctttgacttttaattactatactaacaatcatgtgatgatccttgaccacagtttgactaggcaacatacaaaatagggaatgaaggagctgcagtccttaatccctgcaaggttatggggatatatttatgtctggagaaagatgcttcatgtataatctatggcatatgcaatatatgcatagatatattcaaggcatttagttataaatgtacaggctttaattccttcagtcatttgctccttgtacctttatagagataacagcttttgggtatctctatgcatgtacacggagaaaatgactgtgtaaaatagttattttacatagactaaatttacattactaaattttatgtaaaatgacaagactttcagaggaggtgcattcaattgaatggctttgatttgaaagggctgcttttaaaaatcctttaggctttggacctggtcatctcattcagctttttcttatttatactgttgttttaaacctacgctagcacgcaattctagaattacaataactttaggtatccaggcaagatacctagtatgttgtaggaagtgggactgtaagaggctagaaagaggtggaaggaggcggggacttggcttgtaggcgttggcggtggttgttttttgttttttgtttttttgcttttttaatattgcttctaaatccctgagtgacgttagaggcactggtttgatgtttatgggcctaatgattgctgcatttcttgcaggtgaagatatggtttcagaacaaacgctctaagtttaagaaactgctgaagcagggcagtaatcctcatgagagcgaccccctccagggctcggcggccctgtcgccacgctcgccagcgctgcctccagtctgggacgtttctgcctcggccaagggtgtcagtatgccccccaacagctacatgcctggctattctcactggtactcctctccacaccaggacacgatgcagagaccacagatgatgtgagttgcccaagggaacaccctagggaaacgtctgaacaaggaaaagaggatccgggacctgcttgtatctgcgaaaaggagccaaaggagcaggcttaggagagctcataagtgtggcaagaagccgactaggctcattctctctccctctctctctctctccctctcctttctttttacttcttcctttcctccattccttctttctttccttttcctttctacctttcttttctttttgcctttcaccttttttctcatttaccttctctcttgagcaacgtcagtaattgatcttgcatctcagagagagagaaagagcatgtgtgagagagaaactggtttctatgccagcactcctgaaaccccttactgtaaggatattttctcttaccccttgggatccaggctctgagtctcttctctttgggagtatccatcaaaatgactttttttaaaaacagattttcccccaaccagaagaatctgcacaaacttggcagcgtttttacttgtttaatgagtttaagacattacatggtgaaagagaagcattttggactcctgcatttttatttaccattcccagactgacgagaaaaagaaaattcctcacataacagcccttctctaaagaaaaaggaaaaagtggctgtaagattagaacattgctacaaagggaatgctgcatgttttatcaaaatgcaatgaccaggaatgatggttgattaaaaaaaaacaaaacaaaaaccactctttccccaccccacccccccaaaccctgaactggaatcaggaaagacggaggaaacaatcaaaatcaccattctattgctttgacacctttactaggtgaattggtggcattcacaaagctaatagggacgtttatatcaagaaacatttctgtatatattgttgaattttagttgtacatatactttgtatgtttttgtcttctttcatatatggagtaaaagccacaaaacgctgagtgtcttgtatatttctctctctgtgtgtctctgtccctctctttcctccctcctccctcacttcccttccccccattaaattttctatcacccttaaaaaaattcctatttcctaatatgggaagtcatatgtatatatatgaacatcaagtgcctgcaaagatgtcagtttgcacactagcctttgtcttaggtagtttaacattaaccatggatgttctttcaactttctttacatattacgtttttattgtaatttctacacatttacctatgttttaaacattagaatgacctatcctcaagttaacttctagacatcacagtagtttctagtgctgaaactgagtattctcctttcccttttcccagccaaaataatacagccatatttgtctttgtttggatgcagttttttaaaatataggaaagaaaaaaatagagagtagagtgcacaattatgcctacttaatgtttaaaacccattgccagctagctaggtaggaaaatgcactatgctggatgaaatacatccttccgatcttggggaaagcacagaaataatgaaaatgaaaagtcctttcgtcatacaagcaggaagccccatactgcgagaattaatggctacagacctgggcatccttcaaattatgaaccttgaaaccactgagccatttatcagaagtcaatagagatactcagagtgctccatataatgacagcgacatacagtcgtgcaaaaggacagtcactataattagacacaaagcaaagactacttaccaatatacccgttcctttttttgttgagcaacttccacgctcagtcagtcttcagaatggtttaaaaccgatcagtcttgtcattttctagcattcgcattgttacattaggaaaaatgttttcttttcttttttcccccttcctactgtgaaactttgggttcgtagctccccaggatcaattctgaacaaagcctccagctgcagtgccatccaatttgaa

SEQ ID NO: 16615 - DNA, 8130 bp, Human
ggcagctgcagctctgtttaccccgaagtctatctcagagaagcccgcggcagcccaggcccaaagctcgtgactcgggccagtgggagaaggagaatgctgctgggcgccagtctcccggtgctgaagtttcccccgaaaggaagtgcgacaatagctgtgtttttctggtgcagtccagaccgcaaaggcagggagttggtgcacgcacggcagctctgctttggagttcctgagcggggctgtatcttgctctgagttccagacaccctacctctacccgtcggcctgttttaggccgagtggctccacactccaagtaaggctaaactaatactagacacaactaacacagacgctttcttcttcggtaggagggaaaacggaggggaggccagataaccctagatagcctgtggaactcccagattgccggtcttggaccccgtaaaggaagatgtaggaaggccccaaatcaggatctagtccgcggagttgcctatttgaggggagtaacaatggggattgggagagacttttatgctgaatttctaaactcccagctgaatcacgactagaacaaggatagcacctcctgaagagcaaagtttagatctcgtgtatcaactgaatgattcttgaatcctttcttcccttgcatacgagctaagtaggatgtctttgcagcaggaaataaaggggagagggtacagaaacccgggtctgggaaatggagagactgggccacattcatggagccaggagggggaaatcaatgagcatcatctgactttgcaaaggctttgatccttgtctccttccccacttccgagactttcccattctttcctggaggtatggcaggttatacatggatccattcacctttgcgggagtctttggccactgaacatagttaaagagcctttattccaatgtcttgaaaatagatgaaaatattaaacagaagtggagctgtttggctctttttgcaagccagcaacgaggatttgggcttccttaagttatatgtgtttaagacagtaatttttaaaagtcattataaggactttgggctgcaggaactctccctgccattcaccggcttaatggacattgtgccttcttgggcattcctgtccagcccgcgtccgggagatactcatctcctgcaaaggaagttgcctctttccccaaagagcaaattttcaaaacatgtaagttacaacttgcttcccaacactccactaaaaaaaaaaaaaatgctgtttcccttccttcttgcctccatcctacatccccccgctccccactccctgcaccttgactccctatttcagtatcagtgtttaattctacactcgcctttggtgcagcccacgggggcggggtagtgggaagcaaggaaagatggtcgcccacctcattcccaaaacatgtgcacttttgaggcttctgattggaacacattgtccccagacatcacagagccttgtgctgtggcttctgcgatgtctttggaatttactaaaaacagatagactaagacccctccccactccacaacaagcaaaaacacacacaagcgcgcgggcgcgcacacacacaaacacacacaccccctcagtaccccccaccccctttttaagcaatgctttgttgtgctaaaactagttggacgagttagggtgttactgttgctcccgaggccctggccaatagaaccagatccaccccgctgtgcgtaagcgcgcaattaaggatttaaccaaggctgtgctgcgcctcagccagcagtcagccggccggagacagagacttcacgactcccagtctcctcctcgccgcggccgccgcctcctccttctctcctcctcctcttcctcctcctccctcgctcccacagccatgtctgcttagaccagagcagccccacagccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccaggtacatggacagggggaaggctgggcagatacagggcgactaggacgctgggggcgcgagatggggtggtagattgggggtcacagcggttcacggcagtgggggcgcacgcggcagaagggagtaggactcagaccctccaacaaagagagtttctcgggccagcattttagggatttttagtaggagagccctgtggaggttcgaactagcgtctctcccctccggcaccttccaaggcccttcagtcgctgaattcccagcttgcccggccaggaagccggctaggctggaaaggggataggggtggagagaagaaagaatcaagcagctcctggcgtttgcgtaacaaagagaaggttacttgggaattttggtaagcgtgctgggttggtgcgagtgggaatagaaggctgcctcaaaaactcagtcaggattagtttgagagccgccacaagctagcacggtgcgggtgccctgagcacgctgggtgggggtgggggggttaaggagttgtagccagccagagaagagcgcgccgagagttttgcggtttatccaggcatttccaaaaacaaaaagccatttaaaggtggaggagggttgctgaggggtcacgttgtaggatagatttttttttctgtctccataggcgcccacaatttgtctttccgtcctcctttttcgtccgctttgaaacttacttagagagtttaagagggttagtgagcttgggcggtaagagaaaggcatgaggctcggcggagaggttttattggtaaggtttgatctcttcccaccagcacattaataatcctgctaatattagcatcccctactctggcagaattgagaccacagccctcatcctccacacttctccctggaacttgacacacacacacacacacacacacacacacacacacaccctggagaggttctccgtcagttccagaggggtggtagttttgaggaaggggagttgtagccccagggcaggtttgtacaacacgcgtttggcaatccctccccctcccgcccaaacccatactcatgacagtgagaatctcatcctgacctgccgcccctttcctacgaaaacaccccaccaccggttccttctcagtgtgtgactcttgctgaactttaaaagagagccccgggttgaggtgtctacgtttctttcactctctctgtattccgtgcataagtggaagatttcttttttttttttttttttttgccaagaacatattaagtctatttgtaaaagaaaccagacacatctgtgccctcgcagatctgcagcgagattatgggggttgcataatcgaccctctgtctgcggcggccccgaccgcttgctgctgaagtgaaggagcagtttgcttgtgggtctttgaactttggagacctcggttagcgtcttccctgcccaagagtctggcttctgcgggcgcccgaacagacgccgacagaagtagggtcacggcccagggccacctccttgaagcctggggaggggctggtgttcttgaagcctggggaggggcggaaacgcggaggagcacagggtgggcgtaaaaacaagtccgggagaagaagcaacgaccgcaagagctgaatcccagatgccaaggagaaagcagtgttgtaggaagcgctttgcacaaactatctgaatgaacagagtaggaattaatcagaggctatcccgcttttccatatttggggtaggtgcatatttatcgcggtcctgaaaagcaaaggtggtggtgatatgggcaaagaatgaagactgagtggtaagaaactctaggactctatttgaggcccttccgcaaaaggggcattgtctggtgacaagctttaactgagtctgttttgattatttagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtaaatacggcgctgccatgcactagacctgcctgagctgcacgtctggttgggtcgcgcggttcagtctcgatgggactggagctgtttcgacagtacccgtgagaaactaacagacccaaagacatcagcccctatgctttaactcggtgagtcaggccttgagacggtggggatggtattcatcagcggtctggagatacctcccactaaccgcgccccccgcccccaccccgtagcgggcctccggagctgtggggccaatttcgcgggttgaaagcaagcggagggttatttctagggcggcctaggcagcccagagcagctatctggttttcttaacaatgtagagcctcctcgggggtgagcaaggcctggtgttctcgcggtggtctcaggctaagaaaaggctgagaacgtcgcctggagcggagaaactgaagggtcgtgccctgagcctacgggagcttcaggccacggccaccgaagggtcgcgaggtggggggcgctattgtacgtgagaagtcttcctggattgtcccattccttttactcctccaacccagctggggcctacggaagcataaagaatgttcgagtcgccgccaagagctgcagtcagattctggcctctctgagctgcagagggagtgaagggagtaggacgggaggttgggagctcgctcctttttctgaccacaggcgcgcgtagcccgccccacgccccttccccgccgggctcgcgcgattgttttggagaccttcgccgcgttccgcgcgtcctgcgcaggcttacacgaggcgcgccgccgccgaggacactcgggcgcacacccgccgcgctggcgtcccccacccccagcccaaacaaaagacaagccttggggtcgtggcctcgctgggccggggcgccccgagccggccagggcgccctctggggccagagctccatggtttgcctaaggcatagcttcttggcggtaggccgcaagcggcggggagacgccaggcagggctgggccgcccagaggtccgaagatgcctccagtcgccgccccggggaaggcgcgggcgacctctgagtgtcccggtaacgtgtgcctttgttccccaactcaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagaccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatgaaaagcggaatgtttctgaaaaatacttcattctgcccctctactggctagtgaagttttattgaaggcaactaaagaaggacaagctctgcagagatccaacaaggcaaaaaagaaaacagaagtcggggctctatgcatgcagactgtatatgtatatatgttcaatgctatactttgtgtgtttgtgtgcatatatatatataatatatatggcatgtttatagtactgccatatctcataattgtttcaggtagaaagtaatgctgaaataaaaatacatccctctcaccctgtatgtgagttagaaggcaacagaaatccctcaataacccctctgaattctaagctcaaagcaattatcttggagaagcgcccccacccatcagcctctgtgtagtgccagagcaattagacaaattacccttcaaagggagtttccagagatgagaaaatgaaaaagaaatctagcctcacacctattacattttttaaaaatctaaaatgtttggagcatggcaaatgatagaaccttggactctttggagtatgattataaatgtatcggctcttttcgagagatgaaaacattgcagatattgtgaagagggaacttcagggttggggaaaggaaggaatgaaagcattgtggcgccgtgttgatttcattttgtgtgagataatactcttaatatttcccttcccgccttccttttttcaggaaggagcttcctctgttttgcttttacataaaacagtggcaaacaggttctaaatgatgcaaaatagaatctgtttactaggatttctcctttgggaagccttctttgggacagagaggaaggacttgctgcagctgtgccctgtgtcccttccttcttcttgcactcctgcatgtagataccaacagcatgaccagagctatgcactgcacctaaagacccaggcctgaattgtaggtgtctttctgtctggccgtccttcagtgggccagactctctttccttaggatacgaaggaaaatgttgggttggaaattacaagatgcatgtgaaatattttacagctaggaagtcagcagcaataaatgtgacaaaagagccttcttaaagtgggggtagattagagcataaaaaattatatcctgtcactgaggatttctcagaaggctcttccagggttgggagactagacctgaaaaggcacgctatgtgccttgaggggaatttaccttacctacatgtttctctctctgtctcgtctctctctcctctctctctctctttctctctcattttctctgtctctctgcctgcctcctcctcctcttctctccctacctcccttccacctcctttatttttttcgttctcttctcctttactttttttctagaagagttaccaggcccgccagtgtggaacagcttgcttcttggaggaatcagtattttgaccgctctttagacatatcccgcagcctggctccgaggcagaactacgcccggcagcctggcctgtggacccctcctccggcacccccagcggccgcgactcaatatttccgtctccccagtccgctccagccgtactttctcggaaggagcactgggtgcggggaagagggggcaataggaaggtttgcggggggcgggggggggggcgggaagccaaagggtgccccattttgttttctgcgctcacagagaatagggggattggggaagagatgaagatatccacttcctgcttttctttctttgcttgtaaggatttcgggagtttccattacaccgagagctagcgctttatttctggcgactccgactgggagaaacccgcgcccgcggtgtgccagcgcctggctttcccctgcgcggacgcctctccctgccaaggggtgcgt

SEQ ID NO: 16616 - DNA, 53558 bp, Human
  misc_feature (1)...(53558): n = A,T,C or G
tttttcttttttttttttgaatagagatcagtctatcacccaggctggagtgcagtggtgacatcatagctcactgtaacttctcccatactctaccaatcctcctgcctcagcatccagactagctgtgattacaggtgtgcaccaccacacccagctacatttttttttggtagagacagggtctcactatgttacccagtctggtctcaaactcccggcctcaagcaatcctcccactggcctcacaatgttgggattacaggtataagccactgcacacggccttactatgctatcaattccatatatggaaaggtgttttccctttcagagctctttaaagctctgcagaagatttacatgtgtttatagagctaagagaaatcagggcatggaaattgagtgtgtaataaaaattaaactcttcatgttatataatcatgcataacttctatcttcattctctgaagttgcctagagcaccatcacagctaggaagcttccatcatgaattaccttatttccaaaagcaagtactcaaataattgtctcaagagaggaaggacaaaactgttacaagctgaaatatttggggatttgtttgacttgactagggaaccacaagttttcatataatgcctgatttagccctgtgcctaacagtttaaatcttaatgctaatgttaattgcttcccagttggttgaccttataagaaaacactgtgtggtattttaatgtggtaaacatgtgaatgaaggcctgtggctcagttaatcactcccacaactttgagctgtgagttttactggtggaaggaactttaacaggtcttcgctcttgtcattagatatcaaagaactgaaattagttggaattgtaagcagtgaatagatgtgttgttagaatgattccatcacttatacattgtttaaaatgctaataaagtaacttgctttgtaagaattcattagagtggacttttgttatctccattgtgcatttgataaaactgaggcttagagaggtaagagattagcttttaagtcagtaattggcagccgagacagcaaccctaggtctgttacattcaaaagcctctgagccactccgcatgacttcccattcattcgtgtttgctgctgctactctgggaaacaccatcttcctcttcccctccactcagaaatttagccctagattagcagcggtctctgctccctcatgttgagaaaggcctgttgtgctgtccgtgggcagaagggaccccttcagaaagctattccttattgggaatagcggcttgagattttgactgcacgaatattgcaggacctaattttagtatttaagttttagttcttaaattcttaagtttagagttagatactccaatacggccgttttccaaaataccgagagggaattaaatgaacatttttacattaagaatttaatgtatttctgggtgatgggaaaatgaaaaaaacaatgtaaagtctgaattactgcgagacgataatctggctccactgcaagccaaagtgggcccttaaaacatagaatccatccctcccagctctgccggccgtctgtgcctgccccccacgtgtcccacgttctgcacacctgtaaatcttgggatgtaatcccttgctcagcgtcggtccgccctactgtcggccagcgctcggggaaggggcgggatttgcagttgcgggaatcccaattactgtgttcgctgctcagggctcctcattcccctttagagtaaagggcgagggcaacagtggacggggtgtctccagacatccccctcattaccgtggccgcggaagccgactcggcagttgccgccgcggctgtggtgactaccagacgggccataggcgtgcgcacgcgcacccgcaccggcgcgccggccgtcggtcacgtggcctccggccagggcttgcgaagccggaagtgtcctgagtctcgaggaggccgcgggagcccgccggcggtggcgcggcggagacccggctgggtaagtgagacggccgcgggctgaggggccaaggcggcgcggggcgcggtcggtcaggcctgcgccgcccggcggggagcgctcccgccccctgtgggaggctgggatgctgagtcagagcgggggcgggggcgggcgcaccgagaagccccggacgacccgaggccaagccatccaggaccccggctgcgtggacactgcctctggggtgtgtgtcgggtggccgtagccggtggaatggtcgcgcgggccctgttacctgcatccccgctccgcgccgcgcggccggtcctcgacctgcatcccgtccggcggctttgggcataaagaggacgactccgttaccgggcctgggccctggctgcctggggaggcaggggcacctctttcccttagactcgctgttttctaccctctttccgagcgtcgacacaacgggcagtttttaaatgtattgatttttcagaggattaaaaagagacgtttccttagagttttagtgatgttcagtccgcagaggttgactcacaccggaaattagaagcataagatgttttaaatatatgccgatgaaatacgaattcccagacatttccttgctcctcgtctacctggcttatgggtttaatttgtaatctctatcccaagtattcttagtaggtggcctcaaaacaactcccaagtaattgccaaatgtataaccaaagactggtcttttccactctgaaaccccagtgtatgaatcacataggggcagagtttagaaatcctggaactttgtccataggccatgtcgtcaaacctgttttcatccctcaacaaatagtaactttcgttttggacggtgtaaggaagtaggctgaagacggcatcatcagcaacatagttgttgagtgtctgcttatatgcttgtcaaaaatttgggaagatttatatggcaagcacgttgtgggtgtgctgagtcatgttttaacatgttattgtggagttattggaagataatttcaaaagacatttcccctgaccactattgtgattactgttaaatagaaaccatagttttgtatttgcatagagaacagatatcttagctgataaatatttttcttattatcctgaaggtacatacatataggtacctaatggtactatttgccatttacagttacattgattagggaaggtttttcgttagatagttgagacgtttgttattgtatcgtgagtgaaatgtaatgactggcaaatgtgtattccttatttgtgaaaagggaatcttatttttattgcttatttcctatagtcgtatataaagtttatctaaattagatgggtagtaaaattatataaaaatatcctactatatcagtgattggtaaaattgagacccctgaccattctgcattttcctaacccagcttggggatattggtggtcattaattcatcacagaatacctagtctagcatactactttttgctttaacttactgtggagggatattaaaatccatgttttaatgacaatacagcaggtttaagggggcatggtgggactagtgtttatgttatgttagcatacatcaattttagtccagtgtggagcttggatactttgtataccttgatagatccatagcttttcagtattaaagacttgataatacaggctacttggtacgtttatatatttatacttggaggttggagaaactatccttaaattaattccagaagagttcgtaacttttcaggaataataatttttgcacctttcctttatgtttgtcaggttctgtgtagattgtgtagataaaattttagcttatgggaatattatgcagtgacaacatttgtcttcattagtgtttctctgctctgaaggaaacaaagtaatttttcctatatttgttatattttacattattacttttctttattttaaaacaccttaaattatgtcataaattaatctttcaaaacatttgaaggaggtaagtaacaatatcactctcatcaacaaagacaaaattagaagagaaataggtgttgtttttgtttgtttttgtttctttttgagatggagtctcgctctgtcaccctggctggagtgcagtggtgcgatctcagctcactgcaacctctgcctcctggtttcaagcaattcttctgcctcagcctcccgagtagctgggattacaggcatgcgccaccacgcctggctaatttttttgtatttttagtagaggcggggtttctccatattggccaggctggtctcgaactcctgaccttgtgatccgcccgcctcggcctcccagagtgctgggattacaggcatgggccactgcacccggctgagaaatagatgtttctttcagccctgtgttaagtgaattaaattgaatgtatgtcattggttaatgttttttttttcaaagctcatacagcattttagccttgaatattgctagaaactcagatctttttttttttttttttttttgagacggagtctcgctgtgtcacccagcctggagtgcagtggcgcgatctcggctcactgcaagctccgcctcccgggttcccgccattctcctgcgtcagcctcccgagtagctgggtctacaggcgcccgccaccatgcccggctaatttttttgtatttttagtagagacggggtttcaccatgttatccaggatggtctcaatctcctgacctcgtgatccgcccgcctcggcctcccaaagtgctgggattacaggcgtgagccaccgcgcccggccaattttttttttttctttttttttttttgcgatggagtcttgctctgtcacccaggctggaatagggtggcacgatttcagctcactgcagcctctgcttccgggttgaagttattctcctgttgcagcctcccgagtagctgggatacaggcacctgccaccatacctggctaatttttgtattttttgtggagacggggttttgccgtgttagccaaggtggtctcaaactcctggcttcaggtgatctgcctgcctcggcctccaaaagtgctgagattacaggcatgagccactgctcccagctgaaacttagattttttttgtcatattattgtattttattatagtatgtatagtgtatactaacttacagggaaaaaatgtaaacaaaatgaaggtcatggggaaaatggcatcttgctttaatcttcaacttaaagttactcttaataatccatttataccattatgtcaaattttagtcatccctgcagaattttagacgaatgaaaacagacaaggtaacaccaaagagttaagcacagaaagtgatattgattaaaaagttgaaagtaaaaatctacattggctagaactgaacattcagatccgtctctccagaggaaaatctaacttgaatcataatggttcatattttgacttgttcataccatatcagttagcaacttatgacttgaaaatactttgaaacttaagatatttatattgaactgtttatacacttcatgtcagtaacagataatgggtgatcttacttgagactaaaaacagctaacatttgtttcttagctgtgttactcccttaaaacatagttgcaaattttttttttctcttagtataacaagaggattgcctgatccagccaagatgcagagcacttctaatcatctgtggcttttatctgatattttaggccaaggagctactgcaaatgtctttcgtggaagacataaggttagtacagagaaaactttgaagaccttttatcactgtatgtattttgttctaagatgcatgttgacactaaagtgtgtgacttggtgattttgatccctttgtctgaagaaattgttttaatgatttttgtggtcatttaaggcatagctgtgtcaggcagtgaacatatctacccagtggtggcacaggttaagtgttagtgagtggaggaaaacagattggttgaaaatggactgggaaagattagtgttgtgccttttgatgctttccccagcccagctccctaatggtagagtgatttcactgacaaaagttcagtgtaatgagttgaggtagcatttgatgtggcattttggttggtagggaggcagatgtgtattgggaggggaactcacaggtgtttctgataggctctggtaagggtaagtgcccctactaaaacagcatcctacaaagtagattggagtaaaatgagattctcaacaaggagcccaggttgaaaagaccatattttggtataaggtaatcagaacctggtagtggaagtgggaataaaataaaaagattattcccagaggcacttcaagaaccaaaaaggggccgggcgcggtggctcacgcctgtaatcccagcactttgggaggccgaggcaggcggatcacgaggtcaggagatcgagaccatcctggctaacacggtgaaaccccgtctctactaaaaatacaaaaaaaattagccaggcgtggtggcgggcgcctgtagtcccagctactcgggaggctgaggcaggagaatggtgtgaacccaggaggcggaggctgcagtgagccaagatagcaccactgcactccagcctgggtgacagagcaagactcaattaaaaaaaaaaaaaaaaggattttgtttagattcaatgtggaggatgaaatttaaaatagttaaaataatttaaaattaagaaattgaagataattaaactttctattctgggaaaaagctggagaaatggagtctgagaaagaagctggaaaaatggagtacaaagttcatttataatacaaataataactaatttttcagtgctatgaatttgtttcgagctaaatgatgtttggagcttcctaaatccttattttcagaaacagggccctaaacgttttagtagagaggaattgcttcctcttttcctgtattcttgagactaccagtcagttctgtcagtgacgatgagataagcatacatgggggaggggctgtttcctctggggagagaatattgactataaacaccctttatggctcatagagaatgaatcagaagtaccatacagacaacttttagctttcctccccctgtatctagaattatccacaagctctggattcttattcagattacttgcgatcaatcctgggtactccgtcctagaaattgcttttgttttatgccaaggagaaaatgactagtgcctcagaatttagcattgagaacacgtctgatcatcttatcttcctgtagtccaaattaacaaacttttaataatcacttggtatgtgtcaggcactatggcagacctagtgaatattactatagctaatgtgcggttagctatactgcacattaactggacacagtttcgagtttagtagcaagattgattagaaaggaagtaaagtggaagctgatgggatgagagatagtcaatagtgatagagactggatgagacatattgaaagggcctggcactagaagatacgtcacatatcctgctcctctttccttacttagatactcagtgttcttcatgtaagtgactacacatagtatgcactctgtaaatgtttgctgaatgaaagaataagtgaatgaatgaggactgattagactaccccaagacaacctaaagttctccaaaggaaacaaatatgtactttacccattatagtgtggaaatctaaaatgagaatttcagaagtataagaattaattaaaagattgtgaagtcgagcatggtggctcacgcctgtaatcccagcactttcggaggccaaggcaggtaggttgcttgtgcccaggagttttgagaccagcctgggcaacatggcaaaaccctgtctctactaaacacacacacacacacacacacacacacacacatacacacacgaaaaagattgccaaggcccagtctagtatttagtccccaacagttttcctagggatgtgctttgagaaaccatatttgttcttaatgatggcagttgcaactgtttaggactatatcctacaaaaaatgcctgcttccctttaactatttaaaggatttttaccatgatattagcccttttatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttccctgcttgctcctctgttaggattctcctagttttagactgagtttgaggcctgtctcagcttaagaaaaatcactctgttgggtgatgcatagatttggcagtgtcttaacccttgctgaactgagggaaaaacagtgaaactgaactgtacttaaattcttctcttttcatatgtgtgaaaatggtcattggctctttgatctttcatcttcctctagaaagaatatatatcaatttgtgtattttgcatgaccagggtgaggggaatcacataggattatgaagcagttaaatggccttaagaaaaggatcatgcgattctggagtgagagaggagggtgatggctctaagtggtgaatctgaggaaagtataaagagggctccaaagcaggaacagtacagaggtcctgacagagagccatgaaatgtctttagccatgaaatgtgcttgaaccccaagctcaaagagaaaaggattttcctgcttgctctagggaagttcaaccttggataaatgggggaaaatgtaaggctaaactcaagatctggactggccacgagggagaggcttgctcattagagtgattggaaggaagtgagagggtctgaaagacaatcttaaaggaaggttaataagaagaacatataaatatgatgtttgcctgaaatgtaagcatgtgttttgaacctctaagattccctcccaactacagctgtgctttgtaattttgtgtgtgatgtaggtcatgaaagagtgagagtgggatgctgtggtacatcagtagagaagaagaaataaatgcctttactcctctagagagggtctgtgaaggaacagcctgccctggtcatctaggtagaattgcagaaagtaacccagggcagcaggggcagaaaccaaccaggaagtctactttagcctcgctctgcaactcctgctttccccactcccctcccccacgttgtcctagctacaaaataattctgaaaagttaactgtattactttgatattcttaataaaaatctcataggtggaatatagtgttcagtctctctctcctgctttgattagtttaaaattattaggccttggagaagcccttatgagtttcactttctatttcgtctttaaaagatgattttgcttttgatactattatggcttttatcttctgatgtgtgactatttttgcccctactgtatcctcatgaaaggtttatttataatatgaaagaaaatatccatttctgaattccaaaaggtgtaatttgaaagaaatgttgagcagttaattgattcattttaactttttagaaaagtcaaaagtcctcatacagattccctgtgcctaaaagatgcatgatgttctgtaagaaaataagttgcaatagcgagttctaatgctaccttttaatctcttttacaatattatgaataaataaaacatttctctctcttttttaaagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggaggtaagtagtaaaacttcaatcttatatttattgtagttacgagtcaagaaatagaacctaatattaaaaaatggattttttaaaaaactgttgaaaattagggtttgtacaaccaaatactttatcctaaaggattcttgaatatatagaacaatagaaataaaatatcataaaaatggaatcagaaacagtagtgtaagaaataaaagggggcggccggctgcggctgggtgcagtggctcacacctataatcccagcactttgggagaccgaggcaggtagatcatgcggtcaagagattgagaccagcctggccaatgtggtgaaaccccgtctctactaaaaatacaaaaattagcttggcatggtggtgcgcacctgtagttccagctacttgggaggctgagacaggagaattgcttgaacccaggaggcagaggtcacagtgagctgagatcgcaccactgcactccagcctggcaacagagggagactccatctcaaaaaaaaaaaaaaaaaaagaaaggatcatttgagctcaggaattcaagaacagcctgggcaacatggcaaaaccctgtctctgtaaaaaatacaaaaatttgccatgcatggaggtgtacgcctgtagttccagctactcaggaggctgaagtgggaggatcacctgagcctgagaggtcaaggctatggtgaaccatattgtgccactgtactctagcatgggtgatggagtgagaccctgtctcaaaaaaaaaaagaaagaaggaaataaaagggtattgaatatggttaccagtattattactagaaaaagaaaggtaacaagttaaatctaataattataaagagaaaaaataattataaaaagaaaaaatcgaactttaaaaaaataaaaattttgtatttcatgaataaaaatttcaagagtcctacagtttaagatatgaagtccaattataaaagaattgatttttttaaggggaaatagtggaattaagaatgtcattaggaaaagtaatctagaaataatggaaatagaaattattttaatccctttaaacatgagcaatcaataaaatctttgggaaaaaatgtagtttatactctttatccgagtgattttatttttagtgattatttcttaggaagtaatcagaaatataattttatgcatgaagatgttaattggcatcctgtttataataaagaatggttaaataagttgaataaattagaatgtgtggcagatagttacctggaattagccaaactcaagattaagagcatagccttccacactgccaagtctgctcaagacttttgataccaattgcaaaggagtttggcaaactgcacagagagaacagttcccacaagattaccctcacatcatcccagccggctacaaatgtgggggttgcccatgacactcaggtttggtaatttgctggaatgtagaaatgactcacaaaactgaggagagtgctatacttataattacagttttattgtagcaaaaagatagaaattagaaccagccagaggaagagacacaaagcgtggaatgtgggagggttccaatcttgaagcttctttgtcctgagggacacattactctctcagcattgatgtatgacagtatgcatgaagtattgccagtcagggaagctcacccaagcctttggtgtccagggtttttactgaggctggatcatttattgcctgtattgctgacctttagtccccagctccttccagaagtttggggtaattcctttagtctccattaagcccccatcctaaatcatgctgttagactctccagtggccaaagcccccagaggaacaaagacagaagtcttgttctttcagataggacattttaggggccagagatcactgtccagtagccaagggcaaagcctgacttctctttgggtaaagttaattttttaccacacaatagttaagtggtaatgaaaagagatatttaccaaaattttaatcttcttggaacaccttatatatgatgttatgtgagaagaatcaggattaaaaatatatatgtagtatgatcttaacatatacagtgtaatatgcaaacagcattatgtatctatgacattatttcatccatagaaaaaagactgaaagaaaatacgccaaaatattaattcattatctccaggtaatggaattatgtatacttcccaaattttcaacaatcaacatacattatcatttaaaagcaacagttttttttttctactatgattatttctctctcttttttgaaatgactgccagagagtaatttaaaatattttataaaagtgttttggagatatgtagaaaaaaattagaaaagaaacaaaggataaaaagttggagatgaatagtagattttaagactcattcagattttcagattctgaaattgtcatgcatcttataatcattgtgtatatataatttgatggtatttctttttccccgtaatgctgttattaaattgatgaagcattataatcaatggtacattaaaattaaggtttaaaacaaatcagcatctcagatgcaaatgagcagactggagctttgctgcaagagggaccactcagctgttctgctacccatttatttttaaggataggactccattccttgaagtaacagtagtcatcataagaaaaatttcattttaagaggttagaagagctgttgtcctaaatgtactgttatacataagaaattcagcactggtgtggtgactcacgcctgtaatcccagcactttgggaggccgaggtgggcggatcacgaggtcaggagatcgagaccatcctggctaacatggtgaaaccccgtctctactaaaaatacaaaaaaattagccgggtgtggtggcactcgtctgtagtcccatctattcaggaggctgaggcaggagaatggagagtggcgtgaaccctgggaggcagagcttccagtgagccgagatcgcgccactgcgctccagcctgggtgacaaagcgagactttgtctcaaaaaaaaaaaaaagaaggaaagaaagaaattcaagtgactgggtgtggtagctcatgcttgcaatcccagcactttgggaggttgaggcaggcagattgcttgagcccagaaattcgagactagcctgggcaacatagtgagaccccgtctctacaaaataatagaaaaattagccaggcatggtggagcatgcccgtaatcccagctacttgggagctgaggcaggagaatcacttgaaccttggaggtggaggttgcagtgagccaagatcgtaccattgcactccagtctgggtgacagagcaagactctgtctcaaaaaaaaaaaaaaaagaaaggaatttaagatgattttaacaaaaccattgtaacattgtaccaatgattttgtagttcagatttagctactttttactgtggtttgtcttcaaaaacaaatccaacttcttcacctaataggaatttggaaaatgttagtttttttgttttgttttttttttttgagatggagtctcgctctgtcaccaggctggactgcagtagtgcaatctcggctcactgcaacttccgcctcccaggttcaagtgattctcctgcctcagtctcctgagtagctgggactagaggcatgtgccaccacactcagctaatttttgtatttttagtagagaccgggtttcagcatgttggccaggatagtctcaatctcttgacctcgtgatccgcccacctcagcctcccaaagtgctgggattacaggcgtgagccaccacacccggccggaagatattaattcttatatgtgtatgttcaacagatactgaatctcaggtgaagcaaagtgccttcatcattgtagcaaatcctacatttaaatgaaatcagataagtactggcatataatcaaaatttattttttatgttgattcccaatcaatgatttttttttttcagacaacaacaagacataaagtacttattatggaattttgtccatgtgggagtttatacactgttttagaagaaccttctaatgcctatggactaccagaatctgaattcttaattgttttgcgagatgtgggtatgtttgtttatttatatgatatcatttgtatataaaatttaataacagaatttttaaaaaatatcttccattcaaaactgaagacctttatgcaatgcttcattagatatgacaccaaaagcacaaataccagaaatacataaattggatttcatcagcattaaacatttttgggcctcagaggacatcaggtaagtgaaaagacagcccatagaatgagaaaaaaatgtttgtaaatcatacacctgacaagggatttttatccagacaactcaacaataaaaagccaaataacccaatttaaaaatgggcaaaggattcgcatagacatttctccaaagaagatacacaagtggctaacaagtacataaaaaaaagctcaacattaattaattaataaccgacatcattggttattagggaaatgctcatcaaaaccacaatgaaataccactttataccaatgaaaatgactaatatcaaaaagacaaacagggccaaccatggtggctcacgcctgtaatcccagcactttaggaagtggaggccggcagattgcttgagtccaggagttcaagatcagcctgagcaacacagtgagcccctgtctctacaaaaaataaaataaaaaatagccaagcatggtggcatgcacttgtagtcccagctactcaggaggctgtggtgggaggatcacttgagcccaggagattgaggctgctgtgagccttgattgtgccactgcacttcagcctgggcaacaaagcaagactatctcaaaaaaaaaaaaaaaaaaaaaaaacaagtgttggcaagaatatggagaattggaaccctgatacattgctggtaggattataaaatgatacagccattctagaaaacagtctagagttcctcaaaaagttaaatatagaattatttaacttttgaccaaatgacccagcagttccactgctacgtatataccccaaagaattaacatatccatataaaaacttgtactccagtgtacttagcagcattattcataatagcaaaaaaaaaaaaagatgaaaacagcccaaatgtccatcaactgatgaacagataaacaaaaatgtggtgtgtctatacaatggaatattgtttgtttacaaaaagatatgaagtagttatatatgctacaacatggatgaacttgaaaacattatgctaagtgaaagaagccagacacaaaggctgcaatattatatgattccatttatatgaaatgtcaagaataggcaaatccatagagacagaaaacagattagtggtttctgggggatcaggagaagatggagttgggtatgagttgtctttttggtgtgacaaaagtattctgaaatcagtggtgatggttgtataactctgtgaccatactaaaaatgactgaattgtacactttaaaaagatgaatgttatgtttgaattatatctcagtgaacctattttttaaaaaaaatactgcaatcaaaggaaataacatcttaagagaaatgaatcaaatatttgaggaatgggaaaaagtcaagtgataaggtaaaaggttggtgggaattcttgaacttgtcactggaagcagagtgattatttaggtgaggatacaatgagagagaaacaatattactagtatgctacagcctgtttaatcaaatagaaattatagatatgatgtcttcctaagtgtattggtagtcctgagttttaataattatacattgatacccctaaaccttttacatattttgaatttgaacattcatctatcagccctcaagcaaatgtataaagttatcactcagtgacactgtcagttagacaaaatagcttaatttcagcaaagtagacaactttgcccttaagaaaaaagaagaaaaaatgggctttttggaatagtgccaagcatatgagaatacatttttacagaaacaagtttgacactttgctgtttttctgtttcttttttgctgttttacatattgagttcagtttacttttagggaattttttttcccaagataaagaaatgtaaaactctggtgaaagattgatatcttttttgggaatctttattatttttatgtttaaacagatcacccacatatatataaccaaagtaattcaagaaatcatatgcttaagactgttttgttacattttcctggtagtacttaagagacactggatttttccttagaccacattaatttttatcattctaaaacttcttataactaaaacataacatcttttatatatatatatttattatctattctttgagtaaaattactttgaaccaaattatggaaaaatttatattaagtttgggtgactatatcaatgaatttgagacatgcacacatacacgtaaatatctacattatgacttcttttgttttatattgttgaagtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttggtaagtcatgtatcactaatattttcatttaaagaagcttgatatattgtaattataattgggtaattggtcagccaattcactataaaatgtcatttttatgacaaaaattaaattttctattctaatgaatatgtgcaacatgggaattaggtactcgcttccaagggtgctgttatttttctattaaaaattcttggaagttttgtagcacccttaaattctttagttttactgatgctatggatctaaattaaaagggtctgttttttgatgagcagtcagcatattacaagcttgttataatactgttttttatatattcattatatttatgaaacagataattctatttgggggagttggttattgaatgacgaaaaggaccattgttagaaacacacacacacaaaatgcccctgagaagatctaacttgaaattttagaaagctagaaaagctctgtagttgaaaaagtttatgtaggtgtgtttttgtaaagtcagtaaatacttgaaatacttaagaaaatatacttaaaagtaaatacttttaacatgtaatcaggaagtttaatatatatagctcactgattattcatggctttgggttttgtcttaaaagtcatagaatcaatgacttttttgcatttggattgtgctgttgtaattttataagatgaaagatatctaccacaccctgtagctttattcagattattctaagtctggcatgaactaaatgtcttaaattgttatcctaacaattggtaacctcaaattgatctgtagatatatgtgatgatcttttagataagagtacctaagaatgggtcagacacagtggctcatgcctataattccaacactttgggaggctgaggattgcttgagcccaggagttcaagaccagtctgggcacaatgacaagaccccatctctgcaaaaaattacaaaattagccaggcatggtggcgcacatctgtacacccagctactcaggaggctgaggcagaaggatcccttgagcccaggaatttgaggcaacagtaagctatgattgcaccactgcaatctggcctgggctataaagcaagactctgtctcttaattttttaaaaaaaggtacctggcccaggcatggtggctcatgcctgtaatcccagcactttgggaggccgaggtgggcagatcacaagttcaggagtttgagaccagcctgagcaacatggtgaaaccccatctctactaaaaatacaaaaattagctgggtgtggtggcgtgtgcctgtaatctcagctactttgggaggttgaggcagaattgtctgaacctgggaggtggaggtttcagtgagccgagatcgtgccactgcactccagcctgggtgacagagcgagactccgtctcagaaaaaaaaaaaaaaagtacctaaaaatggattttattcattcattgcacaaatatttatgaagtgcctactatataccagatactgttctaggtgctcagacttctatggtgaactacatacacagtattcctgctcttatggagcccacgttctggtagggaaaaaagacaattaacaagtaagtaaagtaaattcagatcattaaagtttagcaaagacaataaattaaggtaataagataaagagtgactagcaggagaaacatagcctgggaaagcctcctttgaggactaaatgaactgacactgaaatgataaaaagaagcaagccaggcacagcgttctgactgctgttctgtgccgttccctggccctgtgaaagctacctccccctgcagaaaagaaactcaaccaccagtcctcatactcctcggcagttccctccatctctgcttgctgagaacctactgcatcagtctagcctactgcatcagtctgaaccctactgcatcagtctagcctcctctcccctacaacctgtgttgttgagggcccaggatgcctatggggtcctctggctgtctgagttgtgacgtatgagctgctttgtgatacagtgaactccctgtcattgtggatctggagaatgtgtcatagaacctagatagcagagggaagtacagttgtaatgaattcaccttcaagcttcctgagactcttggctggaacagaggcaggactcagacgtttctggcgagtggaatcaggcttcatatcctgaattctccacgtgaatgtaagctccacaaaaccagggactttcatcttagcctaccaagaacaccaagcagaattagacaagaagaaatcacccccttcctgctcctttctccgtcctacatgacatttgtgcttttgctattatccttttgtctcttcctgggcctcaacatgtgactgagtcaacacacatcttcattctcatttctctgttggtggtcttctcagttatatttggctagaccatgctttctgcttctagaagcaacactgctgaattcacaccagagctttggtacaaggcaacttcctgattccttcactttccccagttcagacattccccttgtcttttctcttagagcagtgagcctccaataaatagctcaaggccatgttcttccagactgcctcctttccagtagcaagctcaagcgcgtgtccttcaaattcaatgattagataagataacttgttcaaaaattcaatttctctctttctctttctctcacccagtactttttttttttccccaaccccactttctgtaagaacagcctatttctaaaagctagttcaccaggcccagctccttgtctctggagcccacacctgtcatagccaaagccacagtagatgaatgctcaggacactactgttcccaggagggcactgcttgccaaggtttactgctctaagaatgttcttgggcttcagtctggttccatcaggcccagagaaaacagcagctgtaaaggcctggagacaagaatgacctcaggagttggagaaacagaaaagatggcagttttactggaatttagtgagtaaagaggcaagtggaaggacttagaattaaagaagtgatcagggggctagccagatcagacaggctagtagtttaaaccctgtcagaccaatacccccttgttataataaatattttgtagtgttcccttcagtatcttgaaatgaaattcctagataatattataaacctgcacacctaattaaaatagcatatcttaataatgtaaaggaacatattttataataaaataatagatatttaatatgtaaaaatttagaaacagcttcatgagcaaacaagtagtgatatatgcttgcagctatatgtaatactactttgaatacaagtgcagtgataactcatgttgtattagtgaatcacatcacaaatggtagtattgttattgacatgattttccaaagtagtgaacaatttttggtaaagtttctaactaaaagtaaatttaaatatagttacattcttggaaaagctgtacaaaaatactttgttatatataaaatggagttcgaaatagatttctcacttgcacaagtatctggcagaatattccaaagtcattcaggctatatataggaggatcatttttcagaactgtcacatacactgcagtatgtccttcagtgtctggtctccgccttttccaatcatgataatcactgtaacaagcaaacagcagtcctgtaccagccttcatgaggttgctcccccaataccaactattaatctttcatgtaacctcctgggaacacagtttagcttttgcctctaagacttttaacaggaagagcaaaacattaaataaattaattccaagtctgtgctgtactctaggctgaaatttaaccccattctatttatttcctatttcagaatgggaaatattcaaatacagtgcaccagaatgagataaataatagtctaaggctcagcagcctagctatattctacatttaactggaaacttccctcgttttgaagctcccaggaactacaacccatatgttaaattctctctcttttgtatgttaaagtccaaagaaaacattcttctactgttttttgtttttgttgttgttgttattgtgacagagtctcaatctgttgcccaggctggagtgcagtggcataatctcagctcactcaagctccacctcccaggttcaggtgattcttatgtgccagcctcctagatagctggggttacaggtgcacaccaccacacctggctaatatttttgtgtctatatatatatatgtatacttttgagacagagtctcactctgttgcccaggctggagtgtagtggtgccatcctagctcactgcaacctccacctcctggattcaagcaattctcctgcctcagcttcccaagtagctgggattacaggtgtgtgccactacacccagctaatttttgtatttttagtagagatgaggtttcaccatgttggccaggctagtctcaaactcctgacctcaagcgatccacccaccttggcctcccaaagtgctgggattacaggatgtgagccaccacaccctgtctcttctactgtttttaatatgatggatatcatctcagtaatataatcctgaaaaccttggagtagctttatccttatgctcttcttccagatgcaatagcccaggcccagtaacaccaagccagtaacacatcaggacagagccagtgggcacaaatgtatcagaccagcatgtgtcaagccaccccaagttaatcactcccagggaatagcttccagctgtaccaattaggcagtatattattgcaccgtgtgaggaggtccgtctttgtctccttctggaatcactgtgtcccctcttcccaggaggctttatattccagaaggcatcagacatatccaggtacttttggcctcttcatgacaccatttacacactaagtaccagctgctaggtcaaaggtttggcaatcacttctttggacaataatcactttatgtgctgtgctacagaaccagcaaagccactgagatcccatatatctagtaggcatatgtttggacactcacgtcaatacccagttcttatacttgtctgcattgtgatttctcattaaaatgtatttctcaaaagagtctttttcccacccccatctccagcacccccccaccaccccgaccctcagaaatcagagattgtgatcctttgggagtgagagtcacagattgcatcatttagaagcccctcccagcagcatttcctacactggttcccagttccctgggccatagctaaatcctacaatgtcataaggaattgttttggtttgggatcatttaggtggtaactctactttggtccatacgtacacttttcaagatttatcttccaaaaatcttcaagttgcaagtgtataactttcatgaaggcagatggcaggaggccatgctgtgtgtgaccactggttattctctgcagaacaaaatgtccatcagaatatctgttaggttttgtgagctcctaaacaatttcttagaagctccatctgttctcagtgactatggtatagtgcagagtgtccaatcttttggcttccctgggctacactggaagaattgtcttgggccacatataaaatatgatagattatcttgggccacacataaaataatgatagctgatgagctattttaaaaaaatcacaaaaaacctcaatgttttaagaaagtttatgaatttgtgttgggccacattcaaagctgtcctgggctacatgtggcccacaggctgcaggttggacaagcttggtgtaatatgtcctatgtgtaaggacgtgtgtttaatgtcagtagatccccagtgaacccagtcaagttagtcctctgaattgattctagagaatttaatttcattaaattaaatgcacttaccctgacagattgcatttgagggataaggcaaagaaattaaggctgcctgataggtttcgggtgtgagcagctagatatgtggtggtattgtttacttaaagtttaggaggaaacaagtttaagtgggaagaccaagagtcaattttggatacgttaagtttgagctgccttttagatatcgagagaatagtaggatatatgaatctgaagctcagggcccaaggtagttttggaagttaaagcatacatatgatatttaatacattaggtctgaatgggagatgagggagtaaggcagttataataagcatggacagctgtactgagaagttttgctgtggtgggaagcagagaattgggtaattgttgaaaggagttttgtggtcaatttagagatcttttaaaatgggagatattaaagcatgtttgtaagcagaaagtaatgaatcagaacagagggaaacattgctgcattaaataagtgggataattacaagaattgatttctggaattggcaagatgatatgataggctctacagcacagatggaaaagttggccatgtataggtgcagttccattgtgactggaaagtaggcctggaaaatggacacagattggccaggtgcagtggctcatgcctgtaatcccagtactttgaaaggccaaggctcttaaggtcctcaaggatcacttgagatcaggagttcaagaccagcctggccaacatggtgaaaccctgtctctactaaaaatacaaaaattagctaggcatcatggcaagcacttgtagtcccagctactcaggaggctgatgcaggagaatcactcgaacccgggaagcagaggttgcagtgagccgagatcaagccactgcactccaccccatctcaaaaaaaagagaaaaaaataaaacggacacagattcaggtaggttgtatttggtaaagggcataagggagtgctggtctgattccttccatttccacattaaattatgaagcagggtcatcaaaactgaggatcaaaggaggtggtggaggtttgaggagggaggggaagatgtgaaatagtcttttcagattgggaaagtgaagttattaggaaaacaaaatagaatttctaagcattattgagtatccatttgtttgtataatgaaatgggtcacaggttcatgatttttttcttttttttttaatcttagcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtaagtggtttcccgatctaaaatcagagaagcatttaaaaaatgatttctgtcttggttcatcttattgttagtggtttatgctaataaaaattgatttaacaatcatttctgatattttaagctacctggtttttaaaaagaatgcagccttataaaagtttgcataattttatgtttaagatatttatgtttaaatatcttatatacacagtataaatggtattcagtctttggcccatcattaaaaatgtactgctttctagactttatttcagcacactgtttatttcactctgcatacttgtcagcactttcctcccatacaactgaaaaaaaatacatagttctgtggagtattagaatcattaccagatctaaaacaaacatcagtcttaccctaaagtgaactgattccttttaccatttaaaaaataacattttgggccaggcgtggtggctcacgcctgtaatcccagcactttgggaggctgagggaggaggatagcttgagcctaggagttccaagactagcctgagcaacagtgagaccctgtctctataaaaaaatacaaacattagccaggggtggtggtatgctcccatagtcccagctactcaggaggctgaggtggtaggatcacctgatcccaggagattgaggctgctgtgaactgtgattgcgccacggcactccagcctgggcgacagagtgagaccctgtctctaaataaataaatgaaagaaaattaaaaataacattttggcagtaatgtaacattaaacttttttttccagtgttgcagatttggaccagacacttgatatattttactagtataatgtatacacatttatgtattgtcacaatttttttttaatttccatttttattttagattcagagggtatgtgtgaaggtttagttaaaagggtatgttgtgtagcgctgaggtttggacttttgttgatcctatcacccagatagtgaacgtggtaccgaataagaagtgttcagcccttgtctccttccctccctacttttggagtcctcagtgtctgttgtttccatctttgtgtccatctttgatgcattaaataagtgggataattacaagaattgatttctgggattggcgagacaatatgatgggctccacagcacagatggaaaagttgtgaacgcaagatttagctctcatttataagtgagaacataacagtatttggttttttgtttctgcattagttcacttaggataaaggtctccagctgcatccatgttgctgcaaaggatatgatttcattcttttttatggctgcatagtattctacagtgtatgtgtaccacatttttgttatccagtctgccattgatgggaacctagattgattctatgtgtttgctatcgtgaatactgctgggataaacatacaagcgcatgtctttttaggtaggatgatttatttttctttggttatatacccagcaatgggattgctgggtcaaatgatagttctatttttagttatttgagaactccaagctgcttttcgtaggggctgaactaatttgcattcccaccaatagtgtataattattcccttttctccacaacctcaccagcatctgttacttttttttatttttttatagccattctgactggcgtgagatggtatctcattgcagttttgatttgcatctctttgatgattagtggttttttcatgtttgttggcagcttgcgtagtcttcttttttttttttttttttttttttgagatggagtctcgctctgttgcccaggctggagtgcagtggtgcgatctcagctcactgcaagctccgcctccctggttcacgctattctcctgcctcagcctcccgagtagctgagactacaggcacgtgccaccacacccggctaattttttgtattttttagtagagacggggtttcaccatgttagccaggatggtctcgatctcctgacctcgtgatccacccgcctcggcctcccagagtgctaggatcacaagtgtgagccaccacacccggcgcatagtcttcttttgaggagagtgtattcatgtcctttgctcactttttaatgggaatgtttgtttttttcttgttgattcgtttaagttccttatagattctggatgttagtcctttgtcaaatgcatagtttacaaataatttctcccattctataggttgtctgtttattctgttgagagttctttttgctgtgccaaagctctttagtttaattaagtctcctttgtctattttttattttgttgcatttgattttggggtattcatcctgaattatttgcctaagacaatgtatagaagagtatgtcctatattttcttctagaatttttgtagtttgaggtcttacatttaagtctttaattcatcttgagttaatttttgtatatggtaagaggtaggggtctagttttattctgcatatggttagctagttttcccagcaccatttttcgaatagggtatcctttcccccattgtttatttttgtcaactttgtcaaagatatgttggttgtagatgtatggctttattttaggagtctctattctgttccatcagtctgtgtatctgtttttgtaccagtaccatgctgttttggttaccgtagctctgcagtatagtttgaagtcaggtaatatgatgccttcagctttgttctttttgcttaagattgccttggctattcaggctctgtttttgttccatatgaatttagaatagttttttctaattctgtgaaaaataactgataatttgataagaatagcattgattctgtagattgctctgcgcagtatggatattttaatgatattgattcttccaacccatgcgcatggaatgcttttccatttgttgtgtcatttatgatttctttcagcggtgttagttcttgtagtcatctttcaactcctcagttaagtgtattcctaggtatttttgtgtctgtgtgtggctatggtaaatgggattgcgttcttgataaagtctcagctttgtccgtgtatagaaatgctactgattgttctacatttattttgtgtcctgagatttggctgaaattatttatcaggtctaggagtcttttggcaaaatctttagggttttctaggtttagaatcatactgtcagtgaagagagataatttgactacctgttttcctatttgaatgccttttatttttgtcttacctgattgctctggctgagacttctagtactatgttgaataggagtggtgagagtgggcatccttgtcttgtctcagttcttaaggggaattgcccattcagaatgatgttggctattggtttgtcatagatggctcttattattttgagatatgttccttctgtgcctagtttgttgagatgtattgccataattattatgaaataattactgtgtataaagtcattttttgtaagccaaggaagagatggatttctagatgtgaaattaattataaaaataatccataattgaccacacttctttttattttaaaagacattagtgaataaccttgtttcatgagaaggccagaccacatacacataaaactatgatgtgaagaatattgagtttagtgaatggataacaaccactgacagcctaacctgtccaaccattcttttaggtcttaacatatttctcagacctttatatatttggccctatcttttgttttgtttgttttgtttttttgagacagtttcactctgttgcccatgcaggagtgcggtggcctgatctcagctcactgcaacctgtacctgccaggttcaagcaattctcctgcctcagcctcccgaatagctgggattacaggcacccaccaccatgcccggctaatttttgtatttttagtaaagatgggtttcaccacgttgcccaggctggtcttgaactcctggcctcaagtgatctgccccccgccttggtctcccaaagtgctggcattacaggcatgagccaccgcacccagcctggccctatcttttatgaagcaaacctgacttaaagtaataatcacaactgtaaaaagacaattatctaatctcttctcaaaaaattgagggagaagcatgtttttccttttgttggttggaggaagtaaaacaaattcagatggtacaatgactttttctataacttgggtatttaagtgttttccagcaaggacagtgtacatatttatgggaagaagacacctatttaactgtactgatgattttggcatagcatcctattgagcctgctttatgtcattgcccttttaatgaaatctcttcattaataaaaactgataatttgtgtttttctcattacacataaattgtgcctaacagttaatcatacttttttcatcatagatagtatcagcctttaaagcaatgtcagcatttcttgctgccctaaaaatggtttaaataaaagtgtgtgctgctcactaataaaggaaacatgtgactcataagcagctaggaatacctgatgattttatctgacacccttgtgggcagatataccattagaagaattttattttattagcacagaaactcaactttttatgaacattgatgctaaagaatgttcagaggtgattgaagtactcagtaataataattgttttactttactaatgaaagatatattcatccaacattatagtagtgctgattcctcagcatctcatttgcatgttatgaatgtacttatatgtggatcttatcaaaattaaacttttttaaaacttgtaagcattcccctaagacttttgccatttattctattcacttctcttttgcattaatcccacacatgtgcacttacttcttagatagttgtcacatgaacacaccttatttttcacgttaatttcctctttgaaaaatctcttaaggcagaaatcctggctgccactgctgaggaagcagcaaatggtctaaatcagttgtggtggtttgttctattttttaaaaaaataattaatttgctcaaagcacatttactttaatgttaaacaaatgtgctttttccaaaatgtgcaaatgtgtgttttccagtgtgcaaagaatctgatactgtgctctatatagtataatcttttttgttttaaagaatactattcattctgcagaaactttagttgtgcctttggataatatgggtaagagggattatatgctttttttcatggtctagagacattctgtgacacaacttattttgtgtttgctcagttttttcagatggaaaaattaatatatttgttgtgaacatcaagatgctgttataaagcactgtgagatctcaaatgaaaattaattatggcatatataaataaccgtacaaccactattgtacttcagtcagtcagattcaaagtattttgattgttttatggatcctgtgagcatcaatcacaaagtttcatctagtagataattgtaggtgcaattgaggaaatacttttgcaaagcccattaataagtcatgcaaaaatgaactgcttattttattctgcttttgttcctcccaaggtataaaataattacaggaaagccttctggtgcaatatctggagtacagaaagcagaaaatggaccaattgactggagtggagacatgcctgtttcttgcagtctttctcggtaagtatggtgtacctaattctcatcttttgcactttggtgtttgaaatctttgttgcctagaaccacagatactcaaatactgaagtgtagtttgattttattttaattagatattgtcaaagcatgtgctttgataaatgatttttgtcttcgtggtggtgaaaagatttattctctgctatatgaataatttcccaagatcttcattaggacacagggcatacatttttgagattggtaatcactggtcttggaattcttcccagtgtagggatcatgctcaggaccttagtatcttttgtaatgacctccatattgatggataacaaatagtggattagatatgagtaaatttctcaactggagttgtaaaaagcaaacaatgaagagatttagtattatcttcattttaaaaaattcaaattattcaaagggtgagaaataatagttttttgtactttttagcatttcaaatgttcatttgggtcttgtttaatgtcacagacagaaatcaaaaaaattatattgtcatttaagaatcctgttaccacaaagaaagaattaaggtaaaagaaattaaaagtagaaagtaaattattttgtatttcactctggaaacaaagccaagacatgcatcggtatttagtatctgtgattactgaattagcttccatttttcttgagtgtggtagttatataatccttaattggacacaagttatgaattagtggcttatcaccttttttaagttgtgggtgctttttgtatgactttaaataaataaatatataaaacaagctaataaaatatcacttatcattttatatgttgggttctgtgaaaattcatttaaaccaagagttccaatgctgaaatcattttcaaaaaccactattgttaacagttttttgtgtgtgttattttaaaaagtttccaaaatgaaattgtcatgtaactagattactaagagaaattcattgtgttggagagtagaaatttaatattataactgtgatttgtgttaaatttttatttaggaaatactcattttggggatctcaggcaaaactgataaagtgtaaagggctcagaaaatgaacacttgctggtaaataattatattgccaaaactcagaatcaaaaaaatctgatgatctgaactgcagcatatttctggagggtaacaggcattatctatcgaatcagtctttagcataccaagttacaaattctttgagaaaaattgcttagatgccagaaagtatattatataatttttttgttttaaatagtaagaactctaagtactacaaatcagccgtgaaaacaactaccagaaatgtaatgggtcttggcacggtggcatacacctataatcccacctgctcaggaagctgagacaggatacttgagccccagagtttgagactgcaatgcataaagcatctgtgaatagctgctgcacttcagcctgggcaacataacaagaccccatttctagaagaaaaaaagctataattccttattcattgatgagtggcattaaatgaaggttacctagctttctgaaaagttgacagattttaaattttttaaattaatctaatatagtaataatgacagttcctttgatttgctggtaaatactatgattttttaacctagacagaatatgatatattcactcttcaagtaacttttcaatactattttaggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatatacatagctataatacgtaagtatctctattttcttcttgtatcaacatgttctgttatataatattttcctaagttaggaaaagaaatagaaaagatgcctcagcttcaccaaaagtacccatttcccacatggaaaattatatttaagtgcttagtaaattccttttcacttatttttggagtaaaaggattgataattctaaaatttatagttaaattagcttgtttctcaaactgtaagttttacaaaagtactttcattgctgtgccttctttcaagttacataatcacataaccacaaatggcatctaccaataaaccagccaggttttgctaagtgtactatcctgccatgttaaaatatcaaagcctaagtcttcattgttagcatggttatttgcctatgataaccctatgcagataatatggttactattaaccataataatggttaaagcacctggctccggaaaaataatcagtgtttgttttatgtaaacaaaaacacattacacccatgtgattaaaaaaaactacccatgtgataaaactgcatataaagttttggtcaatgatggaccatatatacaacactggttccgtaagattataatatcatatttttactgtaccttttctatgtttagacatgttcagatatacaaatactgtttctaattatgttacagctgcctgcagtattaagtacagtagcatgctgtacaggttcgtagcctaggagcagtaggctagctaccctatatagcctaggtgtgtagaaggctataccatgtagttttctgtaaatatactctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggtgtctctcttcatcatttcttagaactgcatgtgaatctacagtgatgtcaatgttttgtaaaaagctcacccagtgtgattatcgttaataataacttaattgtacattttaaaatagctaaaaaaatataatttgattttctgtaacacaaaagataaatgcttgactggatggataccccattctccatggtgtgattattatgtattgcatgtctgtaacaaaacatctcatgtacctcataaatatattcatttcctatgtacacacaaaaattaaaaacaaaaaattttcaaaaggtgacacagtggaggcttgtagagccaaattacaatattgctgctgaaacatttcttttgatgtcattgatctattcatggggaagctgtcttttcccccgaagcatcattttgaaaatacctagttttattaatgtatttaacaaacatatagtcacataacaagtgctgttcttggttctttacatatttaagccatttaatcctcacaacaattctgtgaagtgggtactgttattatttccattttactgatgaggaaacagtgcagaggagttaagtcacttacggttttataggaagttagtggaagagctgagatttgaacccatgtatctgattcaagtcagtgctctaaaccgctctgctatgttggttctctatttgaaaatattaataatcttggccaggcacagtggctcacacctgtaatcccagcactttgggaggccgaggcaggtgtatcacttgaggccaggagttcgaaaccagcctggccagcatggcgtaaccctgtctctattaaaaatacaaaaatcagctgggtgtggtggtgcatgtttgtaatcccagctactcaggaggctgaggcacgagaatcgcttgaatccaggaggcggaggctgcagtgagtcaagatcgtgccactgcactccatcctgggcaacagagcgaaactctgtctcacatacacacacacacacacacacacacacagaggaaagaaaatattaagaatcctgtatattacacaggtatccaaacataaaaatactttagaattgcttactgtatggacaggttatatggaatggagtttgtagtatccacattaacaaagcaagtttatatggactggttatgatattagggatatgaattagaaatggatgttgttgcactcatttaaaatattttgcctctcactttatccccagttatagtgtccttttgaatttttctcacacagtgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaagtaagttgggatttttcttgtcgttcttactagccattagaaaaatacagccagcctgggcaacatagtgagaccttgtctctacaaaaaaataaaacaaaaattagtggggcatggtggcttgcacctgtagtcccagctgcatgggaggctgaggtaggaggatcacttgagcccaagaggcagaggttgcagtaagccgagattgcaccactgcactccagcctgggagacagtgtgggaccctgtctcaaaaacaaaaaaatccacaaagtctgtcattgtagaaatgattgtcatccttataaagctgatgataatattagtgtagagctttcataaatattaaaattttataaattactatagttgaaagagagtaattgtaaaattgaaaaagccttgtagacatgatttgacttcaaatattttgtttcctaaaacgataaaatcgtttgtcatacgtttcactgtaactctctttaaaaagtgttttgctaacactcaaaattaccttttatatcataaatttcagcaaatattttttgtgtgcagtatgtatagaacattgtgccaagctttagagtctaagaaaaattagatctgcatttttagaatcttttaaattactcattctactggtagaaaaaaaaatggatcacccagaattttacagttctatttgaaggttgggatttgatgtagatttaaagagaagcattggactcattgtgttggtgtatatttaaggaaaaaatgaaactccttagaaatatttgaggtaatttgttagagaatgagcattattgtttgaagtggtgtttttttaatcacgaaaactacattacagattttgccactaatgtttaatttagacattgtgtttgctctataaaggataaagtgattttttcaaaaagttttctttctcattttattttacttcatatttcagtttccctccctaaagtacatccacgttatgatttagacggggatgctagcatggctaaggttagtatttaatttaattactatgtaaacatctgaatttaatgtatcctatcaatagtggaagcaataacatgtattgtgtcttcatgtatgtctatatgacttaggaaattattcacttaaattgataccctttccaagtgattttgtggtctttcttttttactttttatcctttcttgaattcattatataagaaaattctctccattgagatagtgcatgtttagataatgttaaggataacatatttattatatttatatctatttttaactcttagaaattggtggtttattgtgtttttaattaacctgataaaaatgtgtaagcttgaataattttgtgtaaaagtttttcttaccctataccacaattagcaccaaatattgacattttatttctttattaggcaataacaggggttgtgtgttatgcctgcagaattgccagtaccttactgctttatcaggaattaatgcgaaaggggatacgatggctgatgtaagtaatagattgaaattttgaaattgattttcatgtagaccttgccccatcattgatattttctctcttcaaactagttaggttaggtgcttgatttttattataatacatttgtttcacatttagtttataaaacatttagcagctcatttttcatgagtcctacaatgaccttgtgagacagaacaaatagtatctgaattttaaaacttacaccacgctataggatgtgacggcaaatgcatttcttttcctaggaccttgagtagttggttgtcatttaactatgttagaagtctttggcttgttagaattcagtacaatctgtactttctagcatttaagtcctcaaagtcttccttaatttcctaccattttcccaaatgaagtacacagtccttttttatcacaccgtattttttttttttctttttgagacagggtctcgctgtcacccaggctggagtgcagtggcacaatcacagatcactgcagcctgaaactcctggcctcaagtgatcctaccacctcaccttcccaagtacctgggactataggcatgccccaccacacccagctaatttttttttttttagtgatggggggtctagttatgttgcccaggctggtctcaaactcttgggctcaggcaatcagcccgcctcagctgggattataggcatgagccacacccagccttcacaacattgagatataattcatatactatataactcatgcatttaagcatacagtttaatggtttttattatgttcagagttgtgcagccatcatcactaattttagaacattttcatcaccccagaaagtatctctgcatccattagtattcactctccatctccgcctaaacagccctgccctaggcaaccactaatatactgtttgcctgttccagacatttcatataaatgaaattatacaatatgaatatataatctaacaagcaatttaaaagctaattttttaaaactagatcgcttaatatagttattctagttcagaataactggttatctagtttaagtagtttcttcctgaaagtgactctaagaaatgtaagatggatgtaatttttacctgttttttactttaatgatttatagatgtcatctttccatctgaaaaaaatggaaaatacattatctcttttggaaattatgcttgtttctacacatcattcaaagcttttgaattttgcgtacacatcatgatggccttgtggccgacagatgttaagaagtttgttttctgcactcatgtcgctatgtatgtgcccttggactgtaatgcttttgacagtttatgtatgcctacctcatacccaccccgtcttgcaaaagtgtgtatgaagcatttcatcactctttttaggctcctttttttttctgttagcattatatgaaacccataaatttgtgtttatctttttcactgtgttcacatatcttagttcctaagcctatgcttttctgtttccactaagaagcttccttgtttttactggtttctggaaaaatctctgtgtactaacagtttttattttctcttatctatcgtcaattgctgatccttgaagcttttattccttttacttattagtttatagtccaataagtcatgagaaaatagttttaatgtaaaccactgttggcaaacattttctttaaaggatcagtctaatattttagactttgtgagctgcatatggtctcttctttgtttttacagtctttaaaagtgtaatgttagctcatgggccatacaaaaagcaggcctcaagtcttagtttgttgatccctgatgtagatcaaaagcccttcaattatatatttcttactgtgtcatccttcttcagatgacatcacaagttgagcatccctaataaaaaatattccaaaagtcaaatctttttgctcaaagtttatgctcaaaggaaatactcattggaacattttggattctcagattagggatgcttaaccagtatgtatatatgcaaatatcccaaaatccaaaatctgaaaaacacttctggtcccaagcatttcagataagagatattcaacctgtaattggtttaaagtataaatcagacagtagtctactctgagtagtaaaaattaattctggtggtataaactgtaatgctctacaaactatttgtgtaattgtagattagtttttactccttaatgtaattttaataccttaggtttttaaactgttaacctaagtagtaatggtttgtgaaaatatgagttccctaatacatcaggatcacagaaatgcttattataataatgtttcaaaaagtgtgaattgatgaatatcatgaatattgttataaaatgtttttgaactgtagtactgcagtataattagtgatagatagaaaaaataactccttagataaactaattagaataattttctttttttagtgaattaattaaagatgattacaatgaaactgttcacaaaaagacagaagttgtgatcacattggatttctgtatcagaaacattgaaaaaactgtgaaagtgtgagtagactacttccttactagtaggggttaaattattaaatgttccatttctatttaaatgacttagttatccttggcacaatatggcatgctatgctagggtttctattaaagatcagcggcctggcacggtggctcatgcctgtaatcccagcactttgggaagccaaggcaggtggatcacgaggtcaagaaatggagaccatcctagccaacatggtgaaactccgtctctactaaaaatacaaacattagttgggtgtggtggcgcacgcctgtagtcccagcaactcgggaggctgaggcaggagaatcgcttgaacccagaaggcagaggttgcagtgagctgagatcatgccactgcactccagcctggtgacagagtgagactccatctcaaaaaacaaaataaaataaagatcagccttagattagtgattactttatcatcacaaaggcaaaaatgccagttttcttggtaagaagtgaacaccatctcttagtggcatttcctcccagccattgggcaggaaaaggtagtgggaaaaacatctcatttctatcttgtaaaacagaaactgtgaataagaaaatatgaaacttgtaatcaacaaaggaaataggaagagatattctagaacagccttttagtagtatttttagaattataggaattacttttagtttatttttacttgttaatcttattcctgagaacacgttttgaaacagaatgatatttttaactgccctctttctagaatatactatttgtactgcagaggaaatacaataaatgaaatcagtattcactattgaccttcattaattctgaaatgtatttttactattatcctcatataagattatttgaaattaatttgtcttttctgttttatccatcccttaatctgcaaatttaaaatagaagcagataaaattccttcttcaggaaggcatcaggtttttttgtgttttttggtttttttttttttgagagagagtctcactctgtcatctaggctggagtgcagtgatgcaatcactgctcactgcaacctccgcctcccaggttcaagcgattctcctgcctcagcctcccaagtaactgggactacaggtgcatgccaccacgcccggcttattttttttttttttgtatttttagtagagatggggttttaccatgttagccaggatggtctccatctcctaacttcgtgatcttcccaccttgacctcccaaggtgctggaattacaggcgtgagccacctgggccctggccggcatcaggttttttttttaacaatctgctggcttatagactttgaatcaattttttatttttaaatggttatgatgaaagctgaaattattatttataaaacatctttttaaaactatgtattgattatactcatttaattttctcttttgacttttcatacagatatgaaaagttgatgaagatcaacctggaagcggcagagttaggtgaaatttcagacatacacaccaaattgttgagagtaagtgtttacaaaattacgaaatttgtaagctcataacctattcctttgctggcactattagatttaaactttcttaggagctaggcatggtagtacacacctagagtcgcaactactcaggaggccgaggcaggaggatcacttgagctgaggcattaaaagctgcaacgagttatgatggtgccactgcaccctagcctgggcaactgcacgaaatcttgtctgtaaaataaataatttaaataaataaactttcttatagagatgatatttctcactgcagagaaagaatttttcccatctttagaaacttctttacaatattaaataatcttactgccttgaaattttttgtaacatattcaaatgactactgtnnnnnnnnnnnnnnnnnnnncggtgtttaaatccataatgctcttgtgttcttgctgtggcagttaaagcaagttcataaatgtaatttcacatgcagttgaatgtaaagtgcttgagcttgtttagaaatagatttaaattaggctgggcgcggtggctcatgcctgtaattccagcactttgggaagccaaggcaggtggatcacctgaggtcgggagtttgagaccagcctggccaacatggtgaaaccccgtgtcattagctgcgtgtggtggtgggcacctgtaatcccagctacttgggaggctgaggcaggagaattgcttgaacccaggaagcggaggttgtagtgagtcgagatcacaccattgcattccatcctgggtgacgagtgaaactccatctcaaaaaaaaaaaagatttaaattagaaaaatattatcagatttttttctaaaataaaaaaggaaagaaagatttgaggtcttcaaggcagtaattacttctatagctagaaaaagaaattaggacacaagtctctactctgctgaaaaatacaatagaacttctgggagtctctgaatctcttattaacatgtattatagaagtgcgcaggtttatatattagtaatcagtgagagctgattactactcccagacctgccccatttacctgcctactcatgactggctacttaagcaaggccttttaattctttgcatccttggtttctttttctctaaaatcagcaatttcttaccctgcccgtcttatgggttgttgtactaattaaatgagataaataaaaatactgtactcttggctgggtgtggtggctcacacctctaatcccagcactttgggaggctgagtcggatggatcacttgagtccaggaattcaagaccagcctgggcaacatgatgaaaccccatctctacaaaaaatacaaaaaaattagccaggcatggtggtgcatgcctgtggtcccagctacttgggaggctgagacaggaggatcacttgaaccgaggaggcgaacgttacagtgagccgagatcgtgccacttgcactccagcctgggtgacagagccgagactgtctcaaataaataaataaataaatatattgtaatcttgcaagcttttagtattcgaagtattctttcataaaatggatgttaaattaaaagtgaaaggaacttgatacgatatccttttcactttccagcttaggctgatgtttgtttcttttcctcagttttagatctcaaacagtggttttcaaaatatgagtaatgaacaactagtaggttatgaagttgggtgccttgtaatcagcaatgtatttttcagtggaacagaatagaaaatgtcagaatgtgtcacatataataaggaaatcattgtttatgaaactttgattcaggtatatacacactttaaatgttactgagttaaaacagtgagtttcttactatgagttgtggtcaggaaagtttgaaaaccatagctatagaataaggtgattaaaagtcagaaagcacaaaatagtcttccccagtatttgtctgcatttaaatataggcagccatattgctgtcagtgttttatattcttctctgttttcaccttagaacatgatttacctgcttataggcctagtggacatttatttccagggccagcatcgtttgagcactttaaatcaaaattaatatattttcttttggggatctcaaaatgtttctcatttttatgacattcctgtgagattaagatttctttttatttattcatttatttttaaacagagtttccctcttgttgcccaggctggagtgcagtggcgcgatcttggctcactgcagcctccgcctcctgggttcaagcaattctcctgcctcagcctcccgagtagctgggattacaggcatgtgccaccacgcccagctaattttgtatttttagtagagaagtggtttctccatgttggtcaggctggtctggaactcccaacctcaggtgatccgcccgccttggcctcccaaagtgctgggattacaggcatgagccaccttgcctagccaagattaagatttcttatgagaaagcatagatgactaaatagcttgaggtaatggagtcttatgacatcaggacttctcacttcaagccaattacttttccgtagatatcattttttctctttttcttttttttttgagatggagtctcactctttcgccaggttggagtgcagtggcgtaatctcggctcactgctacctccacctcctgggttcaagtgattctcctgcctcagcctcctgagagctgggacttcaggcgcccgccaccacgtccagctaattttgtttgtttttttttttttttttggagacgaagttgctcttttgcccaggctggagtgcagtggtacagtctcggctcaccacaagctccgcctcctgggttcacgccattctcctgcctcagcctcccgagtagctgggactacaggcttccaccaccaggcccggctaatttttgcatttttagtagagacggggtttcaccgtattagccaggatggtctcaatctcctgacctcatgatctgcccacgtcggcctcccaaagtgctgggattacaggcgtgagccactgcgcccggcttcgtagtggagaccttacagacatttttcccaccacaaaagtaaaatttataagtagaaaaaaataccacatatattatgcacccaaaaaatgatgcttaaaagttttgtccattgccctgcagcagtgcttctcagagtggctcctgggccacaggtcgcagtggttcacacctgtaatcccagaactttgggaggctgaggtaggcggatcacttgaggccaggagttcgagaccagcctggccaatatggtgaaaccgtgtctctaataaaaatacaaaaattagccgggcgtagtggcagacgcttgtaatcccagctactggggaggctgaggcaagagaatcacttgaacctgggagatggaggttgctgtgagccgagatcatgccactgtcctccagcctgggcgacagagaccctgtctcaaaaaataaaaaaaaagtaaagaagagtggctcctgggccagcagcttcagcctcacatgggaacttattagaaatgcacattttgggaccccacctcggatgtgttgagtcagcaactcactggcagaacccagcaaaggccctttttaataagccttccaggtgattctcatgctgctaaaatctgggtaatcactgttttcattttcttttatatgtattattaaatgactgttactctacaaacatatggttgttatttttactttttggataccattatagtgtaggcatttcccaggtttttttggtaacaccattttcttaatgatatgatgttgcagccagtggatttattacagtcttacttattattgctctactgttggtcctttagtttgcttttcactcttctatgtaatgctgtaagaaatgactttttccataaactattttccatatattggatgtataatttaacacattctaaacattaatgttaaaacagacataaagcataaaaaccgagatatatatttgatcatataaaaatttaagctgggcacagtggctcatacctgtaatcccagcactttgggaggccaaggtgggggtagactggttgagctcaggggttcaagaccagcctgggaacatggtgaaaccccaactctaccaaaaaaagaaaaagaaaaaaaagaaaaaattagcaagacgcaatagcacgcacttgtaatcccatctactcaggaggcttaaggtgagaggatggcttgaactcaggaggcagaggttgcgggagctgagattgcaccactgcactccagcctaggcgacagaatgagactctgtttcaaaaataaaataaaaatttaagatctgtacatgtttaaaaaatgttagaatgcaaataagttgggaaaatgtgataaagggttttttataaaaaataactcatacaaattgataaggaaaatagtcaatctgcaaaaaatagatgagcacagaacatttagagacaatttataaatgaagaaaatatatctggtgaaaacactcttgaaaaaatgctcaaatccaatagtaagaaaaaattgcataacagtaagatactatttttgtctttcagattatcaaggcttaaaaaattataatgccagtgctgacaagagtgtggtttaaagggcatccttatttgttgctagtggcaatgtcagctactactgacaacattatttgaaaggcaatagtgtgtatcaggacctttaaaatatatggacatatttatcctttaagtctaaccttcatcctttcttcataagttttacaaatactgtatgcatttctgtggtaggtaagtgataaacttactaagcttaaaatgaacagaatcttagatgaggtttcttttcattttctgtttttaagaggagttgctttggtttggcctctaaacaagaagagcacaaatcttgctgcctacacagttgatatttggaactattctagtggttctatttaattttcaaaaccgggttatgaaatggagaattaaccactttttacagataaggaaacaagattagaagtattttacatgtggttttagaagggtgtttactgaatgaactgttttataagatgtattactgctggtctcatgttttattatcatactgtacccctggtggaaatcaacctaagaaactcttttgtatttaaaaatggaaataattactgtgcctttgaattgaagtaatctacaaaagaaatgtggtccagactttagactttgttgggactgtgatgatcatttctggcttttggcaatctggatctgaacctttggttttatttagctttccagttctcagggaacaatagaaaccagtcttcaggatatcgacagcagattatctccaggtggatcactggcagacgcatgggcacatcaagaaggcactcatccgaaagacagaaagtaggttatagctttatgcgtagtttctgctcttattaatgtcctttttcacattgactcagttaatttatttgagtttttcttccttaaatagtgtagaaaaactacaagtcctgttaaattgcatgacagagatttactatcagttcaaaaaagacaaagcagaacgtagtaagtaaaatttgctatttgttaatttaataaatccctcttagtaattagttataattcagttaaattaatttggtatatctgtaagggtagcttcttaagctgtttttttcagagatgtgattctgtcaggaaaaaggttgattgtgtttaaaaaaaaaaaaaaaactatccttaaaatcaaccttttgaatactttaaatcagggtcatgaacaccagaacctctaaaggccaggcaggtaacagaaaggaatgagattggccagtggggactcatctacaggggagagccactactcatattcaccaaaggtattgcccaatcttcccatttctcaaaaaaagctagaaatacagaatttgttagaaataccttgatttttaaatgttaactgttaattgttttttacattgttatttacagaccaaataaaagcatctgtgggccataagtaaccaatgagccacaaatctatgacatctgcttcagactcttagcctttttgaagcaataatctcaaaagaaaatacattgtgtataatattatgattctatattaacaacagtaatatattttcctatttctaggattagcttataatgaagaacaaatccacaaatttgataagtaagtatccagattatgtttaatagttatttttggtgctattttggttatctttattaatatgattcttcttaaagttgaaattaattacaatttaaaaatacattttaatcttgattttacaggattgttacaatatgtagacatttttgaggttcacacatctgctccctaattgggaagttaccatgatgggagaaggaggggggagaaagattaccatttcagtcagtcagcttctgcctcatatgctctgattacagaagtacagataatacagcacataggcaagggcagacttaactaccgtcttaattttaaccgcattcaataggcattttttttacatccattttgaaccttctctttatcttcttgctgctataatgtctatcttagaaacgtttactttctcctgtaaatattctaaagccacaacaatcattataggaaagatacatttcatatatttgaaaatttctaaatattgaaagtagaaacagtgacattggtttaagcctctgattatttctaaattacaggcaaaaactgtattaccatgccacaaaagctatgacgcactttacagatgaatgtgttaaaaagtatgaggcatttttgaataagtcagaagaatggataaggtgagtaaacttcttttggagtgattagtggttgactgcacaatataaatgtatatttgaagtaagaatgcttcactagactgcatatcaattgattctttttggttttcagaaagatgcttcatcttaggaaacagttattatcgctgactaatcagtgttttgatattgaagaagaagtatcaaaatatcaagaatatactaatgaggtaggtacagctgtcaaggaaaaattaaaattcttctcagtttataactgatagtgattgacaagggagaaatgggatagaatgtgcctacattcagttccacccaccaatttttaatatgtattttgagccaagttttaagaatgtagatgttttacaactaaaaacagctgataaaccatccttttatcaactgtatgaaaagtttctttcttaaaagggtgttgatttaagtattgtatcatcgatagttttgaaatcaaaatttaaagtttttttaaaggacttattaaaagctgtaacacttgatgtcagatctgtagtaagtacttttgttctgtgattaatgtggggtttttttctttttttttttttttttgatgtttcagttacaagaaactctgcctcagaaaatgtttacagcttccagtggaatcaaacataccatgaccccaatttatccaagttctaacacattagtagaaatgactcttgggtaagaaactcatcatttggaaactgtagtgtttccatttgctttcattgcagtttgtgcttttgctcttacattttgaaattttttatgtttgttgtaatacaatgtttaataaggttatctattgaccagttaaaagaaaataaaacataaacatcattctaaaacatttgcatactgtttttgagcaaaggtgcttgtttattttattagtatgaagaaattaaaggaagagatggaaggggtggttaaagaacttgctgaaaataaccacattttagaaaggtgagtaatgcaaaaataattactgtgattttctgtgcaattgagttcattcacatctgtacttatatcttcctgtatcaatagattcagcagtggtaaagggtcataaagtcagaactcatgtttttctctctatgattgtgtatctgtgatgccttttaatggttgattagttccattttatagaagcactggttaatcgaattacttatttgaatcagtttgtaaagatcaaactctatttacattatttttataacttaattcattggaatcataattttcaatttggtgaatcagagttgctttttaagataccagcactttggtgctgagtagcttacggggtcctctgcacacctccttgcaggtgaaagccacaggtaaatgcagtactttgaggagttaggtgtctgcttattatctgcaaaatcctaatagataaggccaaagagatttgaaagcctgcagaggcaataaagcaatttttggatggcagttttccttatcctgattcctcagagaaattaagtcatatttggctctgtaatagaaccttttctttttcaagcccttaggttctcctctataggttctcaaacgcttgtaatgctaataaaaatatttcacatttggccaggcacggtggctcacacctgtaatcctagcactttgggaagccaaggcaggcagattgcctgagctctggagttcaagaccagcctaggcaacatggcaaaaccctgtctctaccaaaaatacaaaaattagctgggcatggtggtgcacacctgtaatcccagctactggggaggctgaggcacgagaatcacctgaatctgggagatggaggttgcagtcagccgagatcacaccactgcactccagcctgggtgacagagtgagaccctgtttcaaaaaaaaaaaaaatggatatggaatttttgggtcagagagtatgtcaatttcaatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggattcaggcgcccaccaccacacccagctagttttttgtatttttagtagagctggggtttcaccatgttggccatgctggtcttgaactcctgacctcaggtgatccacttgcctcagcctcccaaagtgctgggattacaggcatgagccaccgcacccggccaattttgttctttaaaagggtgcatgttatagtcctaagcagataaaacctatgcatttggcaacattgaatgtataacatcttttaaacattcgccaatttgtttagtaaaaaccgagatcttattttaatttatatttctgtggtttatagtgatgtcaaacatcgtttaatatgtttgttcaattttcatttttggggagagttactcgttaactttaaaaaatattttccttgtttatagtaattatctaacttttatagtatccagtttacagtttcttcagaactttagctaaatccttttaggcttaaagatcaccaagtagaagagactataaagatgtgctttttttttttttttttttttttggagatggagtctcgctttgtcgccaggcgggagtgcagtggcgcgatcttggctcactgcaacctccacctcccgagttcaagcgtttctcctgcctcagcctcccgagtaactgggactacaggcacacgccaccatgcccagctaatttttgtatttttagtggagacaaggtttcaccatgttggccaggatggtctcaatctcttgacctcgtgatccacctgcctcggcctccctgagtgctgagactacaggcgtgagccaccgtgcccagccaaagatgtgcttttaacttttatatttaactacttatgccttgtggaataaaatcccaacttcctaaaccacatttagtaagtcagttcctcctgtgttttatttgcaggtttcttgacaatatataggtgatataacatggcataatcttaacgtaaatgttaagtgacaaaactagtaatggaagccagattttgttcagagtattatactactctgtctccatgtggataacccactatcacttcaaatttttttttgaatctaaaatcatctgtcccaactcagttttctctctgctccttatcctgttcaaaggtaccacctttctcctactcccttaaacataaattattttagacacttaatcttctttataccctctcaacaagtttggctcccatatttcccctcgtcaccctcattcagatctcctttccctttcatatgtgatatatggtaataacctattttttttcttaaccccaagctcttcccatctgtcatgggtattacagccaaaatcatctttcagaatactgatgtaatcgtatgacttctttggctcaaaagtttctaaactcctgttacctaaaaagtcaagtctaaatttatacttcaattcaaagagtgtaatagcctggttccagcctgttcacccaactttacttcccactgctccccaaaataacattgtgttctagcaaggtctcatttctcaacttcctttgggtatgtcacactcccaactcggtatcttttttttttttttttttttttttgagacaaagtctcactctgtcacccaggctagagtgcggtggcatgatctcggctcactgcaacctctgcctcccgggttcaagcaattctcctgcctcagcctcccgagtagctgggactataggcacacgctaccacacccagctaatttttgtatttttagtagagaaggagttttgccatattggccaggccggtctcaaacttgtgacctcaagtgatctgcctgcctcggcctcccaaagtgctgggattacaggcgtgagccactgcgccggccccaattctatcttagcttataaatcccaccccaccagaaagaaattatccagttcttactgacagtttcttaattacatcattacatcggtttttcatgtatttatgataataccatgctgttccagtaagaaatagaacaaatcatagttacttaaactctttaaaaataaatagctatttattcctctgaaaagtattttaaggttgggggcctttatacataaatgcaacttttgagattacctttttttctttgtgtgtgtgttttaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgatatttctttaattctgcttactatttcatggaaaaaaataaatttctcaattttaatgtaaagagttcatgtgtttctttgtatccagtttgtgaaacaaaagttatcttttgaaagtaacaatatagatgataatcataaactactcagaatattggatctagggacaattttgtgtctcttctaaacccactaattctaaatttagtatgaagttctttcatatacttaggctattatacaaattgaaaaggaacatttccttttttttttttttttgagacaagagtctcgctctgttgctcaggctggagtacagtggtgtgatctctgctcactgcaacctcggcctccaaggttcaagcaattctcctgcctcagcctcccaagtagctgggattacaggtgtgcaccaccatgcctggctaatttttgtatttttagtagtgatgaggtttcaccatgttggtcaggctggtctcaaattcctggcctcaagtgatccgcccgcctcagcttcccaaagtgctgggattagagggttgagtcaccacgcccagccgaaaaggaacattttctctgaaaaatatactcagagttctagactaagggattgtgctcagcaagaaattatttcatccaacaggacttttctttcttttggttttggtttgtggcttttcagactggtgaagtgtgattacataaaacccgcgtatcataaaaataacatatcctaaagagaaataaatttgtctaccaagaacatcagtaacttcatcagttttaagaaatgattaggatcttaagtgagattatgatgcattattgtagtggagaattttaagcgtcatatgtacacgtaacaagtaaatgcaagggtgaatgcctttatttaaataatacagttatccactgtcagttacctgtttagtttgagagtgtgtggggcaaggaagtatttaatccctctttattttaattttccatttgaccgtctaatatgggtatcttgtatagtttaaaagcttgtatcactgaatattaggtaaaattttactcaaattatgtgattatttgatatatttgccaatttagtttttatttcagcacctctagcaaacaacaccaataaatagaacctttatgtggcgattgtatttttattaatagtattgataggaatatatctattccacagtagtattttttgagatttactcttttatttcccccttacagtgacatggaagagaagcattcttgctttcagtattttaccctcaaaaatgcatcctcattcaaaacatttatttttcaaaacattttaaataaataaatgcatgataccagtctgctaatgttcagtgactatttaaatgaaattagctttaaaataagttgtatcttcactttagtagctttttaaaaatattataatgttttgaaaagatagcaattaatggtataaaaatagtatatataacaaatagaagatgggtgtgatggctcatgtctgtaatctcagcgctttgggaggctgaggcagggatatcacttgagatcaggaattctagaccagcctgggcaacatagcaagagccctgtctctacaaaaaaaaaaaaaaaatttttttttaattggccaggcatggtggcatgtgccacagtcccagctactcagaggctgagctgcgaagactgcttcagtccaggagttaaaggttacagtgagctatgattgccagcctgggtggcagagagagaccctgtctcaaaaaattaaaaaaaaaaatagaagcgttagtagatgtaactcttagcataaaacaagttatagtactgacagcagaaaaaataaaagtgaaatatgtgaatataaagtatatcaaaagagagctttgg

SEQ ID NO: 16617 - DNA, 102008 bp, Human
  misc_feature (1)...(102008): n = A,T,C or G
tgccattgggctgtctcaggccttcatagttagctgtgttgtcaaagtcatctagggctctctcagatgccagttggtcagggaaaccctccctgactattctaaagaaaatcacacactcccttgcccctctttccttttacccagacttatgattcatagccctgggcactgcctgattttagaagtctatctccctgcactgccctccagcctagaatatatgctgcatggatcaaaaacttggttgtgttcactgatgtagcctctgcttcaaaaataatatttgacagaaagtaaatgcccaagaagtacttgttgaatgaatgaataatgaatgaataatagttaatactggatttttaaaatgacaataacagagacacaaacaatttgtggctcgatctttcttcttcaagttaaatcaactaattttatataaattttctctcaaaatgcatatcttccaattcttcaataattctggattgttaccgcaaaattcttgccatgtttttccagcttcttggatatgatggagttcaaaattgaacataacataggcttctgagaaaagcctaggtagtctataattagtttctctctttctttggttttttttttttaattattttattttagtttttatttttgtgggtatatagtcggtgtatatatttatgggatacatgagatgttttggtacaggcatgcaatgtgtaataaacacctcatggaaagtggggtatccatcccctcaagcatttctcctttgtgttacaaacaacccatttatagtcttttagttatttttaaatgtagaattaaattattgttgaccatagtccgtttccctctgtttacaggtttcacatgcttacccaggaatgctccttgaaaagataatctcctcagacataagcctggccacagaaaagtctctctaaggtcagcagtttctagagtgacgaagtgagaattcgatccttatctgttcacagactctacaaatctcaaaacaccttcctgaagaacaccctgggggaaaaatacaaaaaacctcatggatttagccatagatcatatatattttgaattgtcactctttcactcaacaaataaatatctcctatgtgccaaatcatgagctagaggttggaacagcacattgcatagagaacttggtccctagcctgagggattcagaatcttgggcaccatcatttctgttttcatcattgttgtcatcagtgtcttttgagacattcttattttgatctcctttgatttttatatattatgattatttccaatataattttaaaataagaattttatacttatggaaaaatatatttcatctaatttgaaaaaataaggaaacagtgctttgctttccctagccttccttctcatttactgtaagataataatttttctttttcagggttcgtttcaattttttgcaaaggatttagcaatgaaacactaaaatctcaggcattttcattaagctcattttttactttcctcatatatagcctatatgctttatttaatctttattctttacattaaattaaaattatttttaaaatgactatatttctattgctgttgtgacttttcattgatcaatatttcactaaagatattaactttctctaggatgcagagagactcatagaacttacaccaaaatttctactgaatgaatttccccaccttcttggtgattgtacacctgccttccttataaggagaacaaggaagtaaatcatgttgaagttgcttttaaacacagcttttctgctttacctgtccaggtagcctctgttttcatttcagtcttaatgaaaactttctaacttatatctcaagtttcttttcaaagcagtgtaagtagtatttaaaatgttatacttcaagaaagaaagactttaacgatattcagcgttggtcttgtaacgctgaaggtaattcattttttaatcggtctgcacagcaagaactgaaacgaatggggattgaactgctttgcctgttctttctatttctaggaaggaatgatcacgtacaaggtaagacctgcgttctctgatatattactttcgtggtatgcttgacaaacctgtcatttggttcagaaactagatctgaagtcatgttttatttgatctgttccattgctcttttgtgactgagtgaacactttaacaaattacagacaaacaccgggcagttcccacagtgaatgctctaggcttaaggtaaataaatacaaaggttgcacaggcattttaatgaggagaattaaataacattactgcccaatggaacttagtgccagtatgataaccatttttgaaacttttctattttattctaccacaagatcttccacttaggagtaataatcttgaaagagaaagaggatttatttcaaaaacagaaataacttgtttaagaaagaagcattttttaatggttgcaagtaatttttaaaaattaaagtggcacacattggctaagaataataaataggataatcctatatttgtgaactttcacattttaagaaaaaagagcatgataattttggcttataagacatacataatttttaatatacatacacatattttacatgtgatagatgtaaaatacaaacttttatgtgaattgctaacatttcgaggactgattttggatactaaactaaactttgatgttgttttgttcaagtaatgtaagagccatcagtctcataaatggaatgactgaaagtgtacttaatccctgcatcttgctgggtctaaacctaggtggctgtgccctgggaggtgcagaaacctgtgaagactgcctgcttattggacctcagtgtgcctggtgtgctcaggaggtaaaataaatgacctcaatgtgtttttaaaacctgtctgcagttaaattcatgttaatttcctcagtgatatttctgatagtgacttgcttttttgtggagttgtataagtaaaacaaatcaggaaaggagaaggtgagcattggtagatcaaaatggcattcatgtgattactttcaaaaacaatttgtagaaggagtggatgtcaaataattcggaaaaaaattttaacttgggatttttttattttacctggttccttcttttattgtaaagccatttctacaggttacatgtaaaatatggaggctgtctggataatcagagttcatggagatgatattttctaaagttaaacatacatttgatgttcatattatagttgtattccctctgggtaccaggatccattctgaactactgctagattctaagggatgtgttttaagtttggggcaaatattactggtcagatattatccagttcctttaaaaatggcattttcataaactcagtgactctgtaccacaccagtgacaaagtgccaaataggaactccttatctggtcaaaccgaaaactacatgaaagcagtatgaagatgattggggactatgtaccaagccatcctaagacactagagaatgatgtctaactgattcatggtaaggaagagaggcattagctttctgaattttaaaacaagtctctatgcactggatctcataaagataatctaaacataaatcaaatcatacgaataccaagtgcagcaagagctgagtagcatgctcaaagagcaacaaacctcgacaccaaactcagaactgggttctacctgtggaaacccaaactccgagttcagtgtgtatccatgaagtgtggcctcacagacaagagagcacagacacagctcagtcccttactacggccttgaccaacgcggccacaaaaaaaattcaagagaattatgcttttttttagttcctgtatcaaagcaggattgagaatatacaagaagggaaaaaatcacatgttttttggatattgacttcttgaagaagtattagtttcatgccagagagatacaacaacaaatcagcctagaattttcatttaaatgcatttttcagcatttacttaagagagtttcctaagttgctgctgataactttacttgtgtataatacttggtagccaaattgttgtcaaattgtaaaaccaaattattctaagaggccactctaatattagaagtagttatgaggatgccagtcgaggcagttggagcaaaaagtaaattaggcttctgcttagggcagatagaaaataggtcatgtggttaacaccacctctgatcttctggcaaaggctatgaatagaggtgatagcaatgacactgtgttgagaaggattctgaagccttggccagccactgtttcccttggttacatcatgggaagttacagtttgccatgcctggcctagagcttcagacacgcacaggcctactgatagataacaaattgtattctcaaaatcaatttcagaagaaatctaactttcctagttgatgaaaacagcaagagtggcttggagttctaagaggcaaggaaaatagtatgagcattggttttgttttctctaagcatgaaagtcaatgggcaacaagttcccctttgcatagtgtcatgcccactctaaagcagccacgcctatcaggtaagacaggtatttaatctattagctccatctccctgttttgggtgtttcagaatttgaacggccacatctctgctgggaaagactacatctcactgcccctctgctatccttgtgggaaactcctgtgtcccacgcagaaaagcagactttttttttttgagacggagtcttgctctgtcgcccaggctagagtgcagtggcatgatctgggctcactgcaagctctgcctcccgggttcacaccgttctcctgcctcagcctcccaagtagctgggactacaggcaccagcaaaaagcagacttttaacccatctttttcacttttcttcctcactttcaaatcttggagaaagttataaaggatcttgaactaggatacttcaagactctgggtttaagtccacaagaggtcaatttaggtgaagtaatgctgcaatataagggtaacagaccgatgcatacaactggcagagagtgctagatgggggagatgttgcaatccctaccctttaggaatctgcagaatctctctttatcactagatttggggattgacaccctggagcccttggacagtgtgtcaattcccaaatctagtgataaagatttgatcatggaatcaaacctacaggtcaccctgagcagataaattcatgggatgatgtcaactctgtgaacccaacagtttcaaggatctggtcatggcctgggacaaagctttaaagaactgagcttaagacacagacacacacacacagacacacacacacacatgcaattgttacgtgaattcaattgaacataactgaaaggagactccagttttactcagaattttaccggcagaattctctggttattcacctataacttaactttagacctataatcaatgttagtcatgtagggatacaatatggcaagatgcttaactagcaaattgtgcagaaaaactttcaattgctggtatcttataaagaaattcagatttgttttctttttctggttattgtttttctttttcttttttagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtatgttaggatttggctcatgtaaatagatctaatgtcatatatggtaattctgctaccttgctaatgtgtcttgtatcatattacatatcattgattattatgactcgaatttcccattcttaaggaaatagaaaattattaggctcacacatttctctattcacattggccccggcactccaattgtgttactaaaaaagccttctctaatagtaaccatttaaattattcaaatgttgttaaggcttacctcacatttcttcaagggttgtaatgtagatttaaactctcttttatttggttctccttttctaaaacaacacacaaaaaattcagcttatcttctatctaaatggatgctagttctcccaaggagagataaaatatcctaacttatcctccaatagttctaaactcactgctgaaagaatttcatgggttggttcttttaggatcttgaccacacagttaataaaatcatatgtatttcagtaagttcttattgaggtgaaatagccagctgacccagcgagtggccagtagcaaataaatctcagtgtgttttcctgggtttgcttttcctgttgggctttgcaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatccccttttgtgaaaacaacaccagaagaaattgccaacccttgcaggtaagtaaatgattctcttggcatctttgtgcgctgattttctgtggagatactcccgctctgagctgcacttgccaggagcttgctaactccctggcatttctgccttgtctggttggatctcagcagttctctcagaggcctaggttgcttagagtggaggtgaggtcatctgaactacatggttctagccgtgggtccttgaggcctctgcatttgcctcccagtatagggcaggatgtggcaaaccagaatgcgtgttatgcaggcgagggaaccaagactttcaccataggctccactggatggtgcccagccccagcctctcagacactttctagcctcagtggccaccactttctgaggttatttgagaataaccttcactttcccagagtctttctccatgacaatgacttctggcaaaataataatttttgcaactttctctgacatactttgggaaatattggtttctcttattgcttggagaaggccaatgcagccttcactgctattaaattcagtagtaaatcactccataggcaatgactccattctcatatgctataataagctattaaaaccacacattatgcaggtgatggtggaggacagattgctttgtgacggcttacctgtgcagtgaatgacatgttcagaatcaaatattctcctattgaaaatgagctaccatatgctctgtgccagatctcgtgtggaaggttttacatacatgacctcattcagccttcataataacagcaggttaaacagcaggttaaagctagcttaataacatcagccctatactcagaggaagtaagaggctctgagagattagctatttgcccagggccacatgactaatccatgatctgtaccaagatttgatttgtcccaaaagcaagcccattactgctatatatctagtatatatgaaataatgttccaaatatttattaatttataatacttttatacaccaaaggcatcaatctctataaaagataaacagcttttattataccatttaaaaaacatctcagtgtacttcccaactacaatctaacataataaaaaataatttaaccataaaggaaatttatcaatgattgtaacacttagaaattttgtttggttgcaagtatctgagacagtggcttaaaaagagagtatttttgttttttgtgttttgttttgttttgttttgaaatggagtttcactctgtcacccaggccagagtgctgtggcatgatctcggctcactgtaacctctgcctcctggattcaagcaattctcctgtgtcagcctcccgagtagctgagattacaggcacctgccaccatgcctggctaatttttgtatttttagtagtgactgggtttcgctatgttggccaggctggtctcaaactcctgacctcaagcgatccacccgccttggcctcccaaagtgctgggattacatgcgtgagccaccgcgcccagtcaatattttcttttctcttctacatgaaatacagagaaaggccattcaggggtagtatggcagatccataaacatgaggaatctaggcctttttccccctctctgcttcaccattattgacacttggattttatgttcacagtccaagaatgttgctggggcactaatcattacttcttcatttcagtcagaaggaaaggaggaaaataggggcaataagggcactgtctgcccactccctcgcaactccttttaatgtatagttgacatgcctaaaatgcacagatcaaaaatgttcagtttcatgtgttttgatggttaaatataccattgcaatcaatatccaaaacatgatgtagaatatttccatcacctcagaaatttcacgttacagtcagttctaccacttcagaggcaaccactttctgtttctataatttatattggttttgcctattcctgaattttatataaatatataatgtagtatatgccctatgtgtttggcttctttggttcaacataatgttttgaagatttacctattattttgtatgtatcaggagtttgctgctttttgttttaattaataatccattgtatatattaactacattttatttactcttttattggtggacatttgggttgtttctattttggggagctattatgaaaaggctgctatgagcacttgcgtagaagtctttgtatagatgtatacttttacttctctttgatagacacctaaactggagttgctgaactgtatggtacttctactttttaaagaaactaccaaattgttttccaaagtgaacataccattttgcatttccttcagtagtgtgacagggttccagatattgtatatccttactgacacttgatgttgtcagtttttaaaattttagccattctaataggtgtggggtagcatctcattgtagctttaatttgcatctccttaataatgaatgatgttgagctccttttcctgtgtttatttgccattcttatttcttattttgtggtttcttttcaaatcttttgcccatttttttaagattagactgtctttccaatattgtgtggtaagagtactttatatatgctggatacaagttttttgtcaaatatattttgccaaaaaatagatattttagtcaaaaatattctctcccagtttatagcttgtgttttaatttttctggcgatacctttggtcaagcaaaagtttgtaattttgatgaagtccagcttattaatttttaattttatggttggtgtgttgtatgtcctaagaaatttttgcttactgtaaagatcacaaagactcttcctatattttcttctagaagctttatgcttaacatgcttacatttaggcttctgatctcagattagtttttgtatttggaatgagaaggaaggtctaggttcatcttttgtttccacagagatatctagttgttcaagcactatttgttacacaagaatttcttttccacattgagttatcttaatgtctttgttgacaagcaattgaccatatatgtgtgagtctaattctggacactattctgtttcattgatccattgcatatacccatgtaaccactaatgcctcactaccccccttacagagctttataaaaagtcttgaaatcaggagcataaatcctccaactttgttctttcattttgtttatcctagatcctttgcatttccatataaattttagaatcaacttgtcaatttcttcaaaaaatatgctgagatttttattgagacaacattgaaaccatagatcaatttgtggggatattgaacatcttacacatattgaattttccaatcattttacatgacatatatcttcatttattcatatcttgtttaatttctcagagcaatgttttgtcattttcagggtagatatcttgcacatgttttgttttatttatttctagggacgtttaacatttttattttcgaattctttgtggataacatgtagaattgcaattgattttgcgtattcactttgtatcctgcaaacttcataaattttctcattagttctagtgtgatttttatagattccttagaattttctgtgtatatgatcacatcatctatgaataacaacttctttttcctccaatatctatgcttcttctttcttatttcttaccttattgcaccgacttgggtctccagtacccttttaagttgatgtagtaggtgaggacaatctagtcatgttcatgatcttagggagaaaggatcagtgttttaccattaagtatgttgttagctagtggtttttcatttccttccatcagatcaaagaaatgatcttctattccttgcttggtaagtttttttaaaaaaattataaatggttgttaaattttattgccccaacttaagaggttttgacagaaatactcatcaccttagacttgcatctcattggctggcacttagttacatgaccacagttaactacaaaggaagcacattgctagctgcccctccaaaatcagcattctgttattagggaagaaagaaagatggatacaaggtggcatctgcgagtagttcctgtgacactgaatacatagatttctataaagagttataaagacttataccctcaaaaattctgtataataaaaagtaaggtatgattattgttattaattgcttgattcacttgtgaagggaaataagcttggtgctaacaacctcttaactatctaacataaaagtattgctaatgcttttggccccatttttaaaatcagagaatattatacctgaataaaatttgtatttagttctttggtatattgtgtgtttcccctacaataagcttccatagagagattagtagggcaattccaactagaactccaaagtgccacctctgccccagagggtatatttaaaatcattcctcatgtcacagatcaggtacgatgtagcaacatgtagtacaataataaccatgggaaccaatgagtgtggaatgttaccagagaaaataactaaaattaacaaggttgcatggctcagctaaactagtatcccagcatcttgaactaacaatgagaccctgtccttaatcgggcttcaagtaaatgaaagcagtttggctctttatttacctcttgactgtactttattcatgcatttatttattcattcatttgttcaacaaaaatttactgagttccaactatgtaccaagcaatgtgccaggcatgagtatatttggaagaaaaagacctggtcccagttctcaagtagctgaaatcctttggggaagcaggtacatagtatcgcatggtgattaaccacaagggctttggagtcagccctggattcagtcttgattcatatattcactcataatgtgagcttaggtgaatcatttcatctctcaagccttcggtgttttcgctgtaagtctagactaacaatgccaatcacaaagagtgttttttttttaattatactttaagttttagggtacatgtgcacaacgtgcaggtttgttacatatatatacatgtgccatgttggtgtgctgcacccattaactcgtcatttagcattaggtatatctcctaatgctaaccctcccccctccccccaacccacaacagtccctgaagtgtgatgttccccttcctgtgtccatgtgttctcattgttcaattcccacccatgagtgagaacatgcagtgtttggttttctgtccttgtgatagtttgctgagaatgatggtttccagcttcattcatgttcctacaaaggacatgaactcattattttttatggctgcatagtattccatggtgtatatgtgccacattttcttaatcaagtctatcattgttggacatttggggtggttccaagtctttgctattgtgaatagtgccgcaataaacatatgtgtgcatgtgtctttatagcagcatgatttagaatcctttggatatatacccagtaatgggatggctgggtcaaatggtatttctagttctagatccctgaggcatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgaccattttttcatgtgtcttttggctgcataaatgtcttcttttgacaagtgtctgttcatatccttcgcccactttttgatggggttgtttgtttttttcttgtaaatttgtttgagttcattgtagattctggatattagccctttgtcagatgagtaggttgcgaaaattttctcccattctgtaggttgcctgttcattccgatggtggtttcttttgctgtgcagaagttctttagtttaattagatcccatttgtcaattttggcttttgttgccattgcttttggtgttttagtcatgaagtccttgcccatgcctatgtcctgaatggtattgcctaggttttcttctagagtttttatggttttaggtctaacatgtaagtctttaatccatcttgaattaatttttgtataaggtgtaaggaagggatccagtttcagctttttacatatggctagccagttttcccagcaccatttattaaatagggaatcctttccccatttcttatttttgtcaggtttgtcaaagatcagatagttgtagatatgtggcatcatttctgagggctctgttctgttccattggtctatatctctgttttggtaccagtaccatgctgttttggttactgtagccttgtagtatagtttgaagtccggtagcgtgatgcctctagctaagaattgatgagttggccaggtgtgatggctcacgcctgcaatcccagcgttttgggaggcttaggtgggtgaatcatgagttcaggagtttgagaccagcctggccaatgtggtaaaaccctgtctctactaaaaatacaaaaaaattagccaggcatgggggcacatgcctgtaatcccagctactcaggaggctgaggcaggagaatcacttaaaccagggaggcggaggttgcagtgagccaagactgagccacagtactctagcctgggtgacagagcgagactacatctaacaaaaaaaaaaaaaagaattgaatgagttaacgattaaaagcatttggcattgggcctgaccatgatatgttctcaataaataagaggtactattaacaaaaacagggtgtgattagggggagaccagagcactgcagggggtgcaaaaattggagacctgaaggagaatcatctatttgatctcttaaaaggttcaatatgtcctattttctgaagattattattatgggcaaaatttaccattaaggtggtaaatagcaagttcttttttgtggcaagattatatgtttcccatttccattatagccctaactctcttagtttctctgtccagatagtatacccttgtacacacatacatacatatacatgtcaagataaaaagtcaatcctctgatcaaaccaaaccttataattgtagaataaaatgttcttagtaggaaggcaattagaggtaaaaggaaagagcgtaggatttttcagacctgggttacaatcataactttggataaaccattactctctttgagctcagtctcattacctataaacgggaataataatattgacctcctagagtaattgtgagaaccaaatgaactcataacaaaacagacattcaaaacaaatgttaattttttctcgctctcattaacacttactaatctctagttattttaatctagtggtcctcaaacttttagatctcaggactcccttagactcttgaaaattaagagccccaagagctttagtttatgattatggttatatatacccataatcatcatactagaaagtaaaacagaaacattttaaaataattatctactgatttatttaataactataataataaacccactgcatattactgtaatatgtttttatgaaaaataactgtattttctgaaacaaaacaaaaattaacaggccttctgctctaaaatggagtggcactgttttacatattcggaaatctctttaagcatctggtttaatggaagacaactggattctctatctgctcctgcatttaatcttttgcctttttcaaaaattgaattccatgaagaaagtcaaacctcatgtaaacatatagttggaaaggaagaagcatataatagcttttttcaatgactgtggacattcttctttgatattaccttcaaactagataacaggtgatagtagataacaggtaaaactagataacaggtgaaagtagtttcaatgaggaatctgaaacatcagtgaatgtttcatgttgttaaaatgaaaagccattgatctcttttcattttgaatggatttttttaaccaatgtgtgattttgtaatatgatgctttgtcctttgtaaaatattgattcagtgagctatgcagaccttccagatttcatgatacaatatcaaaaaaaatcacatttgttaatatcattaccattctcatcagacaaatcttaaagtattgagaagtattgtttttttctattttttattattattatactttaagttctaagatacgtttgcagaacgtacaggtttgttacgtaggtatatatgtgccatggttgtttgctgcacccatcaacccgtcatctacgttaggtatttctcctgatgctatccctccccctagcctcccacccccccgacaggccctggtgtgtgatgttcccctccctgtgtccatgtgttctcattgttcaactcccacttacgagtgagaacatgcactgtttggttttctgttcttgtgttagtttgctgagtatgatggtttgagcttcatccaggtccttgcaaagggcatgaactcatccttttttatgactgcatagtattccatggtgtatatgtgccatattttctttatccagtctatcattgatggacatttgggttggttccaagtgtttgctattttgaacagtgccacagtaaacatacatgtgcatgtgtctttatagtggaatgatttataatcctttgggtatatacgcagtaacgggattgctgagtcaagtggtatttctggttctagatccttgaggaatggccacactgtcttccacaatgactgaactaatttacactcccaccaacagtgtaaaagcatttctgtttctccacatcctctccagcatctgttgtttcctactttttaatgattgccattctaactggcatgagatggtatctcattgtggttttgatttgcatttctctgatgaccagtgatgatgagctttttttcatatgtttcttggccgtataaatgtcttcttttgagaagtgtctgttcatatcctttgccgactttttgatgttttttttttttttggaaatttgtttaagttctttgtagattctggatattagccctttgtcagatggatagattgcagaaattttctcccattctgtaggttgcctgttcactctgataatagtttcttttgctgtgcagaagctctttagtttaattagatcccatttgtcaattttgacttttattgccatggcttttggtgttttaatcatgaagtctttgcccatgcctatgttctgaattgtattgcctagattttcttctagggtttttatggttttaggtcttatgtttatgtctttaatccatcttgagttaatttttatataaggtgtaaggaaggggtccagttcagttttttgcatatggctagtcagttttcccaacaccatttattaagtagggaatcctttccccattgcttgtttttgtcagatttgtcaaagatcagatggttgtagatgtgtggcattatttctgaggcctctgttctgttccattggtctatatatctgttttgataccagtaccatgctgttttggttactgtagctttgtagtatagtttgaagtcaggtggcatgatgcctccagctttgttcttttgcttaggattgtctttgctaaatgggctcctttttgattccatatgaaatttaaagtagttttttctaaatctgtgaagaaagtcaatggtagcttgatggggatagcattgaatctataaattactttaggcagtatggctattttcacaatattgattcttcctatccatgagcatggaatgtttttccatttgtttttgtcctctcttattccttgagcagtggtttgtagttcttgaagaggtccttcacatcccttgtaagttggattcctaggtattgtattctctttgtagcaattgtgaatgggagttcactcatgatttggctctctgtctgttattggtgtataggaatggcttgtgatttttgcacattgattttgtatcctgagactttgctgaagttgcttatcagcttaaggagattttgggctaagatgatggggttttctaaatatacaatcttgtcatctgcaaacagagacaatttgacttgctctctttctatttgaatttgctttatttctttcccttgcctgattgccctggccaaaacttccaataccatgttgaataggagtagtgagagagggcattcttgtcttgtgcaggttttcaaagggaatgcttccagcttttgcccattcagtatgatattggctgtgggtttgtcatgaacagctcttattattttgagatacgttccatcaatacctagtttattgagagtttttagcatgaagggatgttgagttttgttgaagtccttttctgcaactattgagataatcatgtgatttttgtctttggttctgtttatgcgatggattatgtttattgatttatgtatgttgaaccagccttgcatcacagggatgaagccagcttgatcgtggtggataagctttttgatgtgctgctggattcggtttgccagtattttcttgaggattttcgcgtcaatgttcatcagggatattggcctaaaattttctttttttgttgtgtctctgccaggcttgtgtattaggatgatgctggcctcataaaatgagttagggaggattccctctttttctattgtttggaatagtttcaaaaggaatggtaccagctcctctttgtacttctggtagaatttggctgtgaatccatctggtcctggacattttttggttggtaggctattaattactatctcaatttcagaacttgttattagttgattcaggtattcgacttcttcctggtttagtcttgggagggtgtatgtgtccaggaatgtatccatttcttctagattttctagtttatttgcatagaggtgtttacagtattcactggtggtactttgtatttctgtgggatcagtggtgatatcctgtttatcattttttattgtgtctgtttgattcttccctcttttcttctttattattctggctagtggtcatctattttgttaatcttttcaaaaaaccagctcctggattcactgattttttgaagggttttttgtgtctctatctccttcagttctgctctaatcttagttatttcttgtcccctgctagctttggaatttgtttgctcctgcttctctagttcttttaattgtgatgttagggtgtcgatgttagatctttcccactttctcctgtgggcatttagttctataaatttctctctaaacactgctttagctgtgtctcagagattctactacgttgtgtctttgttctcattggtttcaaagaacttctttatttctgccttcatttcgttatttacccagtagcatgttgttcagtttccatgtagttgtgtggttttgagtgagtttcttaatcctcagttctaatttgattgcactatggtatgagagactgtttgttatgatttccattcttttgcgtttgctgaggagtgttttacttccaattatgtggtcaattttagaataagtgcgacttggtgctgagaagaatgtatattctgtcgatttggggtgcagagttctgtagatgtctattagttctgcttggtccagagctgagttcaagtcctgaatatccttgtatattttctgtctcattgatctgtctaatattgacagtggagtgtgaaagtctcccactattattgtgtgggagtctaagtttctttgtaggtatctaaggacttgctttatgaatctgggttctgctgtattgggtgcatatatatttaggatagttagcttttcttgttgtgttgatccctttaccattatgtaatgcccttctttgtcttttttgatctttgttggtttaaagtctgttttatcagagaccaggattgtaacccctgcttttttttgctttccatttgtttgataaatcttcctccatccctttatttggagcccatgcgtgtctttgtacgtgacatgtgtctcctgaatacacaccaatgggtcttgactctttctccaatttgccactatgtgtattttaattggggcatttagcccatttacatttaaggttaatattgttatgtgtgaatctgatcctaccattgtgattctagctggttattttgcctgttagttgatgcattttcttcatagtgtcgacggtctttacaatttggtatgtttttgcagtggctggtaccagtttttcccttccatatttagtgcttccttcaggagctcttgtaaggcaggcctggtggtggcaaaatctctcagcatttgcttgtctgtaaaggattttatttctccttcgcttatgaagctcagtttggcgagatatgaaattctgggttgaaaattcttttctttaagaatgttgaatattggcccctactctcctctggcttgtagggtttctgcagagagatatgctgttagtctgatgggcttctcttcgtgggtaacccaacctttctctctggttgcccttaacatttttccttcatttcaaccttggtgaatctgatgattatatgtcttggagttgctcttcttggggagtatctttgtggttttctctgtatttcctgaatttgaatgttgccctgccttgctgtgttggggaagttctcctggataatatcctgaagagtgttctccaacttggatccattctccccatcactttcaggtacaccaatcaaacataggtttggtcttttcacatagtcccatatttcttggaggctttgattgttccttttcattctttttctctaatcttgtcttcatgctttatttcattaagttgatcttcaatctctgatatcctttcttccccttgattgattcagatattgatgcttgtgtatgcttcatgaagttctcgtgctgtgtttctcagctccatcaggtcatttatgttcttctctagactggttgttctggttagcaattcctctaaccttttttcaaggttcttagcttccttgcattgggttagaacatgctcctttagtttagaggagtttgttattactcaccttctgaagcctacttctgtcaattcgtcagactcattctctgtccagttttgatctcttgctggcgaggagttgtaatcctttggaggagaagaggcattctgggttttggaattttcagtctttttgcattagtttttcctcatcttcgtggatttatctacctttggtattttatgttggtaaccttcggatggggttttttgtgtggacgtcctttttgttgatattgatgctattcctttctgttcattagttttccttctaacaatcaggcccctctgctgcaggtctgctgaagtttgctggaggtccactccagaccctgtttgcctgggtatcaccagcggaggctacagaacagcaaagaatgctgcctgttccttcctctggaagctttggcccagaggggcacccgccagatgtcaattggagctctcttgtatgaggtgtctgttgatccctgctgggatgtgtctcccagtcaggaggcacgagggtcagggacccacttgaggaggcagtctgtcccttagcacagctcaagcactgtgctgggagattcactgctctgttcagagctggcaggcagggacgtttaagtctgctgaagctgtgcccacagtcgcccctttccccaggtgctctgtcccagggagatgggagtttcatctaaaagcccctgactggggctactgcctttctttcaaagatttcctgcccagagaggaggaatctagagaggcagtctggctacagaggctttgccgagctgcggtgagctctgccgaattcgaacttcctggtggctttgtttacactgtgaggggaaattgcctactcaaccctcagtaatggcagatgcccctccccctaccaagctccagtgtcccaggtcgacttcagactgctgtgctggcagcgagaatttcaagccagtggatcttagcttgctgggctccatgagagtgggatctgctgagctagaccacttggctccctggcttcagcccccttttcaggggagtgaacggttctgtctcgctggaattccaagcgccactggggtatgaaaaaaaactccggcagctagctcgctgtctgcccaaacagccacccagttttgtgcttgagacccagggccctggtgatataggcacccgagggaatctcctggtctgggggttgtgaagacaatgggaaaagcgaagtatctgggctggaatgcaccattcctcatggcacagtccctcacagcttcccttggctaggggagggagttcctgaccacttgcgcttccatggtgaggtgacgccccaccctgcttcggctcaccctttgtaggctgcacccattgtctaaccagtcccagtgagatgagctgggtacctcagttggaaatgcagaaatcacctgccttctgcgttgatctcactgggagctgcatactggagctgttcctatttgatcatcttaccagccttctcactactgctttcatatcatcagtgcaaatgtcaacacagtgaagaaggcaaatgacatctctgaattactgtgaaaatagtttaacgtgaaggacctcctgcaaggtctcagggaccctcatgggtctgtgcaccacccttcaaaaaccacaccaaacccccatcacacacaatttacctatataacaaacccacacaggtacctctaaacataaaataaaagttaaatacaaataaaaataaaagccaccctttttccaggtgcagtggcacatgcctgtagtcccagagctggaggattgcttaagccctggagtttgagtccagcctgggcaacatagagagtgtccaaggctctataaaaagaaagaaaatccacctctttaatctaatctttatgttttctggagtagctcatttattttcagtggatggagagacactaaaaatttatttcaccctgttaaaaatgctgaagtggtttacatttttgaaaagaatttcttttgctgttgtctaagatacagcaacattctgaaggttgttttttttgtttgtttttttttttttttgaggtggagtttcactcttgatgaccaggctagagtgcaatggcatgatcttggctcattgcaacctctgcctcccaggttcaagcgattctgctgcctcagcctcccaagtagctgggattacaggcgtgtgccaccatgcccagatgattttttttttttttttttttgtatttttagtagagacagggtttcatcatgttggtctggctggtcttgaactcctgacctcaagtaatccacctgtctctgcctcccaaagtgctgggattacaggcgtgaaccaccctgcccggccgaaagatttttgaaacatcattttatgtatactgtggtgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaccagcctggccaacacggtgaaaccctgtctcaactaaaaataccaaaaaaaaaaaaaaaattagctggacgtggtggtgcatgcctgtaatctcagctactcgggaggctgaggcaggagaatcacttgaggcagaggttgcagtgagctgagatggcaccaccgcattccagcctgggcgacagagtgagagtccatctcaaaaaaaaaaaaaaaaagaaaaagaaaaaaagaaaagaaatgctagaatggatttcctctatgttcacacacataaacatatatgagtatatggtatatagtttcttattgcaaaggtaataagtccatgtgaaaatacagacaaaagtaagaagtgaaaatcatttctaacctcactcaggaaaagacgatattaatactttagtatatgtgattatagtcttattttataaatatttatttaaaattttaacaaaaaattgaagtaatatttatattgtgttttatcattattttgcattttaaatgcaaatctctttttatctagggactcaaaatcaagtaatttggtgagaggtgcctatttcttttaattggtaggctaagaaagtaacaacaaaatatgaacatttgttagaaaatgaactcttgcctgtaatcccagcacttttggaggccgaggcgagcagattgcttgagctcaggagttcgtgaccagcttgggcaacatggtgagactccatctctacaaaaagtactaacattagctgggtatggtggtacatacctgtagtcccagctacttgggaggctgaggtgggagaattgcttgaccccggtggcggaggttgcagtgagctgagattgtgccaccacaaccgcattccagcctgggctacagagggagaccctgtctcaaaaaaaaaaaaaaaaaaagagagagagagagagagaaagatagagagaaaagaaaatgaactctgatcaaaacatgggcaatatgcactcaaaattccctggcgtgagccatctctgacattctgttttgctttagctctcctatcacttgaatttctttagtgagttaaattaaaattttattccactttccaaaggcacagagttctagtaaaatctacatagcggataattctaaccaacaaagatgcaaatctctcacaaaaaataggactgctacttctgtggatctggaagatgctcaaatgtcatttcggtatggtatgaaccagtagccccaaataatagattaaacaatttccaagaatagttaggtcccaggcacaatggtgtacctaacatgattacatactttttatctcatataatcgtcatggcaactttgtgaaatagatattatgatcattcccattttatggaggaagacactgaggccagtggtgttgaataacttgcccaaagatagataactggccgggcacagtggtgcacgcctgtactcgcagcactttgggatgccaaggtgggtgcatcacttgaggtcaggagctcgagaccagcctggccaacatggtaaaaccccatctctactaaaaatacaaaacttagctgggcatggtggcgtgagcctgtaatcccagctacttgggaggctgaggcaggagaatggcttgaacctagaggcagaggttgcagtgagccgagatcatgccactgcactccagcctgggtgacagagtgagactccatctccaaaaaaataagatagataactgttcgctctttttattctaaatccaatgtattttctaccacccacagctacttcaagtgctctaagggcaattaagaaatatactgcattattgtcatttaacaagttaaatattttgaaaaaaatcaggctcctttcttatatcacactttaaaaatgcatcttagatttgaaggtgggaagaagtttgactgcatcaaaacttttaagatatatatccaaaaacatcatgaacaaaattaaaagacaaactacaaagaaaaaaatgtaatatttttaggatggttctttttttttttttgagacagaatcttgctctatcgcccaggctggagtgcagtggcatgatctgggctcactgcaagctccgcctcccgggttcacgccattctcctgactcagcctcctgagtagctgggactacaggcacccaccaccaccccgggctaatttttttgtattttttttcagtagagatggggtttcaccgtgttagccaggatggtctctatctcctgacctcatgatccgcccacctcggcctcccaaagtgctgggattacaggcgtgagccacagcgcctggccaggatggttcttaaaattaaattagaataagaaatgtagcaaaggatatcagctagcaattaacaaaagaagaaatacaaaatgttaataagtagaaacaatcactcaatcttagtaataataaaatgaaaattaaaactaacaaatgccattttttgctaatcaactagtatagttttttttaaaaaaaacaatgatgccatgccatacactaataccacagatggcaatggatacaaacttttttggaagagtttggtaatatgagtcaaaagataacccagcaattcacaatcaaaaaatttattttaagcaaggatatggaatagtttgtacatatgtatgtagaaggatcactatattatttaattacaaaaatgttcaaaataaatgctcagcaatagaaagatgatcaaataaactatgattcatctcacaacaattacaatttatgtttttgattcttttctttacactttcatataaaaccccaattttcttcaatgaacctgccttattattttaatcaggaaaaaacattattctagagataccattagccaaatccattatctgtacttaggtctgttctagactgtgtgaagtgatttatgtaagaaatgacaatcatatttattatgcattaactctgaaaagctcatcgtgctgtattctttgcctgtttgatcccattcaagcctcatgacaatcctgctaggtagatacagtctgtggtcagcactttagagtttcaatgaaacctgatgaacaatattaaaaataagagaataaggttgtcttctgagagttaaagttaaacataataattaggaaaggaaatttaaaaattacctggaagcgacagactggcccctggacccagtagactaggtgtattgatgcagctgaaaggacagagagacctagtgggctagggcaggacagagaaggggatgtcacagaggccagtgtgggccacatccatccaagagcctcggccaacacacttccagagcttccagtccctttggttgcgagagcttttcaaatttgtgttagctgaggaagtggaccacagatgggggaggggtcagaagtgaccaagaacatccattctggggtggtcgtcttgggacatattgggctatgccattcagtgctgggttcctccatttcccctagttctgaagcctggggacatatccaaacctcacctgctttcaaggaaagtctactgataggaagaaaatgatgatactcacaggcacaagcattctggtcccggtgagagcatccttactcagtgtgaaagagtccatgatcattctgatctatctgtacacacagtcaattctcattattcatggtagtcatgttctgcaaacttgccccaagcaatgaattatggaatattgaatcattgctcccaaggaaaatatagggttaggttcctgtgagcctctggctatcacattttcattaacaaatcactacacaaacttattttatgtgtgcttctatttaaagacgccacatgtaatagatctcattgaattataaacattgaactccagacgaaggcactataactcatgcctgaatgaagcttgtctcacacagcttattttctcaatgagacacatcacagccttcttgcacttaggaacactaaacagcatttcagcattatgcctgggggctattttaaacagtgaaaccatccatgaaaagcataaaaatgaaagaaaggtggtactatgtagaccgtgaaaaagacactggcttagagttggaggcctgaaataagaaggcagagcaccaccgtgtttgattccagttgggaatgtgcatatagggagatgctttgttttgggtttttttgttttgttgttttgttttgcctgtctacacatgtccacgaatgactcagaaaacacggcaagtattaattagggagtaacaaataaatcttagcaactaggtgaattcacaaatatagaatctgtgaataatgaagatcaactgtatacctcaggcagatgaacttgatgaactgaagcctaacattgaaaaatgcaccttctcgtgctgacaaagtaagctactggacctgtagagccaaggcccaggccccacatgtgcccatattaagaatcaaccagttcatccccaggcagcacatcattccctcaccaggcgctatgcctttttgtctctttgcgcttctacaccagtgattctaaaactttagcatgcatccagaaggcttagtacaatgcacgccagtgagcctacccccagcatagctaactcagcaggtcttgggtaggggttcagattttgcatttctaacaatttgccgggtgatgctcatgatgctgggccagggatctcagttggagaacctctcctctatacgattatccgcattttaaaatccaaagctcagaagtgttgagtaacttgcccaaagtttcatgcacagctagaaacttgctttcaaaataagatgtggctgaactcatgatcagccctttgtgttctactgtaatatctttggtgcagatttcatcgtaacattgtaccttaagtagtggttttatttctagactggcctattcaatcacagtagagttggactctcaaatcaagaatgctgctacaattgttgggcccttggcaggcagacctgggagtacaggagggagcaaaggaaaaagaagacaggttcctctcttgtcttgctacagggtgattcacacttgatgacagcctgagatatcagaatacaaaggaattgtcgttgtattaacttagtggtgaattttggttgggagcccatagaaggtagtgattacacacacacacacactggagtctgatcacctgattatctgttatctgagtttgagccagtgcaagacacacaataagctctaaataagtgtcagcgaatatggtcaacatagaaagggttggggatgatgtcaacaaccttaacagtgagattcatagctgagttgcagagtcaggccctttagaaaaactaatcttcatttaggagaatgttgctaagctattagatccattaattgtgtgtggcatcatatttcatcaacagtatttttgcatcttacttttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggtatgctgaagggagtgctgtttcactctgttaacataaaattcatctcttattaataattctacttcaaaaagattagctaatttcctttcctttgatctctaaatttctatatttcatatttttcttaaaatacacaatttttaccaaatgtttaattaaatcatgttgaaatggggactgtcctttctgcctactatttgaataatctaagaaaattgtcgtgttgggaaaatttagttgaaacaatagctatgcatgattgattttcaaagatcaagatcagattagtttttggattaatcatgataaaaaaatcaagggtagaacatttattttaaaaagttaaaatgctctacgtcagtatatgttcatacatatgactacatagctattgttttgaaccaacaataagcttcggaagtttgctgtctctacaacattacaggaacactgctcctccttgactgtctgacaagtatccacaagaattattcccctgtctttaggcaacagcccttcatgaaaaatatcaggaaataaacagggctgaagctcctagaaggtgggagggccaaggaattagaggaggaaggaaagggataaggtgggatggaagagccaggatgcgtttttacccaattagttcctggactaatattaattaaaggggagggctttactaaacaccaacaacagacaattttaattaacaggaccttcgggccatactttcataagcaattcttatccttgtattaggttcataatttttggatgacatcattggaaagagaaatatgtgcctaaatgttgggtgacattttaatgaaacaggcttactctgagcccctttaacattgcattttgatgagtttggcttcaatttggatttgggaccatctatgacctcctctgctcaatttttttggagaattgaaagctggatagtaaaaataattgaactatgtaaaagtcaagattaactgcataccgattgtagtggagctatatttttctgaagcataaatcatatgaaaatgttatccaggaaaaagcaaatgtcacagaatttcatgttttattaaaaacattaatattatcaattcacgatagataaaaaggctaaaatagactagcaatattatttttataacctaaatgtgtccaagcataattgatccacactcaataaatgcctgcctccctccaatatcacacaaatgtttctttctcactgtaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggtgtgtaacctgcactctgtactgttttcagggctataagtaggagaacgaagcaacaactagtgtaatacatgtgaaataacatacacttggtgaaagcagtgcacattttctaatgtgggattaacaagttgccccagctcgattctcaccatcctcagaggttcccaccagagcataggtggacggtgggacatgtgggaagttagatctgctatgaatcccatgatcccagaacctccccaacttctcaaaaatcctggtgctggtaaagcaatacaggcagctcattctattctcagccacagcctcagaaaggagggacccagaccagaacagtagccacataggatttgcagtgaatgatagtccttgaatcaggccatcctttcatgttccatgggtaacaactagtcaggtatggcttggttggtgcttgttaacctttggcttattttttgtcatttataaaatgctagtgacattcaaagaaaacagctaactcttgtaaaaccaggaaaaaatttcagagctctttggacatgcatgatctcctcaatagacccctatgtatccagctgcttttcctgaacagaccatgaggctgctatgcttgtgcacatgttattccctctgcctggaatatccttccttcctagcctgctgagaaactcttcattatccttgaaaagccagttcagtcattactgcccccagagagccttctttgacctctgccaggctctgaagcaattgtctttcccttcagttgcatacacagatgtgttcttgtgcatctctatgtagaaatatgttttcttacatctgtctgtctttcttgcacaatcctcaggtccagacctggtttattatctctgtttcctgatagcacggtgcctataacacagtgggtgccaactaatgtatgaaatagaggccgggcacgttggctcacgcctataatcccagcattttgggaggccgaggcggtggatcacgaggtcaggagatggagaccatcctggctaacacagtgaaaccccatctctactaaaaaatacaaaaatttagccgggcgtggtggtgggcgcctgtagtcccaactactcgggaggctgaggcaggagaatggtgtgaacccaggaggcgcagcttgcagtgagccaagatcgcaccactgcactctagcctgggcgacagagcgagactccgtctccaaaaaaaaaaaaaaaaaaaaaaatagatttgatttctgaagcagcagtctgagattgtcatattttccccatttaacacttggggaaatatggtacagagaatttaagtgacttcttagaacaatgctgtggtggtgtaggtgggggtgcagggggagagaaagagggagacgggaacctagaattctaatgtcaattggaaaactattctctaaaaactcttaacagttcattactcactactattccttgacctaaatttctaaatttcgacatgaatgttttccccaaacatttgatcagtagtattccccaaatgtgtatattctttaatcacatactctgccttttcatattacaatatcagtgaggatagccgcatgttgtcttttagtcagtgaggggcaagaaactggaaaatttatccccttttcattacccttttcttgcaacttttcaaaagcaccacaaaaagctccattttgaacgaggcaggttcataaaagctaacactacttattgcctaatatgaacttctcagctaataaatgttcaagttgttctttctgaataagttgtaacaaatccacagaagccagagaccgtatctatgcctgcctgcaacatagcccccgggtcctctgagcacttcctgtgtactcaaaactcgggccagattcctcaggccaaaaaataatacaaggtggttcctggccttgaacttacagtatggttgtgggaattaaaccaacagatctgattcaaatagaaaaccagcttcgctcaccttcgaaggactatgtggtgtgatcctggctacacacacacagcagctaaggagtgtgggaacacgtggagataaggagggactggcactggagggatttaggcatcagcgtaaaggatttttacgcagttgaaaagcagaggaaatggataatatttggtatctctattaataaaaatccaaatgtgatggaaatcacatatgacatagccatttgcagttgggtaatttattgcagtgttttaggcaaaactacacttttctctcaacttgaaccttgtgcctaaagaaggctttagatgaaaatactccagtagtactaagaatatgtgaatattccatatgagtgtacaggagggcttatttatcagtgttcctccctttggctgacttctccctttgactcccttaacataattaacatatgttacttatgtcataattaacatattcttaatttaattgttagcaggctagtacctcacttgagtttcctctgtacattattcacatttagattcatataatgggcaaatgccacataatattttccaaacttgaaaagtaaagtccatattccaatttaaaaattaagcttcttttattttttatacagtacacatatcacttgggaacaaatatgccaatggaacagaagtacaatgtagttttcaattgtcctgtaaaaatattgcacgattccatgcaaccaacttgtgatattaaaatggcagtaaaaccaaacccaaggattagtacgggaatgtcatagtatgtcatacctcagcaaccctcattccacctcatccaattccaataggagtttcagagctacaagagtcacttcagtcatgtatattatagtccaacagcccctccctcgactgaggaattcctagcctgctggtaagtgtcacttagaaggagaagaaatgtttgtctacccttgaaaataggacacactgttagtctttaaataaatttcaaatggtcttcttagaagtggcagagcatgatacaccacatcaacaggaactgactcttaggacttgactggatttataagatttagaaaaagattattaaaccaactaagtgaataatgctaattgtgtatttgtttacttagagtgatagagctataatgcctgtgagcattgaaatgccaaactcaaaaaggtatctttgaaataaatattcctttctttatttacattattttattgagatgatgcaaaattatatatgttaattttaggaatatccaacaattggacaactcattgataaactggtacaaaacaacgtgttattgatcttcgctgtaacccaagaacaagttcatttatatgaggtaagcaaaaataacttgggaaattccttcaaggagattatgtgacatgaaactttaacattaactctgtgagtttaacacatgggaaggccattagataatcattaacacacaccaaatgtactgggcgcttggctaagtggactcatttactgcttgcaatttaaattgtaaacacctaggtgcagtagggcatggggaactaataaggtgggatgagaaagactgagttaaggaaatgaaacagatatgctggaggagagtatcaacaaatataggacagcctacctaaaagaaaatttattatctgtccccttgaattatttcatctaatgagggagttaacagagaacagagaaaatcttaagagtgggagcagaattgacttcacattctttggcatttgcaaattagatacttagaaaagacacacacagagacacaagctattgagaattggaaagttaaaggaaaaaacttgttatatggggccaaaatacaatttatcccttaaaccagctggatttgcagctcaagtgtttgaatggaagcaccaactgcaaaaagggaatggtttcattagatgaagtgctgtccccaaaccactgtgcaaactgcaaaaaaatacgatatatgcacatacaaaagatttctgtggttttttttcccagcctaggaaaaatatgtcaaaatgccctgaattgatttactcctgcagttttacagagaagtaaggagtctttagcaggggccctaaaaataatgcagagaaattaaatagtctgtgccttctatgcagaagtgtcaaatgctcctaaatacagagtttgatctctcattccttttgaaaggacctcttaacttgcttggtgacttcacagggcttctgaaactctgagattatgtcacagaaggctttgattaaatgccactcactactaaggacggtacagccccatgaacttgcatcaggttctgtagaaaggatccagcaggagatgctatcttgcattttgaatgagaggagggtattgtactcccaggtgagattgccttctgctgcaaaccaaggaagttccttgcaatcaagctccatacttgaaacctgtgttctacgcagagcccatgtgggttcacctgatatgggcattttcttcaggctttttagtatgtgatatttgtttccagtggttttaagtagtagagttgcagttgaaactttttttaaatacccccaaatacaatagtgagtctattctgcctttgatccttaaggctagtgtgagaggaccctgggggtcacaacaccttctccacagcaaggctccagtttagaagtgggaggaggagttgcacagaacttttcttcaaaggggagtctggggaatgcgattgatgatcgtgaacatagactaccataactcactttggtaatagtctttaagactcacaactcatttatacgtctccccaaaaccgctattaaaaagacagaggcagatgaaaaataactacatggcaaaacagagcctgtcggatttaagctagttgcatccatgattcccccgttgcaagggaaatgatcatttccgaggaaaatgccagattagagtctgcctctaatgtaacagcaggacatcgattttgcctgtcttctaatcttattatgaggcgaatttatgttctgtcatgatctgtggtctttaccatccagccttcactaaattcaaagggacattttcaaggggtcatacgacagtccaggtcagccacccactctatgactgaccgtttcattgttttatttttattttgatgggctcatcattccatctgcattagtaggggcaggcagcagcctggcctaaagataataacagcaacaatgcacatccttgaagccttcacacagcatgaaaatgctgatcttccattttattgataatgaaaactgaaaacggtccactaatggcttgtgttgcctttcaattcacatcttttagaaggagccctgtatgtgcaggagtcctgtgcgatttgatgtttggataactgcgatataaggaacgtagctactgaagaatcactgaaaaataaaaccagtgatagataaataaagcaattaagtggttagatttcatgaaaattccagaaggaaaattatttgcccgagttacacgttaagcatagttacttgcctgcacaggccacacaggtttaggttcaacgaaggccctgtctgcagcaaataaaatttatgttgcccactcatggaatgcaggaaaaatgactgttttttttagtaactgtggtagaatgctttggaccgcccaggtgtgtagtgtgcctgtacattgttgtaacagagatgaacagtgaaaaggataaagtaagcagttttgcttcagttcagtatggctgtagtgtgcaccccagactccagccaacagaatatttttgaacaaacttattattatgaatagtttcctgtttgtccaattatagggttcgaaagataatgatgataatagactgagcagtgggtagtatattacattctagtgctaactaccattttgaatcaggattcaattacccaagttaaaaaaaagtttttatatttcctctgtagttttaaaatgtttactgttaatttacattaacatagtatcaggccactaaacctcaactgtcttatctgaatagcttctctttcctagtaagctattgagataaaaagcaattaaatcaacattctttatgacattgtcgaatcatattattaatcactgtgggctatttccaaggctttaaaatatcctatagctattcaaaatatctacatctggcttgaaaagatgactttagtgaagttaatagcaataattattatatgacctggtatttgtgatgtaatgctgaaacacagcaattggaaagtaaacaagaagtatactggtacttccagtttactcactaacttctatgaccactgattaatatctcttggctgttagcacaaagcaatgtttctaaagcatgagagaaggggagtacaagcaggtttttatgcagccaaagggacctttcctctggagacaaaaaaccctcaatcattaactgtttgaggagaataacaggtctttctcatctgtttaggccaattctcgaagcacagtagattctcagtagatatttgtcaaatgatttaaaaattgcaataactgcacttcatcttttctaaaattgggtcaaaagaaagacttggagttttgcgtgacaagcacttgttaagattgaggaagcccacagacacagagcaagtgggggcacctgaccattgccagaaccttctgcagccctggctgtcccttcttccatccctcccacattggatgcagatgaacactctgccatcagtctcaggaccaacatgttggagaagctccacagccttctagcaggccataaaaggaacaccctgagcaagtacccacctgatggccattagatctataaacaaacataaacagcagccgcatatgctataagcctgatgtccttgtgtggcttgtggaaattatccaccatacgtaagtttccatttttcaggaatcaataacccagctgttattttacctcttctttcttctatttggttcttttgagcttttcattgcagcgagggaggaaaagaggcagagaaaatagagagagaaaataaaaattggacccctttgctatttgttagcctgttctattattgttttgttttataatgttcctgttggaaaagatcaaaacaattttgctccagtggaaatctctttatctctctggcctcagtttttaggcaataaaaaagactgggcgggaagatttcagcctcaacagtcaatgaccttgattctggaggagggaaattaccatgaattccaatgacctccacacaaataacaaagtttagtaagctgtaatgtagctaattttagggcatagtctagatattctttatcctatcaatctcattctgtagtggagtattccaaacttgtgattttagtaaaaataaaatcatctaggagtaaaacgaccacttctggattatgagacatctccatggaggtaataaattgctctttatttaagtgtaatggaaagtattttcatttctccttaattgatagtatctgggaacaaagactgaggagggccagctgcctacactttccttattaatgaaaacatcccttagagagggaggttttggaaataaaccttatgtcctcagattatcagtcagagttgttgggagtattttccaatcctaaccatgaaaaatcatcagttaccccttagatcacacatagtacttttcttctaaagaactcaaagcctcataactgagaaagtaaacacaagaaagaaaaaggtacaggtttaaagcaggaccttaatgagatgcctgattaggccaatacttgtagaaatataaaatgggatttttttttttcttgagagagagtctcactctgtcgcccaggctggagtgcagtggcatgatctcagctcactgcaccctccgcctcccaggttcaagtgattcttgtgccctagcctcccgagtagctaggattacagatgtgcgccaccatgcccagctaatttttgtatttttagtagagacggggtttcgccatgttagttagccaaactgatctcaaactcctggcctcatgtgaactgcccaccttggcctcccaaagtgctgggattacaggtgtgagccactgtgcccagcctaaaatgggatttcaataatgcgagatctaaatgctttgagatttacagatttacaacgcacaggatatctagcatatcattgaaactaagacgctatagactgcatagtcattcattccttcatttctcaaacatatcatgagtacctcctgtgaactatgccaaagtttgtgactatagagaagaataagacgtagtgcctgccttaagaagtctcagagagcatcagcagacttgtaaactaatattttgcctataaaaacagaatgagggcattttagagttgtgttctggaaagagactccagctgaggggtcagagttttcatgtctgtcaatgtttttactcttttctattcactatctttcctataaggagcagcaaattaatcggcaatcataaaactgcttttgatgctaacaatatcatggtgttggaccaagcccttcactttataggggtgagggctggtgatgatatgcaactatgactatgataataatagtgtaatagggaacgtttgtcaagagcttattaggtggcaccctggaggttcaggattttgcactcattttatcatttaaactccttcttatgcaaattgcatgtaagagccaagatttgaactcagataatctgaatctacagtctcaatcactgagataactcacaattgaatcactgagataactcacaattgaacctgctatagtgaaaaagcagaccactagaccaccagacacagattttaaaataatcaccttttttttttttttgagacaaagtctccctctgttgcccaggctaaagtgcagtggcacaatctcagctcactgcaaccttcgcctcctggattcaagagattctccagcctcagcctcctgagtagctgggattacaggcgtgtgccaccatgcccagctaatttgcatgtttttagtagagacggggtttcaccatgttggccagactggtctcgaactcctgatctcaaatgatccacccacctcgacttcccaaaatgctggaattacaggtgtgaggcactgttcctggtcaagcaaccagctttaaaaagcatagaattcaagggtagagcagagctgcctgacagctaaaccaatagatgaattccctgtaaattgcacagtgctttaagatcaggaaatacttcatctagggttcttccctattgctgttaatttggatgaacagagcaatttaaagatgcatagacttgaaaaaagacagacacttggattctgccccgtgggttgtttaagctctgggtggtaagaacaggccacacagctagggaacactatgcattgggtcagcacatctaaaacagctactgtctatggtaatcacaatctatggttccaatcaaagtgagaaattgggggcacgtggtctgaccaagactataggtttatgatgagcatatagttcaagcatatggaaaaatggcgtaatataataaacactcggccgggtgcagtggctcacgcctgtaatcccagcactttgggggccgaggtgggtggatcacctgaggtcaggagttcaagagcagcctagccaacatggcgaaaccctgtctctactaaaaatacaaaaaattagcaggttgtggtggcatgcacctgtaatcccagctactcgggaggctgaggcaggagaatcgcttgaacctgggaggcggaggttgcagtgagccgagatcgcaccattgcactctagcctgggcaacaagagtgaaactccatctcaaaaaataataataataaataaacacccacatacttattgccagttttctcacattttaacattttgccaccatatttgctttggattttttaaacaaatgaaacaacccagatctagttgcatgctgtgtaactgcccaactctggtctagttcccctgtccttctacagaggtaaccagtatcctgaacttagtgtttgtcattctcacatttgttttttgtgctattaaaaatatgtgtgtgtgtatatatatacatatatatatgtacacatatatgtacatccataactaattatgtagttttggcttataagcttaatttcatgctgtacacattatttttaccatttgctttttgactcaatgttatatatttggggttttttattatattttcttattatggtaagatacatataacataaactttacattttagccatttttaagtgttagttctgtggcattaagcacttgaagcactctgccatttatagagaatttatctattggttcatctgccaggtattaaaactttgttaagctcaatgctctgcttttgaggcttgtccatggagatacgtatagctatagtttactccaccccactgctatgcacgctccattcacagtattactggcaatgtgttcattctgcaagtgagggcatcagatcacttccagttgtgcagcattacaagtgttgcagccatgcacatctttgcacacatatgctctattgagaagtgaaatccttgggtcacaggggaatggcatctataattttactgagtttgtccaagttgctttccgaagtagttgtatcagttactctcccaccagtaatgtagtgtggaagtatgaccaaaacaaaatgaaactttaagttactctttttctgattataaaactaatatatactatttgcaaaaagaaaagtgaggaggaatacagaaaacccaaagaagaaaacaaagatcactcataaactcaccactcagacatagctaacattgttgacattttagaataagtttttctggccgggcatggtggttcatgcctgtgatcccagcactttggaaggcagaggtgggtggttcactcgaggtcaggagttcgagaacagcctggccaacatggtgaaatcccgtctctactaaaaatacaaaaatcagccaagtgtggtggcatgtgcctgtagtcccagctacttgggaggctgaggcaggagaatctcttgaacctgggaggcggaggttgcagtgagtcgacgtcatgccttaatcgtacaattaagtatgttcaaactttttgaatgtttatacatgtataatcttataaaggcatacaaattaaattgcatgtagttatacatcaaaatttttattgatgagagtaactatatgaaatcaagatcatcctacaaaattctgagcctatagttgccatacttataggtgtctactttaaaataaaagcaaacttgtcctttcccaccagcagcccaaaacctgagcaagtactgcatttttacctcctgggttacttttacatattcacataatacttagttacttttttatattaataggaccaacaaattatttccagtattcattttcttatgcctgaaattgcccctttggtgaagactttgacatctgtgaacaaaactcctctctgagctgctaactgctcaaagctgtgtaattacccttctccgctttctctgggtctcacagcacaagggcactcctgcataattcagttacccatgtatcccctaaagcctttcctatggttgcagttggccactctatgtggtgtctgtgaggctggcccggactgtaagtttgaagggagctcacccagcttgtatcactatgcaggagtctaacagcaaccaagcattttccacgtgtcatagcctttgaaataatcacatatggcatcaaggcacaaaaggacaagtgaaactgacaacccccgggacataagaagagtttaagagtattttctattttcattttatgtctgattatccagaaaagccccaaatatcctaccaagggactagtattaatgataacatagtttaacattttgttgtcttggcattattgaatcttcagaaaataaacagaaaattttggaatcattatttgttgagcttgaacagttgaggtaattatttataaattcaagggttggcacacttttttctatagagttttcagattcagcacataaaaatccaggagatccagttaaatttgaatgtcaagtaagcaacaaataattattagtataaatatgtcccatgcaatatttggaccacatgtacactaaaaatttttcattgtttctctgctttccaatttatctgagcattctgtattttatctggccgcctatctacaaagggtcaaatagtaagttaggcattgtggccacatggtttctgtcatgattattcaactctcattgtagcatgaaagcggccatggacaatacataaataaatgagcatagttatttacaaaaacaagcaacaggccaaatatggcccgtgggacatagccaatccctgccttcgttcattcattctacaaatatttatgtgttttccgtgtgtcaagcactggactaggccctaggagtatagaggagaataaaaaaagacactgttttgtcctcatggacttgtaatctagtagggggaaatagacgagaaacaattaatgaaaaaacaaccaattacaacttttaatagtgttatcgaagaaatggaaaagaatagtgtgcagccatggaccataattaagggggagaaagtgagactttccttggatagaattttcatggaaggtgcctttccagaagtgataatgaggaagcgagctgaaggctgaggagttttcaagaggcaaaggcgtgtgcaaaggccctgaggcagcaaaggactcagttcccagtgtgcttgagaaaaggaaaaaaggccagttggcctggagtgagtaggggtagaaggagatggagcgggagaggtaggcagaaaccagacccttcaatcttgaaggcagtgggaagtaagcagggtgctattctatgggtagcaggcatccaaaaatacttttgttgctgggtatagatgtcacaggtatatgacaggctgaaaaccctggataaactgtgggtatatagatttaaaaacctaatgcctttattttccaaatcactacaagccctctgatagactgttctacaccagcagttctcaaacttaggtgctcattagaatcaggtagggagctttactaacaaacccaatgtgtaggctacaccctgatccaattgagttagtatctctggggctgagacccagacaccagtggtttttttctttttattttcttttttaactggtgtatccaatcaacctgggggacagggacctcttaaaatgcagactgtcattcaagaggtctgggctggggcctgagagtctgcatttcttttttttttttttttgagatggagtctcactctattgcccaggctggagtgtagtggtgcgatctcagctcactgcaatctctgcctcctggcttcaagcgagtctcctgcctcagcctcctgagtagtggggactacaggcgcacaccaccacacccagttaatttttgtatttttattagagacggggtttcaccatattggccaggatggcctcgatctcctgacttcatgatccacccccctcagcctcccaaagtgctgggattacaggcatgagccaccgtgcccagccaagaatctgcatttctaacaagtttccagatgatgttgctgctgtcagtccacaaatcacacttcgaatatcaagagctgaagcctcttttgcagtccttgcacatacacctacttgctattttctcgtccccttcattttcttcctactagtcatccttcaaagttttattacctgccgtttggcctgcaaagcacataggctgctactgaaccccacatcgcttcctattttaaaagagctttctaaagctttgggacttgaattagtcagcaaaggtctgcaattcctctccaaaggcaaggtaatcttattaagagaagatctgaagtatccttaggaacaaaatactcaatgtagcctctttgttctctaagtctccattctccagtgcctctctgtgcatttgtttgtctcagaacagtcatgcacggtggatccatttgtcttcccttatcactctgttactgctgccgagcactcgctcagctgtgtgctccagcttcttggctgacaagataattacattctgggcagactgggagaaagacaggtagtgctcaaaagttccgatgccgacaacctagtcattgctggggcagacttcaagatcaagcacctgatctaattagcacactcccatcactacctgcctgcctatggaatgctgacaatcgaaagcctgaaggcaaagcagatatcatgcaacccagagacagacattcatgctacccttgtgccaggaacaattacatgttctttttggaatcttgggtgtcctagtaacacagttgagcctgggggtaaacttttgcataatactggaagccctgcatttactgataatgaacgtgagaaccagcagaataaaaccccacaagaatgaaagacctcacgggaagaaagccttctgaagaaggactcatttcagcaaacccagtccgcccctagctctggaagaagcacatggctccataaaagcgaggttttgccagcaaagagctgtttttctttgaccagataaatagcacaatacattcccctaggattttttttttttttttttttttgcctctgtgcttttgctacttcctacatttctttcaaaatgtagcctttgagtttgaaagtcattacagccacaacgctttttctccttttctttttgctctgggtagaaaagtgctctataatctctaaatccttataataagtgttctataatctgtaagttcatatatagacataggcatgtgtatatatacagcattattatcttaaatttctaataagattcccaccctcacttgctgctggcatttgcactagtttctctggcagaggcctggtggagaagagtgaaccgtggctatacagtcaacacctatttctaccatgtattacatctgtgactgggcaaggtacttacctgtccagttaaaactaaggctttaggttaaagaaatcaaaagaaccctagtgcagtgttatggtttgaatcatgtccccctcttcctttaaaaaatatgttaaagatctaatgcccagtaccacagaatgtgaccttatttggaaacagggtcattgtggaaataataagttaacctaataggaggtcatactggagtaggacagacccttaattgaataccactggtgtccttatatgaagagacacagagacaccgccacttgagggagaacatcatgtgacaatggacgcagagactggagagctgcatctacaagccaaggagctccaaggattgctgccagaagctataaagaggtgggcatggagctcagacttccagcctccagaacagaacaatttctgttgttgcaagccacccagtttgtgggacttcggcaacccaaggaaatgaacatacccagtcaggcttactcattaacctcccttggaggtcaagaatgacatcacaagtcgaagatagccattgccaggcacctaacagaagtgatgtggttaagaaatctggctctagaaagagaatataaggaaagaggatatgagtgtatgggttcagccctactacttcctggctggatgacatcaggaaagttaactacactttctgagcctcaggatcatggccataaaacaggaataatgatggtacctaaataatagaacttctgtgaacaatgaaagggaacaactgtgaggtctaacggttagctctagctattcttttcctggtggtggtaggaggcaggttttgggtacctttagctttgtctaaactgagggttccctgagcccactaaccctgagtagataaaaagcaatgtggtccactcccccatgcattcctgccactatcccgaggctataacaaggtctcttcgagagccttgggtttcagaggatgcaggaggtgcttggggatgtcaagaggcttgtgaggacctctcaatcctgttgtaaggcccctgagttggcaactgcagctcctgaggaaggggagaggcatagaaagaggcagatgagattcctgtgagagccaaggagtctgctgggtctacacctcccttggctttgtcctcgggtagaggaatccatgaggagctgatgactccttgtggtcaaatacccaacagaactgagcccctttcagaattacctgcactttctgcaatttaagtggcatcttgattacccggaagcatccccttgatgacaacaatgatgaatccttctctatgcatttgtcttggaatagtcatacattctgttggcccatttctataggagtagaattgctagatcacagagtgtgcttatgttcagctttagtagatactgctaactagttttccaaaatagttgtaccaatttacacttctactacaagtgtatgagagcattgtcagttttgtaattttagccattctagtgaagtgagtgcacagtggcatctcattgtggttttaatgtatatttctctagagattcctgatgttgaacacttcacatacttatttgccacttgcatatccattttgattaagatgtcttcttcttgttgatatgtagaatcgtttagatattctggcaccatgtccttggttacatgcttgtactacagatattttcctcccactgagtgcctccttctcatactcttaaaggcatcttttgagaataaaattcttaatttttaaaaacaaatttttcaagcagttttaggttcacagcaaattgagtagagggtatagagagatttcccatatacctactctctccataaatgtatagccttccccattatcatcatctcccaccacggtagtacatgtgtcataaatgatgaacctacattgatacatcattatcacccaaagtccagagtttacattagggttcactcttggtgttgtacactttatgagttatgtacaattattatgtatccacctttgtagtatcgtacagagtagtttcactgctttaaaacttctctgtgttctgcctattcctccctctcttactggcccccaacctctggcaaccactcatctttttactggctccacagttttgccttttccagaatgccacatggtcaaaatactactgtattagtctgttctcacattgctatagagaactacctgggactgggtaatttataaagaaaagaggtttaattgactcagagttctgcaggctgtacaggaagcatggctgtggaggccttgagaaacttacagtcatggaagaacatgaaggaaaagcaggcgcggagaaggaggaagagagaaggggtttgtgctacatgcttttaaacaaccagatctcatgagacctcactcactatcacgaaaacagcaaggggaaacttcaccccatgatccattcacctccaaccaggccccttctccaacattggggattacaattcaacatgagatttgggcggagacccaaatccaaaccataccaactgccatatgtagccttttcagattggcttctttcacttaataatatgcatttaaactttctccgtcttctcatagcttgataactcatttctttctagctctgaatcatgtttcatttgatgaatgtaccacagcctttttttttttaaactattcacctactaaaggacatcttggttgcttctggcttttgccaattatgaataaagcaggtataaacatctatgtacacgtttttgtgtggacataagtgttcaactctttctttttatactttaagttctagggtacataagcacaaagtgcaggtttgatacataggtatacatgtgccatgttggtgtgctgcacccatcaactcatcatttacattaggtatttctcctaatgctatccctcccccagccccccaccccataacaggccctgctgtgtgatgttccccttcctgggtccaagagttctcattgttcaattcccacctatgagtgataacattcagtgtttggttttctgtccttgtgatagtttgctgagaatgatgggttccagcttcatccatgtccctaaaaaggacatgaactcatccttttttatggctgcatagtattccatggtgtatatgtgccacattttcttaatccagtctatcattgatggacatttggcttgggtccaagtctttgctattgtgaatagtgccacaataaacatacatgtgcatgtgtctttatagcagcatgatttctaatcctttgggtatatacccagtaatgggattgctaggtcaaatggcacttctagttctagatccttggggaatcaccacactgtcttccacaatggtttaactaatttacactcccaccaacggtgtaaaagtgttcatatttctccacatcctctccagcatctgttgtttcctgattttttaatgatcaccattctaattagtgtgagatggtatctcattgtggttttgatttgcatttctctgatggccagtgatgacgagcgatttttcatgtgtctgttggctgcataaatgtcttcttttgagaagtgtctgttcatatcctttgtccacttgttgatgggtttttttttcttgtaaatttgtttgagttctttgtagattctggatattagccctttgtcagatgagtaggttgcaaaaattttctcccattctgtaggttgcctattcactctgatggtagtttcttttactgtgcagaagctctttagtttaattagatcccatttgtcagttttggcttttgttgccattgcttttggtgttttagtcatgaagtccttgcccatgcctatgtcctgaatggtattgcctaggttttcttctagggtttttatggttttaggtttaatatttaagtctttaatctatcttgaattaatttttgtataaggtgtaaggaagggatccaatttcagctttctacatatggctagccagttttcccatcaccatttattaaatagggaatccttttcccattgcttgtttttgtcaggtttgtcaaagatcagatggttgtagatgtgtggtgttatttctgaggcctctgttcagttcccattggtctatatctctgttttggtaccagtaccatgctgctttggttactgtagccttgtagcatagtttgaagtcaggtagcgtgatctctccagctttgttctttttgcttaagattgtcttggcagtgcgggctcttttttgattccatatcaactttaaagtagttttttccaattctgtgaagaaagtcattggtagcttaatagggatggcattgaacttataaattaccttgggcagtatgaccattttcacaatattgattcttcctatctatgagcatggaatgttcttccatttgtttgtgtcctcttttatttcatttgtagtttgccttgaagaggtccttcacatcccttgtaaattgggttcctaggtattttatactctttgtagcaattgtgaatgggaggtcactcatgatttggccctctgtttgtctgttaatggtttataggaatgcttgtgatttttggacattgattttctatcctgagactttgctgaagttgcttatcagcttaaggagattttgggctgagatgatggggttttctagatatacaatcatgtcatctgcaaacagggaaactttgacttcctcttttcctaactgaataccctttatttctttctcctgcctgattgccctagccagatcttccaacactatgttgaacaggagtggtgagagagggcatccctgtcttgtgccagttttcaaagggaatgcttccagtttttgcccattcagtatgatatttgctgtgggtttgtcataaatagctcttattattttgagatacgttccatcaatacctagtttattgagagtttttagcatgaagggtgttgaattttgtcaaaggccttttctgcatctattgagataatcatgtggtttttgtcattgattctgtttatgtgatggattatgtttattgatttgcatatgttgaaccagccttgcatctcagggatgaagccaacttgatcatggtggataagcttttttgatgtgctgctggatttggtttgccagtattttattgaggattttcgcactgatgatcatcagagatattggtctaaaattctctttttttgttgtgtctctgccagcctttgctatcaggatgatgttggcctcataaaatgagttagggaggattccctctttttctattgattggaatagtttcagaaggagtggtaccagctcctccttgtatctctgttagaattcggctgtgaattcgtctgatcctggactttttttggttgatatgctattaattattgcctcaattttggagcctgttattgttctattcagagattcaacttcttcctggtttaggcttgggagggtgtatgtgtccaggaatttatccatttcttttagattttctagtttatttgcattgaggtatttatagtattctttgatggtagtttttatttctgtgggatcagtggtgatatcccgtttatcattttttgttgcatctattttattcttctctcttttcttctttattagtcttgctagtggtctatcaattttgttgatcttttcaaaaagccagctcctagattcatcgactttttgaagggttttttgtgtctcttatctctttcagttctgctctgatcttagttatttcttgtcttcttttagcttttgaatgtatttgctcttgattctctagttcttttaattgtgatgttagggtgttgattttagatctttcctgctttctcttgagggcttttagtgctataaatttccctctacacactgctttaaatgtgtcccagagattctggtatgttgtgtctttgttctcattggtttcaaagaacatctttatttctgccttcattttgttatgtacccagtagtcattcaggagcaagttgttcagtttccatgtagctgtgcagtttttagtgagtttcttaatcctgagttctaattttattgcactgtggtatgagagacagttcattgtgatttctgttcttttacatttgctgaggagtgctttacttccaattatgtggtcaattttaaaagaagtgcaatgtggtgctgagaagaatgtatattctcttgatttggggtggagagttctgtagacatctattaggtctgcttgttgcagagctgagttcaggtcctggatatccttgttaagcttctgccttgtttatctgtctaatgagagacagtgtctctcattattattatatgggtgtctaagtctctttgtaggtttctaaggacttgctttatgaatctgggtgctcctgtgttaggtgcatatatatttaggatagttagctcttcttgttgaattgatccctttaccattatgtaatggccttctttgtctcttttgatctttgttggtttaaagtctgttttatcagaaactaggattgcaacccctgcttttttttgctttccatttgctttgtagatcttcctccatccctttattttgagcctatatgcatctttgcacgtgaaatgtgtctcctgaatacacaccaatgggtcttgactccttatccaatttgccagtctgtgtcttttaattgggacatttagcccctttacatttaaagttaatattgttatttgtgaatttcatcctgtcattatgatgttcgctggttattttgtccgttaattgatgcagtttcttcatagcatcgatgtcctttacaatttggcaagtttttgcagtggctagtaccggttgtttctttccatgtttagttcttccttcaggagctcttgtaaggcaggcctggtggtgacaaaatctctcagcatttgcttgtctgtaaaggattttatttctccttcacttatgaagcttagtttggctggatatgaaattttgggttgaaaattcttttctttaaggatgttgaatattggcccccactctcttctggcttgtagggtttctgccgagagatctgttgttaatctgatgggcttccctttgtgggtaaactgacctttctctctggctgtccttaacactttttcattcatttcaactttggtgaatctgacaattatgtgtcttggggtttcccttctcgaggagtatctttgtagtgttctctgtatttcccgaatttgaatgttggcctaccttgctatgttggggaagttctcctggataatatcctgcagagtgttttccaacttggttccgttctccccatcactttcaggtacaccaatcagacatagatttggtcttttcacatacttccctatttcttggaggctttgttggtttctttttactcttttttctctaaccttgttttctcactttattttattaatttgatcttcaatcactgataccctttcttccacttgattgaacctgctattgaagcttgtgcatgcatcacgaagttcttgtgccatggttttcagctccatcaggtcatttaaggccttctctacactgtttattctggttagccatttgtccaatcttttttcaaggtttttagcttccttgcaaggggttcgaacatcctcatttaacttggagaagtctgctattaccgaccttctgaagcctacttctgtcaacttgtcaaagtgattctctgtccagctttgttccattgctggtgaggagctgcaattctttggaggagaagaggcactctgatttttagaattttcagcttttatgctctggtttctccccatctttgtgatttaatctacctttggtctttgatgttggtgtcctacagatggggttttggtgtagatgtcctttttgttatgttgatgctattcctttctgtttgttagttttccttctaacagtcatgtccctcagctgcaggtgtgttggagtttgctggagttccactccagaccctgtttgtctgggtatcaccagcagaggctgcagaacagcaaatattgctgtctcatccttcttctggaagctctgtcccagaggggcagccacctatatgaggtgtctgtcggcccctactgggaggtgtctcccagttaggctacatggggatcagggacccacttgaggaggcagtctgtctgttctcagagctcaaacgcagtgctgagagaaccactgctctcttcagagctgtcagacagggacgtttaagtctgcagaagttgtctgctgccttttgttcagctatgccctgcctacagtggtggagtctagaggcagcaggccctgttgagctgtggtgggctccacccaatttgagcttcctggctgctttgtttacctactaaagcctcagcaatggcagatgccccttccccagccaggctgctgtctcgcagatcgatctcagactgctgcactagcagtgagcaaggctccgtgggtgtgggagccacttagccaggtacgggagagaatcactttgtctgccagttgctaagaccttgggaaaagcacagtatttgtgtgtgaatgtcccgtttttccaggtagtctgtcacggcttcccttggctaggaaagggaaatccccctgaccctttgcacttcccgggtgacacaatgccccgccctgcttctgctcaccctctgtcagctgcaccctttgtccagccagtcccaatgagatgaagtaggtacctcagttgaaaatgcagaaatcacccatcttctgcgtcgatcatgctgggagctgcagatcggagctgttcctattcagccatcttggaagtgttcaactctttttggtaaattccaaagagtttgatcactggatcatatagtaagtgtttgttttgttttgcaagaaactaccacactgtcttttgtagtggctgcatcattttgcattcccaccagcaatgaatgagaattcctattgctccacatcctagtcagcatttggtgttgttagtgttctggatttgggccattctaatacatgcataaaggtatttcattgttgtttaatttgcctttacctgctgacatttaatgtggagcatcttttcatatgcctatttgccatctctgtatcttctttggtaatatgtctgttagggtctttggatcattttttaattgaaatgtttgttttcttgttaagagttctttgtatattttggtaatagtcttgtagtagatgtgtattttgcaaatattttcttccagtccatgacttgttttcttgttcttttgacatcatctttcacagagtagaagattttaattttaagtccagcttaccaattttttctttcatggattgtgcctttggtgttatatctaaaaagtcatcaacatactcaagataatctagatttttctaccattatctttttggagttttatggttttgcattttacatttaggtctgtgatcattttgagctaatgtttgtgaagggtgtaataatgtgtctagatttttttttcatgtgaatgtccagttgttcaagcaccgtttgttgaaaagactacccttgctccattgtgttgcctttgctcctttgtcaaggatcaattgactatatttatgtaggtctatttctgggctctctattctgttacatttgtctgactattcttttgtcaataccacactctttggattgcttcagctttatagtaagtctgaagtcagatagtgtcaatcctccaactttgttcatcttcagtgttgagttggctattctggatcatttgcctttccatagaaactttagaatcagtttgttcatatccacaaaataatttgatggcattttgattggcattgcattaaatctataaatgaaattattaattttaagtcttatttattaatcttttcctttatgggtagtgctttttctatcctacttaagatattcttgttaaccataaggctgtgaagataactcccctgacttctacagtgataaaagtcaaaatagttgttgtgcttttgtggggaggagtaatgactgggaggcaatacaagggaagatactagggagctggttatattctctttcttttctttcttctttctttctttcatttctttctttctttcttactttgtttctccttccttccttctttcctttcctttccttttctttcttttttttttttttttctgaggcaaggtctcactctgtcacccaggctggaatgcagtggctgcagccccaacctcccagactcaagcaatcctcccacctcagccttccagtggctgggactgcaggtgcacaccaacatgccaggctaatttctgtattttttgtaaggatggggtctcactatgttacctggctggtctcgaacccctggacttgagtgatatacccacctcagcctcccaaagtgttgggattacaggcatgagccactgagcctaccttatattctatttcttgatttttctgggtgatggtatttgcttgtttactctttaaatatttcttgaacggtatatttattactggcacactctgtatgttacgctgccattaaagttgataagaaagaaagaaagagagagaaacagggagagagagagagagaatgctagccgctggctaaagagatacaaagtaatgacaaaaaatacttagaaagatttgaagagaaatttgtgagcagattatatgacatcatatattctcagtctatgtaagccaatcttttagtatttactaaagatttcagtagaatacatatagtaagtctatttccagattagaaacattgatgttggttaataatataatattgaaaacaaacagtgctgtgagcataaaataaagtaacattagtgacacattagtgaggcttcataaagagagttaagcaagcagagagtctaaagagaagcagccggctgctctgagcatttggttttacaaattctttattaaaatgtgatagatttgatcattaaacatggtatatgtgtatcaaaatatcacactgtaccccataaatatgtgcagtttattatgcatccattaaaataataataaaagcaagaaaaaattgccgctagctgatatgtgaccactcgacttgtgacttctcaccctcaaatgaggggcatgcctcacatggtctatatcaaatgagggctactgagctctgaggtaggaggggtctctgagactatagtagaaatgtcacaagagtgggctataagggcccagtagagttactgtccaaagcagaaaccaaatcaaggtacccagcaaggatacagttaatacgaaacactgacccagcagacagccaggttctgaagagctaagcacacaggagatacagtcggagcaggaatgggggtaacatcaggagctgccccttctgcaggtcagaaagccaggatatcaccaaagccagagaggctctgcaaggtcctcaacaggagtctttttgaagagaaggccaaccaacagcctgtccacagttaaccaggcagcagttgtgtgaccgcatgttcctctgccctgagccaagcaggagtgcacacctgacagctggttctggcagccagacactgagaggcaccaaactgggggtccctctctgagaggagcccaggatgtgcaggtgggaatgcaggtgtttcctctgtatcacatctgcctgctaaatagctctctgtcggtttcttatgctttctcttccacaaagaggagaattccagggaacaaatgcagactgttggatatatacataatctttttggagatggggccgagtgaagagataaataggacttgaagaaggaagttaagaaaactaaggtaaccagaaagaatgagtgagaaaagcaacctcaggaactcctgggtggtatggtagggaggacagggaaaatccataattcggttaatctgcagatagataatagagaattcaagcccaagcataagagcttgcatttctaatcagctcatgcaacatcatgtttgcagtgttcaccatttctaatatccaagcaccatcttttagagtcacaaatgctataattcatcacatccaggcatgcaaaatcatcctttttctaacattaaacatgtttaattacaacgatttataatagtgcgttaagactttaatgaaaggaaggcatttgacacatgatatttacagtaatcataatactacaatatttaaagtataaattttgacagtgttagagcaggaagccaaattgtccatatttttagttaattatttgaaatgtttttgggggaactcagcatccagaaattaattaatagttttcctctgtgcaattgtcagtgttaaccactggttactgctactggctgccaacgcttttatatcgtcactctagtggaagtcagcgattaatggtaaccacttgtcctaatagccaaatgccaaatgtcataccacatgcaggattatagttatgttttaggaagtggatgggtttggctttgttagccaagaattaaccacaaatttggaggccacttgaactagtgcttgcagaatatatctgtgacacctcagtcctggggttctcaggatgtttttcaaggatagcagtttcataaaaagctaagagccttgaaatccttttcctaagagaccaaaacttttctttgtcaagcgcgaaaggttccctctgccgtctcttctgggatcagtcaaatttacacacgttccagcttcacttaagtggaattcaagttcctgtgtaggtattcgctgttaaccacatgtcacatgcttcacagccctttgtgacatatgtttatttgaaaaggtaagtccgtaaaccagtgccttccttgtattttacaagtttcccctgactcagggaaacaaaagggggtcctccatcatcaggcagcaatgtgggacacaaagtaaggtaaggactgttacctggattactgcccacagccccctcaataataaaacagtgtcaaggcagagcagcatctcacactgttaagagttcagattttaccaggctcagtggctcacacctgtaatcccaacactttggaaggctgaggtgagagtgttgcttcagcctaggagtttgagctacagtgtgctatgatcaggccactgcactccagcctgggcaacagagtgagaccttgtctctaaaaataaaaattaacaacaacaacaaaaataattagatttctactgacttcaaacttcaacacaatcgtgaccactgaaataagaggaacattagaaaccctcaaatcaaaaccaaaacccatttttccacacaggtgtagaaagcttggactcacccagggacccacttctagcaagtgcccggggcaccctgcatgcattctgtgttctaacattgccctagcttcatttgttcctctccttggttctctttgtcctaatttattttcttagtatcactattataattaatgataattatccattctaatatagttttgtgcattttctaaaacatttaaatcttctttaaataagatagaatatcattatgtttgaactatatgagatgccttaaatcctttactcaaagcttacttactcttttctacatacaattttaataaattcagccatctaatttcgtagcacacagcaactcagaagaccacagctgaaagaaagagtggttgttgacatagtacagtatagaaaacctacttagtagatgtcaaatgcaatagtaaatagataaatgagtaaattagtaggtgagtaataccttagagctcaccaaggagaaggtagaaatcatttaaaaacacatataagaagcaacaatgtaacagtcagagcacacttggtatgggtgtgacctctccggagatttcaaaagcctttgatgattacagaaccatagtttatttaatttattattatgatttttttttagacagggtctcactttgtcacccaggctggagtgcagtggcaacctatcagctcactgcagcctcaacctcctgggcttaagcgatcctcctgcctcagcctccaagtagctgggactacaggcgtgccaccacaccaagctactttttgtatttttagtagagacggggtttcaccatgttggccaggctggtctcgaactcctgagcccaaatgatctgcctgccttgacctctcaaagtgctgggattacagatgtgagccagcattcctggcaaaactgtagttaatattgataagtataactctattccttcaagcaaaggccaaagtattttggggaatctttgtttaagaagacaggtatgtctatcacacaccttgtaaaacttttcatttgaaaacaacaaaatttaaaacataaaactccagggtggggaaatgtccagctgtctggaaaattcccttctttgccgtgcctcattccctggccatgcccgatgcctggagtgatgatgaactcatattgctagttctcaggtgggaatgatgcctcaggaaaaaacactgtgggtaaagaatgctttctgcactagcttctgactcactccacggtgatgtggtgggagcaattccaaccaaccccagcacggtgctagcatcctgaaagggagctcattaccaggaggaagggagagctcagtgcaagcatccaataattcactctctttctccaccaagcggttactccttaaggcctctaaactgaatgacttacagagcgacctgattcccctcattgcccatgtgcaccaaaccttggtttctgcaacgttacaaaaagagaagttcctgggtgtgtgctgagaacattttggacaaaggatgcttcacgaatggaagatgttatataaatgctactattatttgagacttgactcttctggagacaaaaatcacagccttagaccatggcaaccacagaccctagatttccccagtgctgactctgtccagtccattttccacttgagcacaggaagcagcacaaagtaaaggctacagtttcaggagaaaagcaggtttgttatcacgaacctgttttccctggccagttaaatagaggcaatcatagccagcaggctcaaacccacacttttctcaattaccatgaggaaacaaagattgacttactctttttctgtttacagaattacgcaaaacttattcctggagctacagtaggtctacttcagaaggactccggaaacattctccagctgatcatctcagcttatgaagtaggatattttacagctggcttcttttttgcatttctttggtattcaaaaactaagatgtgatttaggcagttaaatgttagttacttgttggtagagagagtgcttatccaaaaaaagtctctgcatgaatgcagccaaaatataaattttgttcattttgcttgctgatcttcttcctggaaggtggagctgaagatagaaaaatcataaaactgatcataaagtcgaggttgtttttataataataagcaacagtaacattgttgccgcaaaattttaaaggctccacgagtcatacaattaagctctcctccatctgaaaaaaaatgaagtttaaattgccagtgagtgacagagttatgtagagagctaactctacaggcttgacgatactaggtcataactcaagcaaaaatacaagtgttggctatccaccaaaacaccagtacacaaggaatgccactttttaatttctatactttggagaactagggacattttccactggtttatgagtaggtgtgtaaatttttgcttttgactttgggaattagtacctgaggacagaattcctcccttaaaattagaatatatacctacggtgttgttatgttctcattctttgtctccatttcataactccattagtcaacaatggatggcccattgtcaattatttttaattttggttcctaaatatcaccccccctttttttttgcctttacttacaaagaaatacacacacagagagagaaagaagaagccctaaattaggataggaatgaaaaaaagtaaattttttagtaaggagtaaagctctactatttactgtaaacagcaactatgtaagaacaagtgaataacaattctcctgatttttgatgttttaaaattacaaaaaaaaaggcccatctgtaatatacgccaacatttagcatgtactgaaccagcattccttaactaaaacgacgtatcagaatcaacacggaaagtttttaaaaataggcctatcctctcacagacgtctttgaaggacttcaggggaaatgagagctacatattttggaaagaaaaaaaattccccaataattttgacgttgccccaccaattttgaaactcccctgaaggaagaaaagcaagatattccctctcaagtacttcatttcttcagaaaataaaatacagatgtgtccattaaaattataagatgatggttttgttttgttttgtttgttttactgatagcctcagaaatttcagttttcttagatcacatcaaattcatcaccacattagctcatgcttgaaattcttccagtcaggaatgctcatcaacaaaacgctataaaaaccttcctccctctcatgcagtaattaaagttttaatgtgtagaatcaaataaaatcacacagcaatccttcactgtatcagaatgcacgccattttttcgaatccaatactctcaacagtgttggccactaacatcatcggagaaactaagcagattagaaaacactaaattgtcaaaaatatttccccctccagtaagagcagccgccatgcctctgcttgctctgccagaggttatggctcactttaagatcccaaatacttcacgcaacttacagggtagttgaaatcaaggcattaaacatttgaattaaatcttctgtccttgttttactatctcagaaatactaagaagtgtctattattcttaaatgaaacaatcttgcactggagttattattggagctttatgattcacagggcaaagtctgtaatagatcctggcactagttcaaattatttttctactgttatttttaaatgtatgctaaaaagaatttaaaatatgggaacacatagactgaatttctttctagtctataaaaagagagagaaggaaagagaatatattgagagaaaacataaaatgcttctgactgacctctagtagggcagaggtagacaatttgtgtttataactttgtggctacaaacttcagctcagtattttacagtgccgtattgatattttaaaaaaaccttaaataccgatgtgtacttatctgatcatcattcactaattttctttcttccccgatcgtataataaaagctaccgaaatatcagcaatcccaaggataagttcctctgtttgtgtttaaattccaggagggaattgacttggtttcttttgtttttcctggttcataagagatgctcaaaaaatgaatgaatgaaactatgaaaaatacaaataagtgtttatgtcctttccttgggaaattcacactaaaatattcctggtcaaatttgcaatatgctgttaaattatagcaatgctgaaatttcctttatttaggtcagatcatgtcatccactagtcctcataattgctgtcacagtcttctagctcatatcccttaatttttatttagctcctgactctatctccaacattgcttctattttaatcttattatttcagtataaacagattttggaggaaggcagggtcattttactatacatttggcaaacttacacataaagtatcaaagcatctcatttctccataaatatatacacctactatatacccacacaaattaaaaataaaacaaatttttaaaaaattacacttaagggaaatttgaagccgaatatgctttttaaatgccaacaagaaaatggatatgtggacttaaaacttttggattaactgaagtgtaaattaattcataatatttttaaattggttttattctgtttttctatttttcataatttggtttggttcacctacaatacagactttcattttataagtgaacaaggaatagagaaagcaaaatgataaacttcttgaggaaagaaagcattcttatagtattccccagacctaactctacactaaatacattccaatattgattttaaggcacactttccccctacattttaacatctctaaaattgagctccatcttactgttggtggtgagttactatcaccattgtggtgccaggcagcagtcatgatgtagttttcatggactattgtgattgtactcacttcaattcattagaggcattgttgctacataaatattaagtttaattgctgttttaaaatatattttaaaatgtgtactgtgatttgatattgagatgaaaagtttattatgtatgcagaaatgtaccaaaacagagcagcagggtgtaaatttgttatcaatgaagcaaatattcattggtggaggaatgacttcaattgtggattctttgcaaagcaacaaacagctgatttatgggagctaagaaatcatgatacacataaaggaagctgttgtttaattttgttactgagatataagcaaaagaattgccttttatatgccaatctatgcaactcagggcaggagaatttgccaaatccttcagaatggataaaatgattttcaaagcaatgatagatggataggactgattcatatggtgtgcagaaccatcttgaggtattttgtcatagtttaattgtcgtaagataatggtgtatcttataatgttggcaccttagatttgataatatataaaatgtatatatgattgctcactttcttgcttttgattgatgatatactgaatttctttagacacccaatttagttttatttatttgtagttcaatgaacatgattcacggtttcttcttctggctatatttttggggttgtgacttcactgaactctttatgttgtaactaaaggaactgcggtctgaggtggaactggaagtattaggagacactgaaggactcaacttgtcatttacagccatctgtaacaacggtaccctcttccaacaccaaaagaaatgctctcacatgaaagtgggagacacagtaagtagctggccagtagatagtctgaataaatacctggatgggtcagaaattagctgagctcactgaagctggatttctttcaagaattttaaaagcaattttcaaagattttctagtaaatgcttttggcaaagctgatttccgtgaagccttgtttcacctcgtgcattttggtggatggagggagataattagtattttcttttccaggcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaggctatgttgaaatccatcttaccctgtggctgctcaagtatcagcaaggggcttggcatcctctgcaccttccagtttcctgggcacagtaggtgctcaataaatatttgctgatcagccttagacctagggtaactgaatcttctcttgtaggttttctggctctaacattcacttggggtgagatttctgccaactgaacttatgtctattattgtttccctaagcgtagatgaaagatacaagtgccttctctctggttgacacccagactctacaaaagtgcctgttatatgaactccattaccttccaggtttttctggaccaagcagctgtgtctgactgaccttttctttttttttttctttttttttttatttatactttaagttttagggtacatgtgcacaatgtgcaggtttgttacgtatatatacatgtgccatgttggtgtgctgcacccattaactcatcatttaacattaggtatatctcctaatgctatccctcccccttccccccaccccacaacaggccccagtgtgtgatgttccccttcctgtgtccatgtgttctcattgttcaattccaacctatgagtgagaacatgtggtgtttggttttttgtccttgtgatagtttgctgagaatgatggtttccagcttcatccatgtccctacaaatgacatgaactcatcattttttaaggctgcatagtattccatggcgtatatgtgccacattttcttaatccaatctatcattgttggacatttgggttggttccaagtctttgctattgtgaatagtgccgcaataaacatacgtgtgcatgtgtctttatagcagcatggtttctaatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcattttttcatgtgtcttttggctgcataaatgtcttcttttgagaagtgtctgttcatatcctttgtccacttgttgatggggttgtttttttcttgtaaatttgtttgagttctttgtagattctggatgttagccctttgtcagatgagtagattgcaaaaattttctcccattctgtaggttgcctgttcactctgatggtagtttcttttactgtgcagaagctctttagtttaattagatcccatttgtcagttttggcttttgttgccattgcttttggtgttttagacatgaagtccttgctcatgcctatgtcccgaatggcattgcctaggttttcttctagagtttttattgttttaggtctaatatttaaatctttaatccatcttgaattaattttagtataaggtgtaaggaagggatccagtttcagctttctacatatggctagccagttttcccatcaccatttattaaatagggaatcctttccccattgcttgtttttctcaggtttgtcaaagatcagatagttgtagatatgtggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgtgggctcttttttggttccatatgaactataaagtagttttttccagttctgtgaagaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggattcctaggcattttattctctttgaagcaattgtgaatgggagttcactcgcgatttggctctgtttgtctgttattagtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttctttctcctgcctgattgccctgaccagaacttccaacactatgttgaacaggagtggtgagagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcaggaagtgctgttgaattttgtcaaaggccttttctgcatctattgagataatgatgtggttttgccattggttctgtttatatgctagattacgtttattgatttgtgtatgttgaatcagccttgcatcccagggatgaagcccacttgatcatggtgggtaagctttttgatgtgcagctggattcggtttgccagtattttattgaggatttttgcaccgatgttcatcagggatattcgtctaaaattctcttttttagttgtgtctctgccaggctttggtatcaggatgatgctggcctcataaaatgagttagggaggattccccctttttctattgattggaatagtttcagaaggaatggtaccagctcctccttgtacctctggtagaatttggctgtgaatccatctggtcctggactgtttttggttggtaagctattaattattgcctcaatttcagagcctgttattggtctattcagagattcaacttcttcctggtttagtcttgggagagtgtatgtgtcgaggaatttatccatttcttccagattttctagtttatttgcatagaggtgtttatagtattctctgatggtagtttttatttctgtgggatcagtggtgatatcccgtttatcattttttgttgcatctatttgattcttctctcttttcttctttattagtcttgctagtggtctatcaattttgttgatcttttcaaaaaaccagctcctggattcattgattttttgaagggttttatgtgtctctgtttccttcagttctgctctgatcttagttatttcttgccttctgctagttttgagtgtgtttgctcatgcttctctagttcttttaattgtgatgttagggtgtcagttttagatctttcctgctttctcttgtggtcatttagtgtgataaatttccctctacacactgctttgaatgtgtcccagagattctggtatgttgtgtctttgttctcgttggtttcaaagaacacctttatgtctgccttcattttgttatgtacgcagtagtcattcagttgcaggttgttcaggttccatgtagttgagcagtttcgagtgagtttcgtaatcctgagttctagtttgattgcactgtggtctgagagacagtttgttataatttctgttcttttacatttgctgaggagtgctttacttcccactatgtggtcaattttggaataggtgtggtgtggtgctgaaaagaatgtatattctgttgatttggggtggagagttctgtagatgtctattaggtctgcttggtgcagagctgagttcaattcctggatatccttgctaactttctgtctcatctgtctaatgttgacagtggggtgttaaagtctcccattattattgtgtgggagtctaagtctctttgtaggtctctaaggactttctttatgaatctaggtgctcctgtactgggtgcgtataaatttaggatagttagctcttcttgttgaattgatccctttaccattatgtaatggccttttctcttttgatctttgtttgtttaaagtctgttttatcagagactaggattgcaacccctgcctttttttgttttccgtttgctttgtagatcttcctccatccctttattttgagcctatgtgtgtctttgcagtgagatgggtttcctgaatacagcacactgatgggtcttgactctttatccaatttgccactgactgaccttttaaatgtatatgactttggaaaagtaaaaactaggtagactgctaaataagcatgctaccaaggataaggagcacaaaaatatattaaatgggctttcagggccttcactcattccacaaatatttattaaacacctactatatgacacatactaggttaggcactgagcataagaaagatgagtaactgcatgtgtgaaaaagcctacaggaaagacaaagatggaaaattactcggaatatcttgagaaatttgagaaaaatttaaagtagaaatatgtatgttttaatatcctacatagatgtaaaatcgctatagtttaacgatatattgtatatgactattgtaaaatcattcttttatatatatatgcacacatatataagtgtaatctattcagaaaagaattataaatatgttcatatactcttaaacagtataaatttgtcttatagattgaaatattaactgaatgctgaatttaagcttcaatatctctgttcttcacactatgtaagcagacagctattcaaatcagaaagccattatctttatagaaaactaagcaagttatgtttttaaaagacagcgttaggaacatataaaaaagactaattttgggggaaataaaagacctgaaagaaagaagcatcaaagaaatccaagctttctgaaaaccatttgatacccttagaagtgtacctacctttcatttctttgctgctgctgttgcagccaataagttcttctgagaatatatgccttttttccctccagagagtgaaaaatttatggtctgttctgatcgagacacatttctctcccttttcatttaaaggtttatttcctggtttaataggtgtgtttccaaacccacatcagtcctcttttcacatgatgcagatggggcacaatctgaaggtgacaagaagccagccaaaggccgtcaccacatcacagagaggatatattgggcagaatcccatattgcatgtctaataggaatcttgtaataaaatacatgttcaaaacacttgaaattacctttcaaaaagccctaagtgtaatctaacaaaatataatagagatactaacacgacctatatttcaccctttaaatcttggatcaaagagatctaaggcagtataaaatgctgaactctgtttagcaacagagctttgcttgatggtctttcgctttattttttaccatgcatgaggaacagaaataaactaaaaaagacttgatctgtggattgtagctaggaagttctgacaacagtgcgtctcttttgaatcaggtacagtgattgctacagaaattctatttagaaaatacgatttatttagctagactcagaaaacttcaccaatgccgatttccttcaaccattactgtttctcaaaagctattttggtttttagtaacatcacaaaggatgttgctctataattagtaacttttctttcaaatggtataatgaaagtaaatgcatttataacaaatggttaacaaatggtcatggagtacctactatgtgcctggcattgtgcttagtgcagggacaaaaattgtgcctggcattggaatagacactctgctgctgctgttgttttatttgcaacagaggatcaaacatgctacagctcacaacttgtgtggatctccagtttgtaactaatatactaagcaatgtgccacttttctgaagagctattatcgcaatgttctttttcatacagcttctttcatccatctgtaagcactcaaagatacagagctccattgattttttccttgcccaaattccattagtctcctgtattttgattctaagagatggaaactatcaggcaaatgatattagagaaacacttcctgccattatgcacttacagttattgtcaatggcattccagaaagatctatccctctgaaatagcatggtaattttttcttgatctttggttatcatcttgtccctccatgaaaccaatatgaaagttttgttgttgttgttgttgttattgtatgaaccagtactctagataactggttgtttgaggatatcaattagcaactttggaaaccaggtcagtggctctggaaggccaggagagaggagggcttctaaattctgagaggagctccgtgtttttgccatgatggtccttttctactgctccaggaaggattttctaaatttctgccaagtacttcctacatgcaataatatacttgagcattctcaaagcatttggaaatgcatctttcatttaataatatttgtaaatcatattaattttccagaatcaactgtaatatggaatttctttctatcataagtttccccttttgttgaggaagaaacaaaaagatattgtagtttagaagatcatttacatgtaaaaatgaaattaatggctttggcccaaatcatttaattattcttttctttgaattaattatgtcaattataaattgtataggttatgaaacacagttgaaatatatcttaatatcatgaatccaggtaaatttcaactcatctttcattagacaaataatgcacacaaacacacactttaagatggtgtgaaactcatataaatttagtgtgttgctcgacttacagtaatgttatgtctggataaatccattattttacattttacaatgagtttatccagacataatcctatcataagtccagaagcatctatacatacgtgtgtgtatgtgtatatatagagtatatagagaatatatatagagagagaatatatatgtatatacatataatcatccaccacataatgacgattttgtcaacaacacagtacatatacaacagttgtcccataattttataatactgtatttttactgtaccttttctatgtctagatacacaaatgctcaccgtggtgttacaattgcctccagtacccagcacagtaacatattgtataggtttgtagcctaggagcaataggctataccatataacctaggtgtgcagcaggtttaccatctaagtttgtgtacgtatactctatggtgtttatacaatgatgaaatcacctaatgatgcatttctcggtacatattcccattgttaaaagacacatgactgtgtgtgtgtgtatacacacatatacatatatatatacacacacacatatatatatacatatatgcacacacatacctgcagaaatcagaatccaatttcaaaatctttgtgtctatcatctttgtttggtgatttttgaccaaagaattaagcccaggactctcctactccaatttccttagagcccagtcatcaagatagaaaagtaagccacttactagaccaaagtttacaagagaaagtccagaattcttccttctacagtgaacttggcagtgtctcctgcaagtagaatcctgtttcacttgtgatttttttctacatctactttgttttcagtaaaagtataggaattttaatattgatagataattttgtttacaaattcttcctactggatagttttcagaaataatggcagtaactaacacttgtatagtgcttatttatgggccaggtaccgttctaaacactgttatatactgtcttaggtaatcctaaattttgctggaagagcaaaacttgggaggcaaaatgcctaatgcacatttcttttttttttttttttttgaagaaaagtatcagttacgagagtttgcaaataaatgttatttgtttgaaacatccaacacctatgttagtgtcttgcgcatggcaggcacccagaataatattatggaaatgacacagaagcccattattttaaacacttttaaaatcatttttgaagtatttcatacgtcattaagtggccatatcaaaggggctctttaggattagatgggctacttgtctacagcaaaagtgtccaggtgcctccctctttaacagtgtctgcctcaggcctctgcaatatcacttctgttcccttcctacctctcagtctcttctataaggatccttttttctgatcacattttaagtcctgaagctctccagagtttttctcactctacctgcttgccctagatgacctgatccatgacagcttcaagtaccacctttccctaacggatcccaaaccccaaacttcaggcccatatatatattcagcctcctactaggatgtcccacaggccccttgagctcctcagggccaaaagtgaactcatcatcttccccacccaaagctgcttctcctcctctgtttcaataatcaggtcctactctgtgccaggcattggtgacacggcagtgaccatgagctagcttccattccagttcagtgaaaagccacatcatccatctggctgctcagtctagtcacctgggggagaattccatccctctgtctcttccctcaaccctccgcctggcaccaatcgcacccacaccctgagcattccattcccgaatatatattctttccttgctgctcccatgggcaccgccttggttcatggtctcatatcttcttgcctctactcctgatttttctgtctgtagcttgaccctgtctactgatgctaaaaaatgtctagacaaaactttcaggatagaagctcttccttcagccaataaggcttttcatggtctgatttctgactttttgttatcctttccatttccccacctgccacactccatatgcaactttggctgtatccataggaaagttctatgggtattaagcaggtcacatgattccacatgtattcctgaaatgcatagaacctttttttttttttgtattgtctacccgtatctttcaaatttagctcaagcattacttcctttggaaaccctcaaatctccagtttaatttggaaactattcccctatgtatatttattagtagtagtattcattagcctgcctcctatactaaattataagttcaatgaccttgtcttatttaattttatatcctcatacctaatacaatctttggcacatagtatatgctcaattaaagtgtgttaagtagtgaattttttgagcactcagtgtatgcttatgggacatctaactggtgaatgtaaaattaggagatatatacattatgtcatccagtcacaagcattggaagtagactttattccctctgttttatagatgaggctctcatgatcacacagcttgagtgatatagaggggtgggctttaatccaggtctgtcttgcatcattatcatatggcatcttaactaaaagcaaaatataaaaataactaaataaatatgcacagagacacacattcacatcaaatatcttttacgtgctttctggattatctcatttggtctgattacaaattctatttcatataatatgtggatgaaaagagccaaactctgtaaaatattcgaagagatttattctgagccaaatatgagtgaccatggcccgtgacacagccccaggagatcctgagaacctgtgcctaaggcagtcaggccacagcttggttttatgcattttagggagacataagacatcaatcaatacatgtaagatgcacattggttctgttcagaaaggtgtgacaactcaaaggggatgggcaggactttcaggtcatagtggttggtgattggttgaaagagtctatctaaagacctggaatcaatagaagggagtacctgtgttaagataaggggttgtggagaacagggttcttattatgcagatgaagcgtccaggtagcaggcttcagagagaacagattgcaaatgtttcctagaagacttaaaaaaggttccagattcttagttaatgctctcttggatcaggaagaagatctggaaagaaaaggggattctctgcagaatgtagatattccccacaagagacagcttggtcaagccatttcaaaatatatcaaagaaatatattttggggtaaaatactttactttcaggacctgctatctatcatgttggtatcttattgctacaaagagtctgctttgtcagtcttaaggtttctgtcttcttgttaatgttggtcagctgtgcctgaattccaaagggagaagggtatataataaggcatgtcggaccacccactctcatcacggcctggactagtgtttcaggtttagtttagaatgcccttggctgagaggaggggtccattcagttggctgagaggcttatatttttatttatggtttacaaacataaagtaagcaagtggatcttcagttaggagaccagatctaagtatgcacaattagcaagacacatttgatacaatatatctacactcatactgcacccctcacacacatactttttttctcatttttttcttgtcttttgatgacggtgcttaaagacaaagagaaaagatgcccctcaccccctcaaatctgcaagtgttttggggctgtgagaagcatagagcattttgtgttacaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggtaatgtctctgcttttctccattccttatgtggataggtttatagtgatcaaacttacagtggcattttgtaaactcagacctcagattgtatttgctggtttggtctccaaacatccatcaaaacacacacaaacccacagggcctctgtgatcttcagcctggaacatcaatctctcgcttacctctttctcagtcctgattatccagaatcacaatgtcacgtttctgctagagactagtgtggggaagtagagctgatgtcccacactgataacatcagatcgcctctccattacaataccagccacacagaaggaatgccctggaggtagacggatgacacccacatgcagtcagtagcttttcaggggaaacagacaagcttctttcttatctagaagtttatagcctgaccttactgattcattcctatctataggctcacagaggcaaaaaggcagaaagacgatcttagctttcaattctctcctgcttctttaccacccatgctctttggcgcctttctttggttgccattatacacagctattgtgtattgtgttttatatcatatgcacaataacaacaatgaaacctcacaatttcttaatgaaattggggccacatttgtaggtcaagtgaagcgagcctccaaagtggctcttatgatattgcagtggataatgtattatgcagcaaatatgcttcagcatttcagattttcatgaactctgatgcccaaaatggtgacatttgcatttctgacataaacagagtgagaaaagcaatttttcactcagtggttactcaccattcaggtgtcaaaacttctctgccactgtcactggcaaactaagacaagacgcatgccaggagaagcatgaggacatgattaggatgatttgaataggatctaatggaaaatgtcccttcaaggtgtttcttctattacttttctgttttatcttctctataaatatgattcaatcttaaatctgaatttcaagataggaaattaacaatcaaagccatttgaatttggggaatcaggtagtgacctccttgggatttatgttagttttgagatgagtccatttttccatttattcatgcatgtattcatttatcaatgaggtattaagtgcctactatatgccaagaatcatgttatgccatgggcaaagcaatgatgactgaaacagctacagcctctgccttcacaggtgctggagtctagtgggaaagatagacatcttttaaagtcattgcaatgctgtctaggctgacagttttaataggggaaatagagagtgctatggaactctacagcaggggataaggctaccagactagctagggcagccatcattgagatgcacaaagacaaagagatattaagagcttccacaatcaccagaccccttcaaaaccactccaaataaatatacaatctagaaaaatgcaatgtatttgcaatgccaaggcaacttcacagtaaaaccttccccactgcctgataggttgcccttcctgtggaaaaatcctgaggcttccactgcaaaggaactgattggtctaaggtttagtgaaggtttgcctaaggaagtgcagtctcagctgagatttgctgagttatgggtgcgggtggggtgtttcaagcacttagcagagcatacatttccatggccagaggagacagagacagcatgtgtgtccacagtaagaaaacttttgcagtttttgaattacaacaagcacaatctatttgtaaagtgattttcagcacaagattaattcagggtctaaattttactttgctctatagatgtctttagagtaccttaattcttggatgatgttcttggaaatgtacttttctataaatagtgatcttttatttaaaagcctgtattaatgaggatccatgctctaatccacagcttttgagatccaggctctaatccacaccttcattaagacttagacttattcaaaagagttacagaaaagtgaattgtgaaaataatcatataagacatatacaaagtccactaatcattcttggaattctggttaaggtatagaccatttctgtcaagaaattcaaaacttctcccagtctctaatcatattttaggaacatacgctctctgtaggaaaaagtaaatgaaaacagctaaatcaatttattttctttgattatttgtttgtttacttaaccaatcaggagcaatcattacaggtaaatgaaaatagtagctattatcaagactggcccagggaacattgattactgagtggaactcagaataattcagtgttcacttggacattaccctactatccttttgaaagtaacaaaagataatgacatctatgacatactcctatagcacaaattgcaacaacagcagtaaagcaatattcaagctgcaaatctattttccaccagcatgaactgatacactgttggatactgtccacaggagctgcattgagtgccacctgtcagcagctggccaagcccgagaagaatgtgtggacaagtgcaaactagctggtgcgaccatcagtgaagaagaaggttctgcttgtcttaaattgtttttcatttccttatgtagttcttgagaggcgtagttcttgaccctctgtgaatcgagggctatttagtagcttgaccttatttgtaccagggcattagctcactcacattcattttttaagagtaaatgcatcctataagactagaaacttgatgtctcaggacactagcatttcaaagtcatagctattctatttgacttcagctctgttgccaagttcacctctgcttaacaaattcaactgtagagaattccagaatgctatatttttcaaactagaaatggagaaaaattgaagaaatggctaaatgttaacccccaaacctgaattcaccctttatcatccaattgctttatttcaagataagataaagccaactgtaaaacagtgttccagatggtggctccaagatactgggtggtttctggttagtggccatttttcctctcctccatatacttttattcccaaccttccaaacatgggcattacaatgaccatcctcaattccctgttgcctcacccccaaaatacaagaaagacctattctctttaacggctaagcaaacttctcttgctttcatctgtcattttaaatttaattacttagaatcagagtctagtggcaaagtttcacctcaaatatttaaatagcttgttttttaactggcaataccttttaaacaataatttgtggactttaaaacaaagatgatgactgactcttccaacagagacaacctgggagaatttaatttggtatcatcctgaactcgctgcattatcatgcagctcagggtagaattgctactctgcacacattagagatgtggccaagatgtagctcaggtgaagtgaaataattaagccaataatgtatgaccctccaggatgtgtctcttgaatagatggaattagaatacggaaattaatccatttccagcatggattgagttaatgaactttatattgttttgaagactacttacattgtctgaaaatttagagttctaactatgcacaattggattaccctatatggagggtcatgatatgtgctcataaaacccctcaccaatgcttttcttgtgaccaaagataaacatgccaaatagcagtaaattggacaaaatggtgtgcgccttacattactaccaaagacgagatacatgaaagcactgagcaggcagcctctgtggacttcccacattagtacctggtgcaaagtcctagcatcaccttctgggctcatttcacagcaagcactggggatagttaccaagtgtttctgagaaacgcgtaaaaattgcagaaaatgctctgcaaattgctaagcctcaattcactagcaacatgggaaatctaatgtgttgaggaaaaaaaggagtaaaccttacatacatgcaaatcataatggcatgaacaaggtacttactatatttaagtacacaggtttttttgagtagattatcataaatgctgagattggagaggaagactagggctccagtggcatttaaaatacttacattattctttttgtgtatttgactaaattatttcaaaatagggagatacaattatttgtaactcagcaattgaaaataaaaattggattactaataccatttaaagcactaatctggatgaatttgagagaaaaaaatgtttttaattcagactgtgtttaaaagccacttttctaatgagcctttttataagctttatttcaagttactcatccagttatgttactgatcatactaccttgaaatgatcgcataatatttgtcttttaacaacctacccttcccccaacaagaggaattttattttactcctggggagtattttactccccaggagtaaaaaaaaaaagcataactttataatctgtatgaattgttcctcagttatgctgtgagtgggcatatcaaaaacatgttattaaccttattcatcccattttactgagagtctttttttttttctttttttttgagacaaggccttaccctgtctccccggctggagtgtagtggcgtgatcaaggctcactgcattctagaccttccaggctcagcctcatgagtacctgggactacaggcacatgccaccctacacagtgtaattttttgtagtttttgtagaaatggggttttgccatgttggccaggctggcctcgaactctgagctcaaggcatctgcccgcctcagcctcccaaattgctgggattacaggcatgcaccacagtgcccagcttgagagtcatatttttatttaccttaacatacatgtactcagagaattgtttctcaaagtatattccatgtaaccctagatatgaaaacattacatagaaaaaggcgcccctggtaatgtaaatcttagaaataggaaactaggtttcttgttttctttgcaggacttctgagagttgttatacatttaaattaaatgtgcattgtgaatcatcaggaatggcaaggggaggaattggaataaatagaggattcccaaacttatctgaccataaaccccttacttttttccttgggaaacattgttgtttgtttgttttcgtttttgtttttttgaaaactgctaactaatcctagagctgaggtcttaaacatatggccatcttgactcagtggtgcagatgctttgtatttttctttttcttttttttaaattttattatcattatactttaagttttagggtacatgtgcacaatgtgcaggtttgttacatatgtatacatgtgccatgctggtgcgctgcacccattaacgcgtcatctagcattaggtatatctcccaatgctatcccttccccctcccccgacccccccacagtccccagagtgtgatattccccttcctgtgtccaagtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtaaatagtgccacaataaacatacgtgtgcatgtgtctttatagcaacatggtttctaatcctttgggtatatatccagtaatgggatggctgggtcaaatagtatttctagttctagatccctgaggaatcgccacactgacttccacaatggttgaactagtttacagtcccaccaacagtgtaaaagtgttcctatttctccacatcctctctagcacctgttgtttcctgactttttaatgattgccattctaactggtgtgagatggtatctcattgtggttttgatttgcatttctctgatggcccgtgatgatgagcattttttcatgtgtcttttggctgcataaatgtcttcttttgacaagtgtctgttcatatccttggcccactttttgatggggttgtttgtttttttcttgtaaatttgtttgagttcattgtagattctggatattagccctttgtcagatgagtaggttgcgaaaattttctcccattctgtaggttgcctgttcattctgatggtggtttcttttgctgtgcagaagctctttagtttaattagatcccatttgttaattttgacttttgttgccattgcttttggtgttttagacatgaagtccttgcccatgcctatgtcctgaatggtattgcctaggtttttcttctagagtttttatggttttaggtctaacatgtaagtctttaatccatcttgaattaatttttgtataaggtgtaaggaagggatccagtttcagctttcctacatatggctagccagttttcccatcaccatttattaaacagggaatcctttccccattgcttgttttttctcaggtttgtcaaagatcagatagttgtagatatgcggcattatttctgagggctctgttctatcccattgatctatatctctgttttggtaccagtaccatgctgttttggttactgtagccttgtagtatagtttgaagtcaggtagcatgatgcctctagctttgttacttttggcttaggattgacttggtgacgcgggctacttttttggttcccatatgaactttaaagtagttttttaccaattcctgtgaagaaagtcattggtagcttgagggggatggcactgaatcctataaattaccttggacagtatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactctcttctggcttgtagagtttctgccgagagatcagctgttagtctgatgggcttccctttgtgggtaacccaacctttctctctggctgcccttagcattttttccttcatttcaactttggtgaatctgataattgtgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttcccttctcgattcatttcattcatttcatcttccatcactgataccctttcttccagttgatctcatcagttcctgaggcttctgcattcttcacgtagttctcgagccttggctttcagctccatcagctcctttaaggacttctctgcgttgattattctagttatccattcgtctaattttttttcacagtttttaacttctttgccattgatttgaatttcctcctgtagctcggagtagtttgatcgtctggagccttcttctctcaattcatcaaagtcattctccctccagctttgttccactgctggtgaggagctgcattcctttggaggaggagaggcactctgctttttagagtttccagtttttctgctctgttttttccccatctttgtggttttatctacttttggtctttgatgatgctgatgtacagaagggtttttggtgtggatgtcctttctgtttgttagttttccttctaacagacaggaccctcagctgcaggtctgttggagtttgctagaggtccactccagaccctgtttgcctgggtatcagcagcggtggctgcagaacagtggtggctgtagaacagtggatcttggtgaaccgcaaatgctgctgcctgatattcctctggaagttttgtctcagaggagtacccggccgtgtgaggtgtcagtctgcccctactagggggtgcctcccagttaggctgttcgggggtcagggacccacttgaggaggcagtctgcccattctcagatctccagctgtgtgctgggagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagtttcccagctgctttgtttacctaatcaagcctgggcaatggcaggtgcccctcccctagcctcgctgccgcctagcagtgtacaaggcggctgtgctagcaatcagcgagactccgtgggcgtaggaccctctgagccaagtgcaggatataatctggtgtgccattttttaagcccattggaaaagagcagtattagggtgggagtgacccgattttccaggtgccgtctgtcacccctttctttgactaggaaagggaactccctgaccccttgtgcttcccgagtgaggcaatgcctcgccctgctttggctcgcgcacggtgcgcgcacccactgacctgcacccactgtctggcactccctagtgagatgaacccggtacctcagatggaaatgcagaaatcacccatcttctgcgttgctcacgctgggtgctgtagactggagctgttcctattcggccatcttggctccacccccctgctttgtatttttcacaccctccctggaccttcccaggcccacatcctcacccctgttttcacatttcttccttctctgagtatggttccacggactgcctggcatcttattttcattgtattattctagagcagcactgtagacattcacaaaggaagggaaaaaagagagatccattttctatgaacaacagaagaaattatgcagcgaattatgcaaatctgtcgttgcacatttgagaatactatttcaatacccaaacaccatgaaacaggctacatctagagccgtaacagtcatgaaaaggagtggtgaagtaattaaagcaacatgggagttgtgactcaaagatcatattctgccattccattaacacttaaataaccctgaccaggtcaagtaagcctctctaggcttcagtgcagctatttgaaagaaaatttttaaaaacatggttaatattactgaaaggagtatgataagccactcacatatttcctaccacagaataaaatgtttcattaaatatgttcaaggcgagcagagtgagcctgggctgttcccacagagagggggaaagaagcaagaaaacagtccaataagaaaacgcatagtccccaagacttcatgaaccctagctaattggaggggcaagtgaacaggagatgtggtaaaggccaaataaaatggccaacgtatgaattatatatgcaataccatttgcaatcaaacatatgaaataacacacatctcaccaaatctcttaatcagaatctcctttttaaaaatacttattaaacaactcactaagtgtacaagctcctgtgcacacaaccaacttctcaaatcagaatacccaaggtgggtccccagaatctacattttcaaaactcccaggtgacttagatgaccataatcatttggcaatgactagactaggatgatttgtaattagatttcttaatattcccatgtaatagatgtttctaatgggttcaaaaacagtttgtacacttaaatctatcatccgaaattttatttacaatgctaaatgtcttgctggttcctgttttcatagataatacaaagcatacttctcacagacactgttgggtttttcatctcaaacaaaatgtaaagacagcaaacagcaacttaatatttctatctatggctatggcatttttgaccaaaaacagactattatttaatttttgttagattcagaaaacacattagattctgctttattaatgtttttatttttaagctaatgggagaggttataagtctagtaggagtatgtccaagattatcaggggcagccccagttttaatgttctgatccattgtagcataacacactaattttggacctatgtcctaaaagtttagattaggagaaaaacgtcttctacttacaggtttctgaaaaacagtgtttgtaaccatcattgaaaagtctccaacttaaaagataggagaacagttaagcaaatttgtttggttttcttaattagcagaatgccacataattttggcatacatcctggactactaaaatttctggtagatagtactggcatctcagattggccattttactttacttttaatttctgtcatgacattcattttctgcctcttgaatgagctcaataaggaaaaattcccacttggaaaagatttaaggtaaactggattttttttttttttcaaattaagaaaggagctctactgaatgatagacaaactgtcactgtggatttatttacctttatcctgctggtccctgagctacataatgcttcagtctcagtttcctgatattaatttatgttactgttaccacaatacatggccagcaatcttgactatgtcgttgtgagaaaggcccctttaaaagtatcagtatcagtttgaactgtgcagaaatgtaatctagacatccttcatgctctcagcaaagaacctatagccccctcattaccataatcagggccattctattcccaaggcagctgtgggtacctgccttgaagtacgttcagcctgttgcaatcctgcccgtatccgtttgataggcacatttgatggtcagtcctgattgaccacaactggaactgttcttctggaacgtgagtgaaaacgaaaacctcacttcatgagaaaaaaaaaaacctatgactctcctattctcattctgcaatattgaaaactctaatttacatattaaaactcaatactactttgttttaaaaacaatctcttttggaatctgtttaacctaatgaatgactcctttatctgcagatttctcaaaggatggttctgtttcctgctctctgcaaggagaaaatgaatgtcttattacattcctaataactacagataatgaggggaaaaccatcattcacagcatcaatgaaaaaggtgggtgttttgccttccattgccgatggcaaatgatactacacaggagaagagaaagcaaccagaaaatcgctctgggtagcatgccaggaaagacatttccaaaattttgatgaagtttcttaaagtttcccaaggattgaaagatgccagttagaaggttcagtatgttccagtgtctcttattaagaccagataagggtcgggcacggtggctcacacctgtaatcccagcactttgggaggccgaggagggtgggtcacttgaggtcaggagttggagaccaccctggccaacatggtgaaaccctgtctctactaaaaatacaaaaattagccgggtatggtggcctgcacctataatcccagctacttgggaggctgaggcaggagaattgcttgagcctgggaggtgtaggttgcgttgatccgagatcgcgccactgcacagagtgagactctgccaaaaaaaaaaaaaaacagctaagatgacttgtagttgcagcagtcatcatcttcctgaaatctgaagatgattgtgaacttggccttgaagctcaggtatgccgagtgcccctggagtcttgctctggaaaaatctcatgtaaatcaactcctttgaaatgcatacataaaatgagtcttgtggccgttcattagggaaacataaggagaatcctgctgtataaggagaaattactttataataccaaaaaagcctgcctgctcattatctgtcttacaaaataaaattctccaactacactcccaaccctctgtgactgtggcagtgactttagcaagttatcttgaaatcaaagccatcccttacagtattgattctattgaaaaaaacgagtttcaaaaacaaaaacgaatttccagaataagtcctgcttttaattcagagacttttgtatctagttggtgattttttttttttcagtgaaacatgccttgggctaaatgcctcctcattactgagctgttgtctgttcttttattcttccacacaataagagtggcaccacaacatgccattctgcagagcacgcacagatgccctgatgctttttattatggcgtgttattatccccatgcttttgtagtagggaaaagtgaggggaaacataacctcccggaggcttaacaagagtcacctgacagcctccaggctccctcttcctcaacaaatgtccgcatggttgggtaggcctggcacttccaggggccagcagagcagaacctgtccccagaggtccatggtccctcctgtctcccgtctcacagctttcagactagaaaatcccagggtggcctggtggaggcttgggtagaagaggcaaactgagaagtgagaaaggggctgatccccagggtcctctaagcaaattgaaaaaaagaactgagtgaagggtcgccaccagggtgcttgtggacacaggtggcttctttcatcttctttctttcccccacagtccggagggacttccagagcataagagccacaacagagtcaaggaatgataggcgggaaggcttcctggctggaaagtaccagctagggtagatgctatacccacaggttccaacttggaggctccaggcccttgaggtgatgaggatagaaaaggggaaagagtgctgtatttgctgtaacaatagtaatattaattattataatagcagctctcattttttgagccctaataccatttgccagatgttgttttatatattttacatgtattaattcgcttaatattcttaacaaccatataaaacaggtaccactattattttcattttaaaggtaaggaaattgaggcatagagacattaaataattttctaggtctggcagtaattacgtgccagagctagttggaggagctctggcagcctggcctggagcccctgctctgaaccactgtgctctactgcctcctactggctgtacaatcatcataactatctgaatcacaaaaagatgttagatcagcatcatccgacagaactgttaggcaaaccctatatgtaatttaaaattttctagtaattacattaaaaagtaaaagaaacaggtaaaatgaattttatttacgatgttatccaaaatattgtcatttcaacgtgtaatcagtataaaagctgagatattttacatttttttcatgccaagtgttcaaaatcagtgtgtatttcacccttacagcataagctacttgggaaaagtcacatttcaagcactcaatatgcacattgagctaccagattgtgcaacgcatgtagcacagttagatactcaggaccttagaagtaggtgctgcaccaacctggactcgatgggccacattgcccacagtgatagaggtgaccctcttcttccacgtagaaatccattttcagtctgagcatctcaagaaacatccaagtatgaaaagtgatgatctctattgtgtaagacctgctctggcacttgggccaacatctttaattgagaaatgtacaattcctgaggactttcagttcttaaaataattatctctgccagaccgcacccatttcttctttagtccctcctggagaaccctcctaattcatgtctaggtgcaggattgtagcaagcttcatcttgctttgaacaggaacatactatgccccaccccaggcatttcttagccaaagatgtagccagtatatattctcatgacacaggcctgccgctttatttgcaggaatgtgctcacctattagaggcagctatggttcatttgctatgcgagaatatagtctttagatcttcatacagtaatagctatgtcattagctcctttacttatttctgcataatctctttacatggtttcttggccaaagaacaaaagtgtgtgaggccaggcatcatgctgttagtgggtaattagccccactcagattcacatcaactccagatccttaccttaaagacagcatgactagtcatatgtgtataactctccttattaaatatctaaaagcagtaagacttaggataaactaaacatcattcatttcctccccagatcccatggattttgcctcatttcttgcagagagatgcagatatctaatgataattttatgtgggattttttttccatgaaagtaagaggagaacataattataatgtttcattaagaaatgtatcatctcctaggcatattgcaaggactattagtcattctgctgtgaattaggaaaggtactgtataattgcaaaattacattaatatcttcaatacagtcaaaataacatttcatagaatattcaagttgaaagtaccctacagaacatctaatttcccagacttgcttgaggataagaataatttagaatatttaataacacagaatcggtggcttatccaagacccactgaatcagaatattggggaaggggtccaggaagctgtgttagtaagcaagaacagttcagcttattggtatcatcagaaaaggtaagggaacactgaactttgttttacagaggaagggcctggggctcagagaggtcaagggactggatcacattcacacagctactgtacatcagatgggaattgaatctacctctcctgaatctagtctaggaacttccccaaaaccagactactgcattagggttcaacaaaacagaactgaaacccatcattgtcttctgtctataaagaaagaaggaaatagtaattttttccaagggataggtttttatataacttttaatatagtcttctagactccccatgattcaagaaggtccatgaaaaactgatgacatgcagcacacacacacacacacacacacacacactccatttctgctttatcgtgaactcagaagagaccatgtttagtgattaaactagtctttttcttaatcctttaaatattccatgtgcattaattatcactcttttggattctcttttagagtcaaccatcaagtctatatccatttacttcaaatatctaaattcttcctttatcttttgttctactttgaggaatgcagggctattcttcaacaagtaactcatttttaaaatttaagcaaggcgaaaatggtgtcaatatttatcttctgctgcagaaaatgtagatgaaaatccaacaagaaatgcctttccgatgtcaaaatgttgattttaccaccttcttataattttctttatttctgcagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacggtatgtggaaacttagggctactccttgtctaggggagaaagaggctggtggaagagattgaggggctcagctttcttctgctctgggagttcaaatgtcacattttttctctcccactctcgccatgacccaaacagctttgatttctgttctgcttcaggggcaaaggtccagatgaccctcatagcttatatttgtcttagtgcggtggggatttccaccacgatgaagggtctcatgaggctcctgagacagctgcttagggacattggggaagtatatttttacccagcgcttcctcaccactaggagtatccctcaggccccatttgataaagcacgggtgctatatctaaacatttccataaattggttatgttataatgaatggaatagtgttcataaatagtacgataattcatgccaatttctttggaaatacttgtttctgatataataggttacaaagcaaaattgagatgatttttaaaatgccatgcagttattttttctgaataacataaattttaaacagagacctgaaaaaaaccccaaaagtattaacctttaaatacataaactcaatagaaataatttaactgccttctcttcacaagaggcaatcagaaggcaggactatagttttctgtgtttcttttccacaggagagataattacatttctagagacccatagaaacaattccatagttttaatttcatctctctatctctaatggtgtgtccaggtatctaacagcaattatcttacattgctgattctaacaacaatgatatcactggagaaaatacaggtagacgcaatgctcctttggatttgtccgcccaaataatttgatgttaacaatttttatagcaatgccttcaactcctaaagcaaatggaattttccatttttgataaatttatcttgataagggatgtttctgttgtatgcggttattctaaattaatgataatacatggtacaggacaatgaacactgaaaatttttatctactttatcttcccattaaaaatgcatttagatacaacagccaaatgcaatgtatggattttgtttggatcgtgatttgaacagtccacctgtaaaaatacatttttaaaacaactggaaaaaggctgggcatggtggctcacaccgtaatcttagaactttgggaggccaagacaggaggattggatcacttgagctcaggagttcgagttgggcaacatggcaaaacccatccctacaaaaagaaatacaaaaattagccaggcatggtggttcacacctgtagtcccagctacttgggaggctaaggcaggaggatcacttgagccaggaggtcaaggctgcagtgagccatgatcatgccattgcattccagcctaggtgacagagtgagccccagtctccaaaataaataataaataaatacataaaaagactgaaaaaagattaatacatgctgggtattagaatgatagcaaataagtatggttaatttgattaggtatgataatggcatggtgacattgctagaaaatatccatattttttagagatgcatactgaaggagtgaaaggaaatgaaagctggggttcactttgaaataattcagccaagagagtgggatggagggatagttgaagcaggtgtggcagaactgtgataactgtggaatctgagcgatgggtctttggaggttggttatatagctttcctctttttgcgaatgtgtgtattttccataattaagcaaaattcctcaggagaagatataatttactcatccctaacaatgtaaaaggtaaacaggttagcttggtgacttagaacacagtactaatgagcccaaagttgtaggacagttcacttcacctgacccctggccacagatgttatttttgactttcatcaactctccaacaaatgccttgccatggttagaagggcaaccaggtaaaagaatatggttaagttgccacaaaggacaatagcagcaagccccatgatataatcctggtatttccattttgaagagctaaactaaggctcagagaagttaagggacttccctaacttttggtgcatggttaagctgaagcctaattgttcattgttcttctaagcacagcctttggttgaccctcctggaaataataagcaggtgttccacaaacacgcacttgggcaattatgtgatgtgtatctactaaccagcacatttcaatgttctcatacagaggcataaatactgacaagtgattaatatctttaaaataacattttaattaacagttaatttccccaaaaacatgaattgttctccctcaggatgtagaacatgactgaaattcaaatgctgaatttttgctgtttcttcatctaacatgcgacccgaacatgcattaaacagaaaaaaaagcataaatggaaaatattattcccttattaaattgagtttctttgaataacaaatgtttgatgttcctgactagataatgactgggtagtaattattcacttggatgcaaaaaaggtttaactcaaataattcagtttaaatttcactaacatcctactggaaaaaaatgtcgctcactgcacacatttaggggtcttcaatttaactgagttttttccctaaaacctatttcttcttgaagaagtgaatttgactggtctttgaaacccagtgccctccagagacaatagggacagtcaggcctcctggccataggactgcactggactcataaagtgacagggcttaagacagaaaggtcttcactcctacctcctaaaacatttcagagcagctgtaaagaaaggttatcttttttattatgctttaaaaaataatgcccacccccacatattctttatgaaaacacaaatgaaacatatttaaattcatctttgattagaattttttttctaggatgacaagtcattaacttgaggcaaaaaaatgttcagcctgacatttcttgcagtcatgaattgattttgtactgtgctaagcaaatcaggtctgtgtttggcagttgggcgatcattaaggaagctgtgggtcatgacagagttttcctattaccactttttcaatcttgaaaaatgtgtcattgcatttgcagaatccacagcctaaattagcactcccagacacctgggggaatcagcctggtaaccccaaatggttaggggaaaactgaccttttctgagcagtggattgcacactcacccgaaatagagtaggactcaagcctgcatttcagctggaaagtctgtgtagagaggttacaatcagcagagcactagaggaggcagtgtggacatttccacacctcctcctggaacaaaacccaatgtgagtgcattatcctgacctctgatcttcagctgaggccaggaaataccctattacacacaacagcaatatgtacttgctcttcgtccacttttacacttccaccttaccctcttactctagtgaagtctgctttacccatcactccctataagcaatgtcttggccctaaaccagtattgcaagggactcccaaaatattgcaaacctgaatgaatgaagttgctttaaaatacggaatgaaaactctgccatcaaaattaaacattcaactaaatatctactaaataacattgtgttatcttgtcaactgcaattcaagtcacctcctctataatgcatatcagttatattaagtgtgggatatgggtgtattgtagtatgtttgacatgatatagggtgcacctacaaacaagtatctggtcctacggagctctaagctggccctgctcacagcctgtgtcctctttccaagtgtcttttctgttcacaaaggtgggagcttcctggaggaagtgggaaattcctccaggacaggcttaccctgtcattgctggcctgaacctcttacttttttccatcttgtttcttcaatggagtctctcattctcctgtaaccaactagattctagtctcaaatttaatagaattccatgcatgatttttgtttgcaaatgagactccatctacatctaaattcacatcagtctgccctttgccttcaaaatctcaaattcttagagcagcaagactagataagatctggaggtccctcagaattaaccaggctgctctcaggaatagaagcaatataccaacttagctttcacccatcatccaccaccagccaaggaacatttttctgtttggctttattatagaaatagcatatctctttaaaggcacataacaaaagtagcatgtcacttagtcagaggtcaggccactggctctggacaacatagaaatgggtgcaggtgtgattcccactcacaatgagggcactgaggccagtgagtgggaaagaccggggagtgtttccgattttattcaattcttttaagagctgaaagaaatatactgagcaagcaaagacaattaaggttttttttcaaatccacccctagaaatttctaccatagctataattcatggaatgaggtgatcaaagtataagattttaacttagaaggtcagaggcggtacctggattccatacatactcagtaatgggcttagaaatgttaagtgtaccaaagccctgggggaaaatatcttaataatcctctctaaaacctaaaagaaaaggaaattccaaatgtgaagaaaagctataaataggaactaatgagaagaggcagcatttatggagcatttgctatgtgctacacacagtgctaaaatactttacctggacgaggtaggaacagatagggacaccaaggctcagagtgtcttcagtacggtcatgtggtggagctgggtttggacccagactgttgccatagcctgtgtgatcagccttggaaagtgggagagaagaaactgtaccttacccagacaccttcctccggcctggaacaactagagaggcttgatccttctggaccttctggtccttttggctacagcaccactgctattggcacctggaggcacatctataacccaaacagcacagctgagctacccaagagtcccacacccaaccttcccactgcccccaaggcaaagccatttttcctggcctgcctttggactgcaactctttcatgaccccagggtcctccataccagtctcttgtggttgtcttacacagtgttgtacatagtaagcaaaagacagctggttctttggctacccagggcaagtgttagctgtccagaggatggttcctcactcctcccaagcaactactttctcccacttctgagttttgatttcatcttagcatgattatttgtgcccttctttgatgcctctcatgagtaacacgtttgttaaaggcagatactgtgtcgttcatttttgtatgttcctactggtttcacttttcctgttttttacttttttggctttgatttcacttttggttcatctgtcactgttcatgccactcattccatacatactgagtacctgctttgggccagggactcagtgctgggaaaacagcagtgagcacaacagctgaagccttgttttctatccgtaaatttgtgcattaccaaaagaggtaagatttttagaatatacatatgggacttgttctgtatatttaacaaaatgaaaatgtataaattgcaaaacactaaacatatgaaatgccaaattaatcaaaattgttctaatggtttccaagactgagcttgactctcctcttccaatttgcactacgtattaaaacagtataaaaacaaaatatacatactttcacttgaatctttttttttttccagggaaccaatccactctacagaggatccacaagtacttttaaaaatgtaacttataaacacagggaaaaacaaaaggtagacctttccacagattgctagaactactttatgcatgaaaaaagtctgtttcactgatatgaaatgttaatgcactatttaatttttttctctttgttgcttcaaaatgaggttggtttaagataataataggacatctgcagataagtcatcctctacatgaaggtgacagactgttggcagtttcaaaataatcaagaagagaaatatccttagcaaagagatgactttggggatcatttgaggaatactaactctgttgcattaatgcttcaaaaaatcatcaaatgattcatgggggcctgatttgcatttgaaaaatgtttgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaagttaagtgttaataatttttgtgaatttatacacacctaaacgttaagtacacaaatattttatttgttttacaaataaggaataagtaatttataaattaagaagttacctataaaaataaaaagataacaaccctatcatatagcttatttttaaattacctgaaaaacgatattctacactgtttcctttttgactctgagttttcaaactgttacttctcccatatttctcaatccatttcactcagttgcacagtcttttaaaccctgtaattgtcataccaaagtttctttttaaaaaaaaattactttaaatgcttagtttattcaaagagcgatccaataatataaaaggaacatgtgttaaacacaataaaattttaaatggctctaaatcaagcacatcaagagtatacaagtcttaaaggctttttaatacatactcttttcccatctatgtaacccaacttgcacatttcagctgcatgtggtgaatatgcatcatatatttactttaagaggtaagattttacttgcaaaatacatgtgcaaattagggatccatcagttgatggaagagatggactctagaatattatttcttgtggttattactcctttacaaagcactttcgtctcacttgatcctcataaggaaactaaggctcagaatgagtagagctgggttcagaatctagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagttcattatgtagtggaggcttcgtggttgtccattgaattgtcacagcaaaatctataagtttcttcaattctacaagatagatccatatacctttgatcacttggagactctttttttgctggtttctagataactcaggtaaatcagacctttacagagtacagggctaggtgaaagaattactgaaaaatcaccttgaaaatccgaagggctgatataccctttatgttcctgactgatgcgcagaacctgggggaaatctacagcaatatacaggttgcaatgctgataacacaacagcaatcctctcctctacgtggacttactgttgtttttttaattattattggaatgggattttagaaaatagaagttacctttgtgtgtgttttagggaaggtagagaagaatctgctctttctctgaatactgttttgaccccaggcaggaccttggaaaggccaaaacattaacagtagtacttctgttcactgaagagttatgttacatgaagataaaatggttttgtcgtgttta

SEQ ID NO: 16618 - DNA, 106929 bp, Human; identical to SEQ ID NO: 12060

SEQ ID NO: 16619 - DNA, 15687 bp, Human
cttgaatttatcaacaaaataactggtgaaactgataggattataaatcatcagattattgtttatttgtaaaagatagttgctcctaaaatattttctaaaataaagaagattatgaaaaatattaagaaacctgaattgatattttgtaactatatgttcccactttggacagtttccatttttttttaatattctgatgtcatttacattttattttataatcatatcccataattgatatcttagttttacgtttgaatgggttaaaatctcaatgccagtttttttagtttttcatttttcccatattaatacctttattgctgagttatttactttgattactcttgattgagtggactttttgcccaagaaagatttttaagaagggttcttgggtattgtgttttttgagtttttgctgatttaggagaatcctgccccaccagtttggctgtaatattatgggatcatgcttttgttctcagccttttttacacactgcacattgccatcagatgccactgaggagtctaaggccactattgtcattcccttgtttttatgcctgggtgtgaatatagtctttatcctttatgtttagcaactttaccaggatacacattggtattcattgctccttgtcaatttttcctaccaaggactctccagcctcacttctcatcacctcctttgctggaggcacacctgccttgccaactacttgcccttctgtgaacttattatgcttcttcatatccctgtggcttgtcagaggcaagtgaaatttcttcgtgctctactcccactcttgtcatttactgccaccattctagcagatttaccttctcagcatcttctcactccccaggtgacacaaccactttccccttccacccttgaaatgtaacacagatccttagtattacagggaattatcattcatatttaaaactctcctacccaggactgtgagctccaaggaaagggacgtgtaacttacatccacttaacgacgcaagcaatttaaagccaagagttcttgttggcaagaattgggaaagttggacggacagtatacaattaccgagcagccaataaacaggaaaagtcatacagttcgaatgttctgaccaggcggatattctgtctttaagaaacactaatcatatacctgggaaagaaaaaaatcttgggccccttcaaactgggaattactcagggcaaatctgcctcctattctatccaagtcacctcttttgctgacaaagaatagatgcatattctgattgcctcctttagaaagacttatcagaaactcaaaagaatgctactgtctattacctacctggaagcccccagttggggggggcggggcttgcttttaacggtctccgcctttctggaaggaactaatgtactttttacatattgattgatgtctcctgtctccccaaaatgtataaaaccaagctgtgccctgaccaccttgggcacatgtcctcaggacttcctgaggctgtgtcacgggcatgtcctcaacgttggcaaaataaactttctaagttaactgagacctgtctcaaattttcgaggttcacataccgtaggtaaaagtgtcagaagcctaaaggtgagccagtggaaaagcctgaagacccctgcaaggttattagctaagcctccataacgcaggcggcaagtgtccaggagtctggcgtctgctcgcctgcaccacgacctccctcctggggagaaggacatgcatggtaagccatttctccatttccatactgattgcttcctctcaccaccacggcccatctgcgaagcaaaactaatcctggcgtggaacaggccgcctgagggaaacagctagagcccggcgcggggcggagctggttgtgcgcatgctccgtgcaggcgcaggcgggggctgagcgccgtcgggttacgcctgcgctccgggtgagcccgcgcctgcgcctttgcggccgtgattcggtcccgctgtcctaggcgggatggtgccgctgtgccaggtaagggtggcgggtgtgcgtgcgggcctgggtgcggagccctcctcgacgtgtctctcccgccctttccctccacatacccagccttggtcagtcggacctccccactagcccccaacctggccggcgtcttgggttcgggggcgcccccgcccccgcccccgggcccttcctgtctccgggctttactgcgactgccccagcagaagtcgggtcctctccgagaactcttgtcagctcacggcagcaaggacggactcgttctgaaggcgcctccaccttttatgaccacctctttcccagattattcgttttgatgaagctaaaattttaatctaaaaagaaatgcacctcatggagaattcttgtgaagaactgtgcttcatctgtggatttctacacccttgatcatttgcaaacctgtaattatttcgtaaagagttgtttgcacggagtgacaggtgcctattttacttcgtcggatcccttacataccaggctgctggcacaagtttgttctagcaaattccagtctgtcgtgtgtttcaaacctacttgcttctgtaaatgtcagatttactatgttgcataacttaatccttagcgtctggggacgatgttatacagaccggaatctaaggtcatttgacaaccgtgagaaacaggtttttcgcttatttattcatttattttatttgtgtaactcatctcttgactcaaacatttgttctttgcttacatatttataaaaggtgctatacttttatgtcaattaaggcaggcttaacatgttttcctagaagataaatacttaggattttaatgatggcacacttaagtttgtaaaactaaaaggcatccagaaattagtctgaattgtatttaaaacaacaagttttcagaatttgaacttgtaggtatactgaaattttttacgggttatttaattttctttataaaatttgtctttgattaaagcaatacatttggaaaatgagaaaactgctcaacattgacagtcagaaaacgagtatgagttgttattaaaagcattttctttactttcaggttgaagtattgtattttgcaaaaagtgctgaaataacaggagttcgttcagagaccatttctgtgcctcaagaaataaaagcgttgcagctgtggaaggagatagaaactcgacatcctgggtagttaaaaatttgtagaatgcatatgagtaacacttagatattttcaaaatacataaatgataaaagtaaaaaggttaatttcgatttccgtgcttaatgtcaaaaagaatcgttagttgtattttttttggaacacctgaaaaactctaaatgtgcaccgtattttaagaaaggttaaagatattttaccccaaaacacagtgaaccgcagagggacatgattatattctctttgataatttacaaaacactgcacatgtcacttctgcaattttataacattaaatgaaattgttacaaattctgttaaaaatgtgtgctttaaacattttgttctgcccctctctttagagagctcaacatagaaatttctaagattgaaagaaaaatgagttacaacaaatcctagatgctgctgaatttgagtttttgtaatatttaattttttttctggttcttgaaaaacctataattttacttatgtcattcccacttcaagttctttttggaacaaaatataaaagtgacttatttgagggtgattcaggaatattaatggtgttacttagcttgtataggtgtttaacctggaagtcctagttctgtgtaaaagatactccataataagtgtttaaaagcaaaccacttcatgatttcgtatcttttaagttgctcttacagtggcctgataatcaataaaacacagtggggtctcccattctgctttacctggagggagacagcaggtcttgtatacgttttcactgtgcctgaaaagaaagcttaccattgttcaggtataaaggaacagctaataaagctgtgttgcaggtggctttatgacctatgctatctttttcatctttctaagcaacttaatccatattcgagtaggataatgtgtacaggcatagtttgtgggcagttatacttgtgcttgaacacatggatagaaggaccctggaaaggccatgtactgattggaaacttttcttttgacctggtttgagtgttgcctccagtctggtgggttttttgtgcatttttttgttgtttaattccccaaggcatacaacatccaataaagagttgacagcagtttaacgtatctttgtggtgtataagtatgttcttcagtggatatgtcctttctccatatactatgtgtaaatttaattggtaattttgcaggtgatgctttatataattatatctatgtaatatctctaattgcagctgaagcgatttgaggtctatcatagcgttgatactttgagtcatattttttcccctttagattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggtatgtgagatttgtttttcttaatcagtcgtgtggggaaggatcatacagatgataaagtgtatgtggtttgctgttaatgtatattctttgtaagtctgtctgtaccaaatctttattgatgcagcaactcttcattggtgccaacagatttatgaatatctagcaccatttctgcatcaagtctattgtaagcagtttaattacaataaacatatcagtttgatatgtttcatttaacatggtttattgagatcttatgtgtcaggcacagtgacatattaatatccatattttgcaggtaaaaaaacaaattcagaagacttaaaaaacttgcctttgatcacatagctaatcacatagctaataagtgaaagagccaaattaaaaagaatttatttaacttttaagttcaggggaacttgtatcatggcggtttcttgtacagataattttgtcacccaggtattaagtctagtgcccatcagttattttttcaatcttctccctcctcccaccctccaccctcaagtaggctccagtgtctatggtttccttctttgtgtccatgtgtactcaatatttatctcccacttgtaagtgagaacgtttggtatttggttttctgttcccgcattagttggctaaggataatggcctctagctccatccatgtccctgcaaaggacttgatctcgttctttcttatggctgcatagtattccatggtgtatatgtaccacattttctttatccagtctaccactgatgggcatttaggttgattccatgtctttgctattgtgaatagtgctgcagtgaacagacgtgtgcatgtgtctttatgacagaacgattatatttctctgggtatatattcagtaatgggattgctgggttgagtggtatttcagtctctaggccaccctgtcttccacaatgattgaactaatttacactccctgcagcagtgtataagcattcctttttcttcacgtcctcgccagcatctgttattttaataatagctcttctgactggtgtgagatggtatctcattgtggttgggatttgcatttctctaatgatcagtgatgttgagctttcttttcatatgattgttggccacatgtatgtcttcttttgaaaagttcctgttcatgtcctttgcctacttttattggggttgttttttctcataaattttaaaaaattccttagagatgctgatgttagacatttgtcagatgcatagtttgcaaaatttttctcccattcggtaggttgtctattcactctgttgatagtttcctttgctatgcaaaaactctttagtttaattagatcccatttgtcaatttttgcttttgctgcaattgctttttgagtcttctttgtcattaaatctttgcttgttcttatgtccagaatggtgttgcctagattgtcttccagggtttttctagtttttggttttacatttaagtctttaatccattttgagttaatatttgtatatggtataaggaaagggcccagtttcagtcttctgcacatggctagccagttatcccagcaccatgtattgaatagggtatcctttccccattgcttgtttttgtaggtttgttgaagatcagatagttgtaggtgtgaagctttatttctgggttctgggttctgtttcatttgtctatgtgtcctgttttgtaccagtcccatgctgttttggttactgtagccctgtggtatagtttgaagttgggtagtgtaatgcctccagctttgttctttttgctgaggattcaagaggttttcaaaagacagcatttgaactcatattattggactgtctgtgtacttttttccaaccacacttactaatactagataatagctctcccggccatggaaaatgtagaaaaatttcacagctaataatgcctgaaaagagagctaatcattgcccaggactaaaggaatagctttattgttatggctgtgttgcaggtggctctttgacccatgctaccttgtcatctttctaaacaacttagtccatattcaagtaggataatgtacaagaacattgttcagtatagtgtggagagatcaggcttcttataagtacagacagaatgaggcttaatttattgtcagctgaggaacaaacagtagaaattaacagtcatccctgaataaaaactcttggtaagttaggaatgaaagaagactttcttaatttgataggatttttattcaaaatcaggagtaaatatcatatttaatggcaaaaacttggttccattaaagaaaggagcaagccaaggatgcctttttatcttttttcacccattttttccccaccctcctggagggcagtgccacaagaaatgaagaatcaatctgtaaaacagattgcctctcatgtcaacactaggcttctttctcaggcctactatctggaaataatagaagaatctcttgtcagatatgtatctcaatgctatttagaaactgtggtcaccatatcaccaccatgatttcaggaggttctaaaaatgcagttttttggaatttcgaatttattcagaaaactataggctaccattaaagggatatttgtggtaattacagctgttctttgaaaaggttacgaagattactcaaaagcattgtgtgttacttgaatgtgtttcgcaggactggtattatgcatttttaaaacctgccagctaggttttagtagtctcgtaaaatcagaagttgtgggaactcagtatggtttgaaactcgtagaccatatttatattacctatattttattgcaagaaaaagaggtggaagacacttaggcggcttgtgtagcagatgaaaaatcctggaatccagtggtatataaagaattgtgctgtttccgtggtggaaaggagataggaaaaagaacattggcttaactagtactccttggttggaatttcagcaccttgagtgagttccttaacttctctgagccttctttctctcgtctttcaattcagatgaaaccttacaggattaataattatattcctcattgcctgcaagattctacctacctgtccagcctcagcctgcccagttctctccgttcgttctaggttctggagcacatcacaccctttcttgtcccagtgccttggcattggccactccctctctctgcctgggggcctgtgccctggtttctttacaagacttcctccttatctttcaggtcgcaacttttcatagaggctcttgagagaaatctcccccagaccccaggttctgtctctgaagcctatttacttccataagttatccctatttgtaattctgagtttctcctgtaatgctttgtttctcctatttgaatgtaagcacgctgaggaaaggagcttgagcttctttctcccctgattgatatctagtgcctggccctagtctctggcccttagtgagtatgtagtaatgtttgaggaattaaatgagaaatgcatggcaaagggctttgcacaatacctagtaagtaagtgtgcagttcattcccttatttcctcagttacttacctggggttttgccagtttgtgaagggaacccagttccagtagaatcactgtcacttctgttcttccttttttgttggataaagaaaaagacagctttaggtgtggtgcttggtaccatagtggtgagaggggatgggcatgtaggtgaaagtggcaatacctccactgtatcttgatgggagatatgaatagcagttacagaatttggaatatattggcattgagacagattatattttagtgatcatgttaataatggattactttttatgtcatgcctgattcattatgaatatttatacacataattgagttttgttaatttttacacttgcttatttttatcattcagatcaaatcatgcctcctaacacatttaatggtggggaaaaaaagaaaagaaactttttatctgaggaatgtgagcccgtcagataaaacattaagaggcacagaaaggcactggaatgaaatggcagtcatgtcactccccattaagctgcatcattaccttttttttctttttttttttttgagatggggtatcactttgtcgcccagactggagtgcagtggcatgatcaatttcagctcactgcaacctccacctcccaagctcaagcaattctcctgcctcagcctcccaagtagttgggattatagatgtgtgccactaccgcctggctaatttttgtatttttagtagagacggggtttcaccatgttggccaggctggtctcaaactcctgaccccaaatgatccacccgcctcggcctcccaaagtggtgggattacaggtgtgagccactggtcccttgaagccacttattatgagggctgcagactagctgaagctaagaaaccataaagtccatatgctggacactctaacttgtacccaccctatagttcaacagtgtacagccaatcagtgatcaacattatctctgtatgccagtgagaattcttggtgaaactttgtatcattgtatcagcccactttttgttccctttgcctttacaaacctgcttgcaacaaaggccgagggagtgctccccaaaggaactccccaaggtatcttagaagcatcctgggccactgtccttgatttgactcatgtaaactatattttgtgccacagcctcttccttttacatcgacataatgtagaaaaaaatataaattgaaagagcctataagttgttgagtgttttacccctaggacttctgttaaggtttgttaatgtattatttctaggaaagatatggatgaagttgaagagaaatctaaagatgttataaactttactgccgagaaactttcagtagatgaagtctcacagttggtgatttctccgctctgtggtgcaatatccctatttgtaggtgagttgtaattttcattgcatctatcactgtataagacaatagaaattagcatgtgctttccatgttcagtgttaacggaggagtttgaaatactgaactttaaaccaagattaccgatgatggtgggtagacttttttttagttcttgttttgttttagtaaccttcaaattaacctatattaaattacaaggcattttgaaaagtaggataaaagtcattgttaggagagagaattctagattttccaaaattgaaggtaaaaatgtacttgatagtcctgggaacataaatattttccttttaagtatctattagtcagaagaggaatattgcccggtttgccaggtgagtgtttttagtaagcttgcttaatcagtgctcatctttgtgaagatctgttttattttcctaatcaaattttgtttttagaagatttcaaagtagttttagaagaattggtatgctgcttgtttactattaatttactattaaaaatattccttttttattaacgtgctatttcttttgtagggaaaaaccttattttaattgttttctttttcttttttttcatttttaaagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttgggtatgatttcctttatcactctaaaagttaagtgtaattgttttccatctttgtactaactctgattcttgaatctttcttagtaattctatattaccatgagaggaatattcatgtattatttttggaggacaatagggatggctgttagtacctttagggactgcctagtgagttttgatattgggagagctcttgttgcctctgttgctgtaacaaactgcagttgtgccaagacttgcaggccctatgacaatctgtgacagattctttttgatataaatgcctcgaaagtcattagagtggtttgcctttttgtacccctaaaaagagaagagttcttggctttaaaaagaagccagtaattgagactgtatctatcatactctgttagttactagtttgttattaataaccagtagttttattaatggttattatcactcctattacttgatatgtattattttaaattttgtattatactcgttaggacataactttgtatttctaggcattacttggcactgtgccttgttgagtcagatgtttgctctatcaatgaaaggattttccttggtgcccatcaggagggtttagtggatagattctaacaaattagctgtagcatcagcctcatctactgcctctgctgaatgctactgcaattaattactcttttctaactgtatgtttacgtaaaatagaactacagtataattctaagactgcatacctggattttttttcatctgtctagcagattctttaacacgtagattcagagatgatggtgatttttttttctcttcatcttgttaaagcttggttccagtgtcagaagcaagcataatcattgctgtgtcctcagcccacagagctgcatctcttgaagctgtgagctatgccattgatactttaaaagccaaggtgcccatatggaaaaaggtaagttaagaaaataacacattttagcatgtggacctgatttttctcaggaatttttagataaatccccccatatttatggactttttactgactgtagtatcttgttttctttatctgtgaaatatcttctttccaagatttgttaagcatgaaaaatatgtgccccaaagaatgcatggcacacagtaagcctcaatgagtgataacagtgagaattcctagtctggactgttggaggggttcatacatgaagttattttccttggattataattcccttgaattagagggtctttctgttggagagtgagaataatgcattagctatttaggtaatggctaaaatagaaattctttaaagtgaaagaggcttttcctagaggtcctttttagggaagaaaaaaaaatggtgagatattgctccctctgagaaaatgcagtgagtggatttaaaaacagaaataggaacttctggcatgttttctgtcaataagggcaagtaattctctggttaaatagagcattctgatgggatgaaaaggcccaactccctagtttctcccctggtgtagtaacattaacagtgggattgttctgtggttgcacattcaatgtctagaattgtctagaattgcctacagcgttgtggttgacagaaagctgaggagttaatgaacagctcagtagatgaaaagaccagagcagagagccagggcttttaaagggcacttctcccctccttcccaggggacctgcctcagtcagtggtagaaataagcaagttggactcataaccagggcctgggaaatttgatgaccatgttttcagaataaaattgaagcccattgttagaatacgtagggattagaggatagaatatgtgtgaaaggaaacttagtgaagctcagatatattgttcccttgctgtgaacaaggctgacacaacaggaggcaggcccccagagagcgagaggtaggaagagcattctaagatcagctgcaagcctggaaggcaggggtagctttcttcaccagggaggaaagggtgcacagtcagtggacagaaagtagatgggagcaaccccagaaatacaggtaatgagcaggagttggggcatattcttgttttcatgctttgaggactagttgggcttcgtattttgcttttgtttgtccatagagagtccgaggaagtgcaggagttcagaggacagttgaatttgaattcctctccctacagaaatggaatgtgactagagagtgagaagagaaagtgatatgttctccttacccctcctttccacaaactatgtaacttctagtctggttctagtctcggcctgtgctttgagatcatctgtgatatagggaagggtggcaggtaggtagagtgcatatgtcaaagaacagctcataccagagggcagctcaaacttgtttaggaacttctgagaggtgaccacttaattcaacagctaatgaagatatctgcctttggaaaagcatatttagaaatgttgaagtagtaggtatgtttggaaagaaaaaaaaatgtttaaaactaaagactttctgtcttcccctatgtaaccttgcccatgatgtctctcgtcatgattgttaaaagaggagccattgaaatagatgtgatattcatttgtctgatttattcaaatatattttatattcgtatagtagaatggtctatttttaatacctgttatgattttgttttttaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaagagtattttctttttttttaaattgcctaaaatagttctcattatggagatttctgggatttcagaatctataatcttaccagaaaactttttgttgttttttattagttgttaattttgtatcaatatacaaatcagcacaaaattgtcataaagctaactagcaacaaggtggtttgtgttgaaatgtttaggtaaacaatgccccaatttttaactggttaagctttatagtattttgatagacttgtacatataagtcccatatagttcttaaatttttttttccagctttatttaggtatacttgacaaaaattgtatgtatttaaagtatacaatgtgatttttgatacacatatacattgtgaggtgattaccataatccaactaattaacatattcctcagctcacatagtcccctcttctgtgtggtgagaatatttaaggtctactctcagcaaatttcaggtaaacacatagctcataaaataataaaatacaggcaaaatttgggcagtcggcatcatcacaaaatttgcattatgcatattaagaacaaaagctatactttcagacacttagattgaaggatttttttcttatgtctgggacaaataagaaacgtagtaatcctatttgttatatgtagtgaaaacatcttttacctaaggaacccatttattcaacaaatatttattgaatgcctgttttgtgccaggcacccacccagtgatctttttctgccaacctaaaataccttgaggaacactctgcatcttatctgtggctgggacccataggacagccacactgactttaggaatcacctggttacatcagttgatgcttgttcattagtccgtctggagagattgggccagaaggatactggaagggcagacaaaccctccgcctacttcctctgccgggttcgggttgcctgtttggtctcagccttaccttcacagttcagtgtcactctggcttgccatcgagcttccgcctgtccccattggagagaaggggtgggtgttggctgttgcattatatctaaaagcacattatcatggggttactgggtcactggacatttctaggattttggacataggttgttaaatggatgttatgtcatatgcaatgttgataggtatatgtggatttcaagactttcctacttagatatttctttagaagttccttattgagggtaatgatgtttttaaagaacatagaacattctttatgttttaaaagaatcatgccttcattaagtaggctttattctaagtttggaactgagactgttatgcttttaaagtctccaacagagaggttaaggagttaacctggggcatgccagaactgggatggaatggccttgaaagattttagtgcattgcacttgacttagataggatctttactgacccttgcttacttaggagtggcagagttaattggtggttcagatattaaggggctactgtcactctgatatgtagcttttctatcatctctgtaacttagcttcaagtaactagaagagtaatctaaaaaaaataattagcctttaatcagattgcctgcagtgtttcttggtcactttaaagccgtgactttgcatgattgctaggtaagttcacttaagaaataggaaattcaaattatttatgtttcaagtatttttgaacaggtggtaaaatgaaattgatttttatcatctttgaatgaaagtaacagcagatattcaatgagtgacttattttgtggacatttttgtcctttggatatgatgtatagagtcacaatatattttcagccttttttgagaaataagtgatttagacatcttacacagttactgagcacctggtacagtgaagatctctcaagaatgatttgtgtgatgtagttcggtggatcatccagcagagggcagtagagccagagccatagtaaaagttatagtaaagttgctcttagcaa

SEQ ID NO: 16620 - DNA, 14565 bp, Human
acctaatgggaataactgaatagggaaacgcagcaaggcctgtctgttcagattcttctttgtctctccgttcagcattccttcctcctggatatgggacaggatccttgctggaatgtgggtcttatgacctacttccaaagcaggtcacagaatttctttatggtcagctcttatacagaaaggcagggaaaagttagaataatatgtttagattttatgtctacctttggcggggataggttctggtttctatgaccttccttggggaagaggcattctagtttctatggcttgctgtgggggcgaatgagggatggcagagtagggcaggacaaagtaaaagacaaactttgctttatacagaggccttcacttgggggtatcattttctgagccccaacaggggtatacagatttggaaccccacctcaagacccaatgaaacagaagtggcatagccctgaaatctgaatttttaacagtcagcccatttgattctgatggaagtgtttcttagatcacacttcgagaaacgtcagcataggaagatcctccagactttctaagaatcactctttaaatgcatctattcgtttgagttaaactaggaacacagagataaaaggcgtagtctcagccttggaagaattcatggcctagtggtaaaggcagacttagaagcagatggtttcatagcatgaatgagtgagtccatacagcagaaggagctgggtgctatggagaactgaagagaggcacgcagctcagcctgtgtggggagaggtgcacatctgggaggaaggcttaacagaagaagtaactatgtcttcaaggatgagtgagcattttccaagaggaggggagagaagaattccaggtagagatgtgcagtcttcagagatatcaaggctcagagctcagaggaccaaaagcagggtggcctctagggacatgttcaagatgagggattgcataagaggaggggctaataaggaagataggctgatgacgctgaagactgcacatgtctttcataaaaggtgatgctttttcacagaagaaggtgcatggccgatatttatatcattgtaattgcaatagtgattaatgtgcaattccaaattgtggtctctgtcctcataagtacagtattctcaatgcagtggtattctgatgagcttccaattgagaaggaattcggaaaagtccaaggcaatcctaaatggttttatcttcttgttttcctcattaatctttgtcatcagatgtcttagaccaaagtaaggctgaaaaaattctgaccaaaggaaggaacaaggtggctgtatgcagaaccacaaaaaaacctcccacattgaatgaatgttgacatatgttatttacagtatcatcatgcataaaatacagatgagtacatgaataaaaataaaatagtattcaccatccacctttctaagagttaagatcaaaaagtgcctgtagttgccactctgttctccagtttaaaagatggatttcactaccaatctgcataaactagcattgtaactcacagcgtgtggttatacaaacaagaacagaaaccagagtagaaatcgaagcatgctgaaagaagaggggttttttttgtttgtttgtttttgttttgttttgtttgtttttaaccagaaagagttatttgaattcagaatagagctacatatatccaccccattgtctgtacaggtgtgtgtgtacacgtatatgtgtgtgtttgtgtgtgtctgtgtgtgtatccgtgtgaatcacattcagctgtaatatattataaatgataattaagtagatataatcaagtttttgtaatatttatttttcctcacatttatataaagaaaatcaaaaccaggaaaataaaagtattctcaaagctgtctacttgattccagctgttagcattatttattgtaattagtgttatgaagtagtgaaatgccaatgtctttgaacttcttgcagttgtgtgtaatattggagccaatgcaggaactgatgtcgagacataaaacttacaacctcagtccccgagactgcctgaagacctgcttgtttcagaagtggcagaggatggtggctccgccaggtacaccctcattcttcactctctctctaaacacgttttcagaggtgtcttccagggatgaagtgatgtgaaaaagaagaaagtgatcattaatttatcaggacaagtagcttattagggatattctgaccatggttgtggacataaagacaatgaatttgtgacaggcaaacatccttaagaattatctacagtctcctcacttaccagattaggacctgcaactcagagaggtaaaataacgtgttcaaggtcatcaagaaggtcattggcaaagctgagatcagagccaggggttcctgtcttctaatctagtggttcttccactgagccagactgctggcttctcacggcctaatgttttaggtttttgttttttaagaatgacagacattatgaaaaggaaggaagaaagggaagataaggaagaaggaaaggagaaaaaagaagggatggaaagaaggaaggaagaaaggaacagatgaatgaaggaggaaaggatgaaggaaaaatgaagtttgctctgtttttaaagatatattgtatcaaaagttctgatcatgaagagaatatataagcaattccatttccctcacttccctagaatgcagtttagatactatagtctcctgctggggttctgaaatcaccgattcaagtcatcattaattgtcttcctatctaatatactttcactcccaggcgtgtgttgagcctcattcatcataaaagcaaaatgtagccatttgctaaaaattatttttataaaaagtaattattaacacgaggcacatagctttctgaatcacaaaatataatggtcaccttcggctggtaagtggccaggggttttatgtaaaatgaatatagcaaatttaatcaagtacatatttagaaagctgagaaaataagtgttattttatgtagaatagttacatccccatcttatgggaattttagacttttggaatattatttttcaaatatattaaatgtgcttaaattggctttattttttcttttaacgctaataagactttatggagaaaacgtaatccactcagcaagtgctatattttctaacataggcatatataattgatatattattcattaattccttcattcattcaataattatttattgagatttattaggctccagacatggttctagccactgggagttacaaaactgaataaagcatgcaaaaatattgaatccttaccataactttaaatgtattatctccattttatatagtgcactctgagacttagggtagtaatttgacacagccagtctcatggctaacaaatgaaggaggactgtgtcaccaaaaggtttttatgtctccaaagtctattattttactaccacagccacctactggtaatgggaatagtccagaatacgcattttaggtacacttgccccaatttcatggtcaaagtataaataaaaagagcaccaaatttatactcttaaggtcaaagaaagaagatacttgtcaggagtgggcctgagtatctgctggactttagaatgtcctcctcaaccctttattcaactccatgacctggaacagttctatatcctgttcctctcatccttcagagcaagcaccctgaactcgatggaaggaaatgatagaccatttgatgaaaatctttaagcataagagacaaaatatttagggacgataaaaaaatagtaggtgagtagaaaagtcaaaaagaagtcagggatactcattggactaagtgatctttgaaatgagccttagaggaagatccttcccattgtccaccagaagtggcataggtgtttttttggtgtgattttgtcttgctttgctttgtttttgagacatggtcttgctctgtcacccaggctggactgcagtggcacaatcatagcttactgcagcctcgacttccgggctcaggtgattctcacacctcagcctcaagagtatctgggacccctggtgcgtatcaccacacctggctaatctgtgtatattttgtacagatggggttcaccatgttgcccaagttggtctcgaattcctgggctcaaacaatccacttgcctcgtcctcccaaaatgctaggattattgccatgagccatggcacccgtccagcataggtgttttaagaaaatgctacaaggccctcttatttggttccagtgtagccctgagttgccttctctccatcacagtcaggtctaaaatagagctggcaaaaaggatgctcttacttgccatttccaacttattcagtaactggcaggagaaggcttctgaaactttctcatttatgaaacaaagattacaataatagttcctaactaataggattttttgaatataaaatagtgcattggaaacattaagaatagtgacaagcattacataatgttctataccttataagtaaacaaacaaataaataaagaatatttctcttatcacactttaccttgggtctctatatttctattaaagggttgccccatccttcaagtccaaaatatttttctctgtttctgaataggcctttctttaagaggtctagtttcccctcagtaatatgctggctataccatgtactcagacatatttttttctagcaattttggaattagtagcatttattaaacagcagggcccaaaccatgggtattccttctgaacttgggaatccctaagctccacatccacagctgatggaactgactttacttgagaattctataaaggtataatagaggtgggttgcaatatgacatttcaccagtagatgctgctgttgcacactggctcatgaatttggctatttaaagttcatacttcactcgtaccttggagttagttaccctagggatcccaggagtcctctctttgttttaaagagaagatacaccagaggaaaaaagtttcccaaattttctaatggcaaaatattttaaatccaattatgaaagtggtacttgtagttacatacctaaaaaatatttttacaaaattaaatacataccattagagagaatgattaaataaaaattatttgatctacacacaaagaaaagagtgtcacatattttgtgctaaaaacacatctacagttttctccttttattctttctaaagctataagaaatggaaaatgtttaaatagtctactcttcagtttaccaagacagcttccttagagtaaccatactgatgattgccttgttgcttttgccctagaactgatccctcttcccttttccatattgcagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgtaagtctcgctttcctcttaggcccgaaatcctaactgtctgcttcctactcaaagggcccaaattaaagtctcttttcattagaaaaaaaaaaaaaatcctgggcaggttggaggtgggggagggataaaagacagggacagaggttgggatgggagggaggaactctgccatggaaaccttcccctgcaaactgggaattagaaaggaatattaagagtcgtgctgcaatgggacctgaattaaaaagccatcagagtcacagacaggagatatgtcacttaaggtttaattaaaatatcacttagcagcatgcctggtggcgtattaaggcctctcagcaccatcattggagaccctgtgctccactggaaactagctcccagcggctcagtcccatattgtaatttgactgggccttcccaacatgggcgtcccctcttattttaagactcaggtaattaaccagcagccactaaacatgtagctcagtgaagctctcgcttagcccattgcattagctaagggggaggatcagcctctggtttggtctcaactctctcgaacccttggcccctttctttcatttctttatcttgacaaagaccattaggaaggggacttctttgaattccaaagctgacagctgagggtaatcccatatagtgaaaactgcacaggaactttcttcatcttttattcattcttcttgaattctgtcccttctgcctaattccctcccatctcctaactccccagccccttattagactatctcctttaagtactttgctcctttaaagtgcttctgttccttctctgctgtccctgtcataccaccctatcaccaggtgtttggccatcattcaaatcctgagattttcttagtgcttcatggataccttttagatactctgttttccaaagttgccctatttcttgttacatccctcaaccagtacaattttaccttttccgtctttcccacgtttttccccctcacccttcttgctctcatccttacccttattgttctgatcctgctccatcgcttccatgtgcgagtggaccttcgcacagggattccccacttacttccaagtgtgtctttcacatctgcccccacctacttgtatctactttccactggtcagttctctttggccaaaaccaaccccatcagtaccctgaggattccttgggccattgtttctcttctcctgtctcccacagacagggggtatacttttcattcccactgcattagaaagaaggggtcatggggagaatgaccagcctaaaatggaaggtgccatgttacattttacaaggttacaaattgcagtcttcaaataatgaaaatagtctccaggtggtcctccactttctgagctaggctttatacctaatacctctgaagatcagggggaaaaagccaaaagaggaaaataaagagtctctttattaaaaaagtatcaagttatgcccacttctggtgaaattttgaatagagaaaatggcctgatttagataaatcaactgaaaaagtgtacacaggagcccatttctttatccaatcctggagttaaaggcagtaacattcgttagtttcctctagcaaataagaaaaagtgcatctcagaggattctgaaacggtgatatagctacttaaaggcactgtagctgcaagaatcccaatcagttcaacagatgttttctgagctcctactatgtgcccacactgtgccaggtactagcaataccaaggtgaaaaacaacaacaacaacaaagccctgtcattgaagagctcactgtctaatctagggatggcaaggacattttctctctcctgccagccctcagagtatggtattgaggaggattctaaggtctagtctgggtttggtgggccatccattagtgatgtctgacatggttgtagaagttgagagtagcagcttacatgtcatatgttttgacacatatggtctagtcagaatcatttcaatttcatttgaaagaggatatagcttctgtactctgttatgctcctgtcttccaaatcaacaactgtattttactggaggttacctgtatccagagggtttgtaacaagtagagaccctttgcattttgtgtgattaagagcaaggcaccgttaggaaatgagagttggattccatcactatctccacactatgcagttaaagatgttttaataaagtaaaattgtcagatgttacagagaggcagaaagaacaaccagattaggaaaatgtacaaattcatatgtgtcctggagttgaatggacattaaatgataagcgttggatgacttgtggtgaccatatcttttaaccctgtctactgagttatcaacactattctactggttaactagagatgctacctgcaggcatccactgtctggtccaaaggcatgtgccactatgaccacagctgtggtctgtgtagctgctgcggcagcgatgtgtgtgtctggcgagggctagggtttaatccttggattctgcttctcactccatgagcaggggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggttggtggtctttgcacgggggattagtgagaagatgtgaaatgggtgagagctggtggcacctccgggcttccagcaaggagcagaagttggccttgtggggagctgagggcatatggacctctctcagatggctcgctgttgtctctcgtggacacacaggatagagatgggaaggaaatgtactctcactgccaatgttggggggatttttaacaaaatgggggggaaatgttgctaacaacccctaatcagaggcagcctagaatgtgcatcatgctttatttattttgtgtgagaataacaaatcaagactgccagagcagataatcactatcctagtctagaggcttagaagaaccaatagaaacatgcacataaatttttaagtggccttaactgtctatgtgcatatgaagcccttaacttgccatttgtcaattatgcacgcacacaaacacatacacacacacacacacgctctctctctctcacacacacacacaactaagtatctagctagggatattttatataattagtaaaacatatgtggcatccctttgaaatttagtacatttaaaaacacctatgcctagacatcttttccagctgctcctagaacaaagattcaccgaacagattacaagcctgttggctccattggaaatgattcaaaccacgatgttcatagtacttttcttcaatgattgttgttttctaattcaatgaatgcatttggagtgttgagagcttttcttttaatatcatgcttaagttggctgctttttattttcctcctcctctttcaaattatgcttcctcatactctcccatcctctctcaatgactttggagtcacgatactaatgcagacccacttggttggttaacatccttctcctgccctgtgacgccttacgcatgtgttttccaagcccttcaagtgtgctggacacaagtcatgaaatgagattaaccctcaggtcatgctctgtacaacctagccctattctttccatctccctttgttcttgatcataagtgtcatctcctaattgcctataactcagtggcactcttttatcctgaacatccccaaacaggtaacactgcagctgcccagctaactgaataccattcatgcctctgtggtggccacactccatctaaaatcctgtcatcctttctgccagtcagaaggacggtatctactttgcatctcaccttaacagtcttcatgagtctcgttccatgtcactgtcatttctggttcttcattgcataataaataaataaatcttggaagcacagagatgaatatcccctggcatttttattgctgggtttaccaagctcacattttaggcacttacttactccatttgggacatttctttttaaaatcatttttatctattcacaagaatgattagtcagaaaacatagtttggaaacctattaattatctcccctaactcaagaatggtggggagcagaaataaataaaacaaggttttccattgtaaaagactagggggtaactaagggatttgttcaatggacactttcaaaatcccactggtccttctcctgacagtaggcagtattccattctactgtcccaggaaggccttctctgggcaaagctctagtaaaatgaatttctgcccagttgtcaaaatattttattgaattagcctttctactggaaaccccaccctctcatctccaaaagcatctggctagccctaccttctctggcctcagtggaggctgatcacagttggtcactttcctgaagttactgcacttttaagtggagtattgctcagagcctgcccagaagaatccacctgacagatgtcctgtcccatgccaaggtccctcatcaaccccatatggtcccctttgaacaaagaagctggagctctgccctgtgtatgcattcttcttccccatccctggcctctccagctgtggcctccccatgctcccagctacagtaggtggcttacttatttgcatggaaggacaatttgtacttaaaagagtgattagatggattcttcttgcacgcttccatctctgatgactaccagcttcatcaatgtaattataattagcgttcttcatcttccctttatggcaccagctggacagaccggttctctttactgcccagatgggtggcagggttgcctgtgtggtgataggtgacaggcaccatgaaataacagatggtaaattcaaggcttgttggcaatcagcaggtttttgctaatgacttaattagctatgcaaattgtcaaatcagtgtgaacattgtttttatcgaaaactttacctaaattaattaccataattaagtagcagaatgtcaaggatattggctgcataaaagggcctggctgagtagagaaaagagagattctgtcttcaattaaaatgtatatcatccctgggacagagaaaataccgtttggaatgagttgtgtgaatattgcagaattgcaccttacgtgtgtctccggtcactgctagtttccaaagccactcacaggccctaaataaaagtggcagatttttggaggtattgagaagcacccagcagaaggttccacagccctctcaaaagtccccaatgtcggcaagttgaaagcatggatttttttaattttgaaaaatacatttttttatttctgcagattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaagcaagtgaatctggctatttgtgtgagtacgtgtgtagcaatctgctcacaattatcagaagtattgagcttagattcatggcccagactccaaatgaagtggaaccataaaatctgtgtgaagtaagttcactgtgcactggttaccaacttgtctgagtccagtgagccagaagacacttacttacttatgtgcaacaaattacatggagcaggtttattacttacagacaggcatcaagaaacaacagaagcctaggattcatgggacctagtccccaagactcagaaaagctgcccagggcagatggtgcaagccccatttgcaccacagctgagggaacctggaaagcagccggacctgggttttataccctggggtcatgtgacacgctggactaaagcactgaagggcatcctgtttctatgaggggatgggttgggaccagagctcaggctgtttcagccaggcaccccttatcttaggatgtttcattcccagctcatgctacagttattcttgagaactaagagcaagaaagaggagagaattgggtcagttcgaggccacagaagcactgtcctacaacctgtgccatcttttatgaagtattgtttctttccttgttcactgcagcttcttgagcaaacacagaaatgccttctctgtgctgagtcctgtgctagccgaggatacaacatgaaaagacagactggatggtgttcttggaggttgtagtcaagtagaaaggcagtagcttccagtcactgagtgcttgctctgcactaaagaactctacttaaggctcattatttcaattaatcctcatgataactccatagcataagcatgattattaccattttaaaaatcaatgtctcacctgcctatttttctatacagagtaaggaaaattcactggaggatcttttatgtttaaagaacattactcatatttttcactttgcactaatgataaagaaagatgagagaggaaatctgttattatttattgggtgtttgtttattaagtgccaggcaatttcaatttatcatctcactgaattctgggaaggggatttgaaaaggggaagctaaagaaaggttaagtgtcttaggttcggatctctagaagcagagcctaaagctgggattcagggacatgaggtttattaagggtatgttctacagaaaaaaaaaattatatatatattatatataagatcatatatatatatgagagtgggaaaagcaggatagggaaggagaaagaactaaggaaagctatgggcctccacagtcagcttcctgggcctaatccatgaggtgaaggctttgtagacctcactgaagagttatccccgcttgtgctacagcccagccttttggcacctgtatcaatatcaacccttcattgattgggaaccatccccagaatgtatgagggatttgtgaccttcacagcaagatggcttcatcaaccgaggggcattctacagagaagaaaccaactagatgcaacagtaacagtatcttgggaccagtgttctggcttaataaaggacatctatgtgggcacaaatttgcttactccattaagtaagttgtccctggtctcctacatcaggaatgcaacagttgggattttaacctggatcttccttgactgtaaagcctggtttggttttgttttgttcctagaatattacattcccttcctagaacattcttactttttatttttatttttctgttttaatgttttattttcttttttcttttattatactttaagttctattgtgcatgtgcacaatgtgcgggtttgttacacatgtatactgtaatagcaacagaactaatgaaaatatagagaaacagatactttattgctttcccactgtgtacttttaagataacttccagtgcatccctcaccctcacctcaccattttaggttttcttttatcaattctttaaagtcatttatatatac

SEQ ID NO: 16621 - DNA, 108341 bp, Human
acatccctctatcttgtgagagtgaagacttgagtttctccatcaccaaggaagacttgggtgaaggcactcaagtgggagggacaaaatgacatctgaaaactggaggccttgggcagggacctccccttcctcaaactaaaggtgaatgaaccaaattttgcgattccaggtagcttttcatgtcaaattttcatgtcaaattcttccgtgccatctctgaccctttagtaaaatcccctccaaatattccagaaaaaccttgtgagttcatatttggcaaggccatccaaagcatgttagcaacccagcatgatggtgtcagtactaattacataatgagaggccccaaagagaagagtattaggcaacaggaacgagggccactaaatcccaatcgcttttccccagcaatgattctccttcaatatgaggttatgggttatgaggatatgagttagtcaattagcttccttatgcaacttcaaattccctgaacagatccaggaattttgcacattctgttccttgtccataaactttggttcccctccccaaactgttgttctttcgacaaactctatacataattcatattcctggctcagaaatcataatctctaagtaacctttcctgacaccctattctccacctcctcttccataacctgtggtctttttgaacagagtggtgacattttgggctggatgactgaaaaagcaaagtagaaaaacagaacatagaacatacagggcctccagttgctgtgcctggcggtacatgaaacatagtattcaataactattctttgaatgcacagtcattttgttttttcctttaacagtatttcctaataggtaactcatgaacactgcaaaaaatgtcaaactgcacaaaaaaattcagggaaaagtacattttccccccaatcccattccctcctttctcttaataccagttagctttcctttcagattgattatgcatatatgggtatgtaaatgttttcccactatttgttacacataaaaattatatacaattcatatattacatatggtgcatgttatatacacacacataaacagatcatctcggttttgcttaacctaagtcaggctttttttttttttttttttttagagcagccctcagaaccaggacaggttcagagactttatttattttttatttactattattattttgagacggagtcccgctctgtcgcccagtctggagtgccgtggttcaatctcggctcactacaacctccacctcccaggttcaagtgattctcctgccttagactccgagtagctgggattacaggcgagcaccaccacgcccggctaatgtatttttagtagagacgcggtttcgccatgttggccaggctggtctcgaactcctgacctcaggtgagagcaacgtagtactccactgtgcgtgcataccatgatttactttgcagtcccagatttacggtttccaatttataaatactgccattttcaccttcaagccccgatgccaaacacagaaataccaggccacccccaccccctcgccgtgtgcctcccacattttcacacacattttcaggagcccagggcgcagcctcacaccgaacgccgcctctgccgtcccctcacttgccccgtgcccccaccgcagggctgaaggcgacggaaccgagcctttgtacccccaccagccccgttccctggcgtctcccggccgccgggctcgcccgctcaaacgtggcggaacaaccggagccgggccccgccctgctggaagacagggcggaccgggcaaggcaggcgcggggcggggcggggcggggctccggctggcggggcgcggccagcgtgcagggctgggccagcgtgcggggctcctcccctttcctccggcggcgccggcggccgcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgagggccccgggcgcggccgggcgggtgtcggcggcctccggacccgggctgaggggcaaacggcgtctggcggtggcggggacgcggactccacccggcgcctccctcctggccgcgccgctccatttccgcagtgctggagctggtgacgtgggcactgcgagcggccgcggcctggccaggcccggtctgcggcccccgacccggccagtcttgcagctgagggccgtggcagccgtttgcgacgcccgattcaggaagtgtgtgacaggaggggaggcctagcgcagggccgccggggcccgactcacatgactgcaccccacccccagggccccttgcgttaggtctcttcgcggccccaggaaaaagaaggagggaaacctaggggagcagaaggtgttggggcccgggtcttggttcctgaccagtccaaccttcctccaccagcacgcatctatcaaggcctgggcaaggcgctttttggcgtgggacaggcagccgagaaagagaaaaggaaacctttaaaatatgtattttatatatatacatatatataaaatatgcttttttaacaccttcaactctcacgtcagaataagtcacatctcattacttgacggctggagaatccctttcggggttaggaaagcatgaacgagttctgtggacttttgccacgtgtgaactggggttatatagtaatgtaaagtcgttcagtgctctgggtgtgtacttaggtatgtgtatgttgaggacgctgatgttttagatatgtcaagtccggtgtcacaactgctaattttcaggtgagctcatgtccatgagctgaaagaaattcagttattctcacttaaaatgacgtcctagtatatttcacagaaaagtaaacagactcttcgtagatatttttaatacctgtgatttggcattactttgaatctaataataaacataaagattgtttagatgttgcaactattaatataccagagtctgatttcagtggttactcttgcacaactttggaccctttgcacaacttcggtcatgtaagcagcagtttgtagttgaactaatgatgtggcaggttctataagtaactaaagaagcatgttggccggacgcggtggctcacacctgtaatcccagcactttcggaggccgaggtgggggatcacctgagatcaggagttcgagacctgcttggccaacgtggtgaaaccccgtctctactaaaagtacaaaagttagccgggcgtcgtggcaggcgcctgtaatcccagccacttgggaggctgaggcgggaggatcacttgagcccggaaggtggagtttgcaaaaaaaaaaaaaaaaaaaaaaaaaaagcatatttattgctgcctgaaagaaaaaatttctgctagatacatgagttttcagcaaggttttctgatgcgtgcgtgcgtgtgtgtgtgtgtggaaattggatttgtaaactttaaaagaaaaatgctgtggtgtatttggaagaaggagaattctaaagtcttctggcaaaatttcatttaggctgtaaaaacaagattggagaggaatgccacattaactgtaatatgagtgggtttgagaaatagaagcttgtgactgtggcatttggctatctcattagtggtgaaaattcaaatcagactttgctggttgccttttttcagttttttatttgaggctgtactgtggataaataaagtattgtgcatggagtagtggggctacaaatcctaacaagttaatgctctgttctcttggaatttgctcttatccaaaagcagtccccacgcaattcaaagggaagacacttctttcttgtcattgctgctgatacgacctagttcaggaacagaattcttgacactgtatagtctgcagcagtacttctccctactccagttcagccagtgtagtttactgtcagtttagtcatcctgaagcatgaatgtcaaaaggctactcctgtttgctcacaatttttagtttgaccttcagtgaactctatattttagcccctatctacatttctcgccttctttcccgctattccccaccttgcttctgccattgagtcccagtgactgattttggtgtttttttcctgggcactgctagtctctattcttagagtgctttccggcacaatctctccctgtggaagatccatcagtccttcaaagtcttatctgagttttccgtaatgccttcacagtcaacatatattaagctcttattgtgtgaagattttcacagtatcctggctgaaagtgactactccgtttctgaatttatgtttctcactttgtgtcattcttctgatattgatcccagacttttctgttgtatagatacttgtataggcacctctattatgtaggtacctattatatacttcttgaagtcagaaaagatgttttgtatggctctgtatttctttcaggaagagcgtagtagaaggtaggccctgtatatttaattaataagagaggagccaaacaggctactatattcctgtttgtatatattaataacttaacagaagtggtgtcgttgttgttgttgttgttgcccagttctgccaccttcttgcttactaatttgggcaaaatcctttaccatatttctttaatgcagagtgtacccatagttgtaagatacactcagtgtggccctcccctagaaaagatgactttaaaatcagtaatgtgagatccactttgattttttaaaaagtcagggtcaaaaacatgcatcttagaatgaaggaaatcacctaatttttctgtttccctgtttccgtaacctataaccttctctcagtatgtgggataaaatgaggataaatgtgaaagtactttgatttctcaaaggaaaggaacaatgcacatttttccttttcagaattccctctttaatagaagaggttttaaaaacttttacatgatcatgatgatactattgagctgttttcttactgtaagactaaatgcagttaaaatgtagctttaaattttttccttgttcctgtcttgtttctgaatcatttagtaaaatgtgtcatttaaatctagatgtaaagtggaaagtggtttttaataagcagttaattatcaagcatggagagaaaaaatacgaatctatagtaatttttcttctgaaattctagcatctgccaaccattttaaccttatcactaaccctccctgctgctcaacgctcagcaaggtaaacaaaggcacaggtttggttgtgttcttatttctgctaatatctgaagcactccttcttgttcttccctatcaaaaaaagttatgtcaaaaatttttgtcacctggccaactcctttttatccattcttttgagagtttaacaaatcctaccactccctgttgcattttatgctggtcccctcctctcttccctcattctgtttcccttctcttcagtcccagtcccacttacattttattttttatttttcactcttatgtatatacccaccacttccattttattttattttacttatattatttatctatctattgagacatgatctctgttgcccaggcaggagtgcagtggcactatcacggctcactcactacagcttcagtctcctgggcctaagcaatcctcccacctaagtcttccaagtagctgggaacacaggcacatgccaccatgcctggctaatttttaaatttttgtagagatgggctctcactgtgttgctcaggctggtctcaaactcctgggcttaagccatcctcccacttcagcctcccaaagtgccagattacaagcacaagccacagctctcagccccacttgcattttaaattatctttttagttaggaaggtctttgcctttgtcttagatgccagggtacaccattgagtgtcagatttatttaatagttaagtggatggatccttgaggggaggcactaggtgatgtttcagctgaaattagaatgatgagtaggcaccgccagagtgggcatgggggaatgtctggtatgtagttgaaagtttatttctggctcaggagagagtaatctgggatagagacttgggagctaataacataaaatggagtccctattacctgagagttcattttctgagcttttgaaattacaaggttatgtagggaagaaaaattctcatgatatgaaaataattattaataagttatcaccttaaaaaattaactactcaagcttacttctaattcccatcctcctgattggcgtaggggcttgctgatcataatatagttcaaattagttgcaaagtgaaattatgtatcatgctaaaattgcaagcatttgtttcttttttttgagatggagttttgctcttgtcacccaggctggagtgcagtggcgccatctgggttcactgcaacctccacctcttaggttcaagcgattctcctgcctcagcctccccagtagctgggattacaggcgtctgcccccacgcccagctgatttttgtatttttagtagagatggagttttgccatgttggtctgactgggtctcgaactcctgacctcaggtggtccactcacctcggcctccttaagtgctgggattacaggtgtgagccaccgcggcaaggcagcatttgtttctttgatgcaagtgatttggagcattggttcacatgcaaaaccattgacaaatggggatctgacaaagttgtcctcctggaatgaagtaggtggtgattgttcattgaatgaattgacagatgaaagcttggatgtaatggtgggaaatactagtgttcatggggcacatggggaaagttatcagcatagtaggctaacaaggaataatcaaaagagcaagagagacctgggcagtacagtgtcatggaatctgcagagaaggcagatcccagagagggagtggttaccagtgtcatgtgcagtagaggtcagggactattggttgaaatggtaggaagacattagtgctttgacacagtgtttgattcagatgtcagtgagggggagaactaaggtgtattttcatttatgttgttaaaaaactgtggatttttatatatgtgtaaataaaaaaagtcccaagactacacacttaaccgttacttctggggaggagagtagaattatatgcttatattgattacactgaaagagttggtgttggtgaaatggggctttttatattgtagggtcctcctactttcttttttaaaaaaaaatttaaacaatatcacacatagtattggtggttttacaaaaagagttattgggaagttacaagtagaaccatgcatgggttattttattgaagaataaatgtgagtgtgtgtttgtattttaagataggagagacttgaggttgaaaggttaaatacaagagaaggggaggtaaggagcaaagttgtagaggatttggggaaggattggggaaggaaggggattagattctcaatagctctagagaaaaacagaaggaagacctcttcctgtgggagactcaaatttgagtttctttagattcttgtgaatcactggagtgtttgtttaaaaaaaaaaatattcagcagcccaacccctagagattttgattgactagatttgaggtggagctgaatgttgcaaaacctgcggccagaagtactagtcattttattttattatataagcagatttgttagaattaccttcaaaaaacaacctgggaagttcagaggtagaaaaattctattaaagcttttttattgagatgtagcatgcatataaaagaatatataaaatacatatacacagtttaatagttttaaagaataatgataaacacccatgcaaaaggactccacattctttttctttttttttttttcttgagacagtctcgctgtcacccaggctggagtgcagtggcgcaatctcagctcactgcaacttctgcctcctggattcacgccattctcctgcctcagcctcccgaatagctgggactacaggcgcccgccaccacgcccggctaattttttgtatttttagtgaagacgggctttcactgtgttagccaggattgtcttgatctcctgacctcgtgatccgcccgcctctgcctcccaaaatgctgggattacaggcatgagccaccacgcccggccaaggactccacattcttacatatgtctctttctcaaccagttttccactggcctgaattttatattaatcctcccctgcttttcttcatagttgtatcacttatggattcctaaactgtattatttagttttgcccatttttagatgtgcttagctgtttcatttatcaaatgagagctgaaacatatcttttaacatcatttacaatttagatgatatacttttgttaaccttcatttttttttttttttttgagacaagtctcgctttgtcgcccaggctagagtgcagtggcgcgatctcggctcactgcaagctccgtctcccgggttcacaccattctcctgcctcagcctcccaagtagctgggactacaggcgcccatgaccatgcctggctaattttttgtgtttttagtagagacggggtttcaccatgttagccaggatagtctcgatctcctgacctcgtgatccgcctgcctcggcctccaaatttttgctttatatatattattggtagtctttcaggatttttgactagctcttttctgtctgttttctaacccagtttatttactacttcctccccctaatatttataccgtgcctgagactttatagtgaatcatagaggctattgtccctgttgttctcattcctttttacctttcttaaactcctctggtgactctccctactcatcttctcaattggtgttctgtcctttctgtcccatgccattcctgtccagcatgaaagtttctcttttatctccccaactgcttccctccttcattttaattcttcagctctcctcctcttgcagtagccagtcagtttgatgttttatttgagcagaccctaattttgccatctcagctgtttttccctttccttctggcccagctgtgcttacttcatttgttattctctgctcactttagtctatgaggctgtgtcctttgctacaaaagatgcagccatatgcagacctctcttgtccctctcctaactttacattttctaaaagaaactgtcccatttgatttcattagccttgattatttgcaagttttaaaatactctagttttagctgttacttttcacttgtaagtaagagatccctggcaaaaaggttctagattctctctcctgtaatgcacacatagtagcccccttttaatttctgcagtgtttcttaactcaaactattaatatttggttctcatccatggaaatgctgttttagtcactctccggggagtcccagacatcagtatttttaaaaagtattgtttgtattgatggtagtactgtaacattccactgctggtaagccatgggccttttttgcttatttttctaaaattgattcttctttttctgctgccaagttttctgctttgggggattttatttaatccctaaggtgtagccagactgaatttgtatggaattctccatcacattagcttttggcattgtggtctgtatagcagattctcatgagtaatcctccacactttttatagttcctacaccatatcaaaagcttattatctgttaattcttcaacagatacatgagattactgttttacagatggagaaactgagttgtgtcatttggggcaaattatcttagtagatggttgatctggtttggctctgtgtcccactcgaatctcatctcaaattttaatttctgtagtccccacgtgttgagggagggatcccatggaaggtgattggatcatggggtcagtttcccccatgctgatctggtgatagtgagtgctcatgagatctgatggttttataagtgtttgacagttcctcattcatactctgtttttctcctgccgccacgtaatatgtgcctgcttccccttctgccatgattataagttttctgaggcctccccagccatgcagaactgtgagtcaattaagcctctttataaattacccagtctcgggtagtatctttatagcagtgtgaaaacgaacgaatacagtggtagaacaaagatctaggggtgtctgactccacgggccattctcttgattacagggtggtctggctccattcccctttgctctttctttccccatatcttctgagtttttacttttcatagccataatgtagctttaggtttctcccagttctcactttaaaatattctcattttcaggtatagctgagagtcactgtgtttttagccaaatctaagggagaaaatgaatattgatagcagcatgctgtagccagctccttaaaggaaggatggtgcctggtacagagttagagttagtgcttcagtaaataatgaatgtgtgctaggtaggttctgctgggtaggctgcatgcattgaccaatttattcctccttgtttcaaaacaggatttaagggcacttatatatatatattttttagtttttttaatgtaaatgagagaataaagatatatatatatgtctatatatgtatatatgtatatatatgtctatatgtctatatgtatatatgtctatatgtatatatgtgtgtgtgtacatatatatatatatatatatatatatatatatatataagttttctgttgctagcataacaaactaccagaaacttagcaactgaaacaacatgaatttatcttacggttctatagttcagaagtctaacgtgtcactgggatgaaatccaggtttcaacaggactgggttcccttctagctcattcagctacctggctcattcaggttgttggcagaatatacttccatgaaactgtagggctgagaccccgtttccttcctggctatcatctgagagcttttcccgacttctagagtccacccacctacccacatcccttggcccatggcccccttcctccatcttcacaaccaacaacagtgggtcacgtccttcttgtgtctcatctttcttgttgggccatcccaagtctctctgttttaggaaaggttttccacttttaaggactcatgtgattagattgggcttacctggataatacatgctaatctccccatctcaaggtctaatcttaatcaaatctacaaaatcccctttgccatgctagggtaaaatattcacaggttctggggattaggatgttaatatcttttggagggcatttttccgcttaccataaaggcctgcattagtccattctcacactgctataaagaactacctgaggccaggcatgatggttcacgcctgtaatcctagcactttggaggctgaggcgggtggattgcttgcgctgaggagttcgagaccagcctgggcaacacggtgaaaccccatctctactaaaatacaaaaaattagccaggcgtggcggcatgcgcctgtaatcccagctacttgggaggctgagatgagagcatcatttgaacccgggagggagaggttgcagtgagctgagatggcaccattgcactccagcctgggcgacagtgcgagactccatctcaaaaaaaaaaaaaaaaaagaagtacttgggactggggaatttatgaagaaaaagaggtttaattaactcacaattccacaggctgtaaaggaagcatggctgggaggccttaggaaacttataatcatggcagaaggtgaaggggaagcaagcacatctagccatgtcagaccaggaaagagagagtgaagggggaagtgctacacacttttaagcaaccagatctcgtgagaactcactgtcactgagaacagcaaggggaggaatccacctctgtgacccaatcagctcccaccaggcccctcccccaacattggaaattacaatttgatgtgagatttgggtggagacacagagccagacaatttcaagggctaaggagcaaatggtagaaacagtaaaataagatcagaagaggtttaattgactcacagttctggagagctggagaggcctcaggaaaattacaatcatggcagaaggcaaaggggaagcaggcaccttcttcacaaggcggcaggagagggacaatggaggaagggccatgccttattaaacaaccagattggccactcccctagcatgtggggattacaattccagatgagattttcatggggacacagagccaaaccatatcaggacatttatactcaaagtctatgatatgaggtggtgtagacttctttgaagtggtcactgaatttagcactaaccagtgcaaaaagacaaccctgctcatttaccctaatcatagtatccattattttttttttgaagtatgttcatgtatatacttagtaactgctgacattgagaatcttgaaagaagctttgcttctgattcctcttaaaaataatacagtatagcgagtgtaaatatacaactgcttttatagggcattttctctagaggcataactcattgaatctatgaggaagacaccattttataggtgaggaaagggacactggttatcacatacagtctttttgtatacagctagtaactgaccaatatggaacatgaacccaggtttttcggactccaaagttcatgctctcttccccatattacagttcctgattcccataaatttcacatcagacctcttctgttggcttactgtttggtctgttaagtttctgtgagagtacatagccttcaattcccttaaataggtaggacctccattcatgcataatagtgcagaactatcctatataaaagtaggataaagtactttctctgctatttaccagccatgtgactatgggcaacccatttgatctttctgagtctttgtgtcgttatctataaaatgggaatgaataaatgatatcatatgtgtaacagtgacttgaataacaaatgattatatcttttttatcctgcttctttgaatgttacaataatttccccatatgcatttgaaaaattcacccaaatctgaccagtgctgtatagtgtctaatgctaataatagcaaaaacataattttttttgccctctgtgtgttctaatatgttgatcgtcccactgtcccccacttagcttgcttgtttttgaccagctgctacaagaataacaagcatgttatccttgattctaattgttttttttcctaccctgtgttggcgtttttatttgtttgcatcaagttgttttatggcaagtttcttatgttatcaagattccttttatttcagatatctatatttttggcagctttgcttaatttagagtgattggccatccaagtccacttatgatttatcttgtttaagagatgaggtctcactatgttgcctaggctggtctgtcaaactcctggcctcaagtgatcctcccgcctcagccccccgaaagtgctgggattacaggtgtgagttactgtgcttggctcctggtaatgatttaaaagactcggtaggattttgttctgtgaaggaacagaaacgcactccagctagctcaagaaaagagatttatgataagaatttaaagagggcttatagtaatccaagtaaaacagtgtaacagatcttgggcaattggctactctgaagtttttgttttcttctcatggcttctctcttgacccattaagcatgtttcttttttttttctttgtctttttcttcttttttaaaaaatcttttcattattgatttctgactttattacacttagagactgtaggctatatgtactgattcttcagtgtgtgagactaattttgtagccgagtacttgattggtttttgtacatgttccatatgtgcttgaaaatattcttgtgtgtgtagtgagttcaggtttccgtacatgtctgttagatcagacttgatattagcgtggattatatcttctatatagtcttttgtctacttcttttttgacctttggggagagatgttaaaatctcatattgtgacaatggatttttcttgttcttctgtcagattatttctcccctccccgcgtgaatttgggggctaatttgtaaggtatttatgacccatacatcttacggaggagttactccgttgtcattaggtttcccttcatttgtttcttagtatggttttttgaattcaggtatttgatattaattttgcatatttggttcatacttgctttgtttaggaagtaaacattacacttgactctgaaacttttttgctcattactttgggggtttatctatattaatacatttcattctattttattgatattaattgcttgattatgttctgttgtttgactatactgcagttttctccattctttcacttatggacatcttaaagttgtttattttgttgtaaaagatgatactccatagattattcttgtgcctgcctccttgagctgggtgctagagttttagaaataaatcttgcagcggatttgtgggtggaaggtgtatacatctttggctttaccagcatatctaaatctctctccaaagtaatcagttgactcattctggttctgtgtcaccttttttttgagacagggtcttgctctgtcacccaggctggagtgcaatagcattatcatgacttgcagcctctgcctcctgggctcaagggatcctcccagcgtaggctcccaagtagctgaggtcacaggcacatgccaccacacctggctaatttttttttcttttttttttttttttttgagagagagagagtctcgctctgtcacccaggctggagtgcagtgacacagtcttggctcactgcaacctctgcctcctggtttcaagccgttctgcctcagcctctcaagtagctgggattacaggcacacaccaacacacctggctactttttgtgtttttagcagagacagggtttcagcgcgttggccaggctagtttcaaactcctgacctcacgtgatctgcccacctcaacctctcaaagtgctgggattactaatgtgagcccccatgcctggctgctcctggctgatttttaaattttctgcagaaatgggtcttgccatgtttcccaggctggtctccaactcctgggctcaggtgatcctcccacctcggccttccaaagtgttggattacaatatgaaccaccatgcccagccctttatcaccttttttttaaaaaaggcctattttttaatgtagcccatttctatatttttaaaaatttcaatctaggagtctgtattttaacaggagaatttaatgtttttatatgtattgtaatcactgatggatttgggtttatttctactatcaagtaccaccctggttcagtcatatagacaaagatcaaggtgtagatcacaggcatgcccacttgtcatgggcttttgggtttagacgggcacatgtcttggcacaggaaacaatgtggtagattttccaagcatgtataggtcacctattccttgcaggccagtagagagattactgaagagaagatacctgccactaacttactagtgcacatgaacaattaatttaaattctgaaattttctgtttctaaaacaggtatagtacctgcctagtgcaccctatagggttattcaccaagactcagggttttgttttgtttttttcccctagctttacagctgtctttaaaatttaagtgtcagtcatgtgtttccttcatttatttacagttgatatatcagtgtcagtggtgtattcatgcttgctctgctgccccagcattattaaaattgatggatgacccttttgcatttgtccttctttagaaatagctactatgtagtcctcgctggttattttagcttagacaccactcttgaaaattttccgagagcctggtatttgtaattagcatatctcgattaatgtggtgtctgtactgtttacttgtgacctcagtaaagttcatacctcttcagttttagttttctcatctggaaaaaccaatagcaatgcctggattatctatacctcacaggatttttgtgagcttaaagtaaataatatgtgaaggtaaggtgccttgtaagctgcaaagtgctttattaatagtaataccttagagataatgtttcctatctgttgagcatcctaaaatttagtggggttggtcttgcctatagaaaaaagctgttcactgtgctgatcatgtgttaaccacaaaatggctctccttgattctattgtcctccatgactcaataaaagaaagttcttttccatctcagatgtcttcatagtccacttgagattgagaagaatatcaaggaggtactgtttttcactagtcttcagggaagagaagggaaggccagtagtcatcttctaccttgattttttttttttttttttttttaacacggattttcgctcttgttgcccaggctatactacaatggcgtgatcttggctcactgcaacctctgcctcctgggttcaagcgattctcctgccacaccctcccgagtagctgggattacaggcgcgcactgccacgcccaactaatttttttgtatttttagtagagacagggtttcaccatgttggtcaagctggcttcgaactcctgacctcaggtgatccactcgccttggcctcccaaagtgctgggattacaggcatgagccaccgtgcccagcctaccttgatttcttctacactcactcttagtattttgtggtaccacttgaatgatttcagtcaattttgaacccctttggaaagaggtggttttgtagctctatagaagtctttgatataaataaatctgttagtcagtggttatcttctttctttggataaagtattgttagttcagttttaactgtgtcaaagggaaagtaaaagtatatgtgtcccaaattatttatgctcaaggctttacttgacacaaaaattaataaatagctaaaaagtaataaattaaagcaataataatgtatgcccgatgaattgagtcaccagtcctctatgtaaaggtatttgttatacttgctcaggataaacttgggtgtgtgttgaagaaattctactggtttcatagctacgtggattttttttttccaagatgaagtcttgctctgttccccagggtggagtgcagtggcatagtctcagctcactgcaacctctgtctcccgggctcaagtgatcctcccacctcagcctcctgagtagctgggactacaagtgcatgccagcacagccggctatttttgtattttttgtagagacaaggtttcactttgttgcctaggctggtctcaaattcccgggctcaagcaatctgtccatcttggcctccccaagtgctgggattacatacatgagccactgcactcagccagctacatgaattttcaaccggtttaagaactgtatccataaaggactgccatgtaggcaagcgggaaggagcatgctgctatgtgcagtcctggatttttgacttctgatattagcaacaacttggacacagtccaatttggttgaaagagctaatatgtaatttggattttaactgacagaatccaaaatgaccttggtaggcagaatgattggccaaattttagcaaaattgtattacataaaaatgaagttaaaacccagtatttgcttgtaaaataaccgtacaaatactaaatggaggtcagctggttcaatatccacacatgtctaaaaacttagttttacattacttgattcatatgagtcagataagtaataaagcgaacaaaagaataaatgtgatgctagattagtgaaagtatagtgtatggataaggcaggttctaccctgtcagacctcaactgcaattcagttctgaaactcttgttttaaaggaatatctacaaacaggagcccgtgctcaggagaccagtaatgctgatatgaaggctataacattcatgacattttaggaatggttgagtatctgaaccattttaacctaaaaaagaagacttaaaggagaatataataatgactttcagatacttaggtgactgacatatgaaagagggactcataccaggaccgtgagtagaagacatacagttggactcttcataaaatggaaagagcttgttcactggtaagttaatttgtgctggagtaggaatttgattgacacatatgaaggcttggaagatggagtttatgcaaaggatagagatttgcagttgattttttttcttcctaaagaaatataagatactattgtgggccaggcatggtggcttacatctgtaatcccagcattttaggaggccaaggtgggtggatagcttgagatcaggagttcaagaccagcctggccaacatggcgaaattccatctctactaaaatacaaaaattagctgggcgtggtggtgggtgcctgtaatcccagctacccgggagactgaggcaggagaatcgcttgaaggcggaggttgcagtgagctgggatcgcaccactatactccagcctgggcgacagagcaagactctgtctcaaaaacaaaacaaaacaatagcaacaacaacaacaacaaaaagatactattgtgggcagtccctgtgctggagttcgaaaaatgaagactgtcccaccctacagagaagaccaatttgccacaataactataagaaaatgtaataaaaatatgtacgaagttctaaaggtgtgtggacagggtactttctaactggagtgaatggcttataacagatttcagattgtcagtaaacctttattgagcacctgcttactgtatgccagtactatgttgtgacattcatatatgttctcgcggtaatcttagtaggtagctgctaaccccgttttccaaatgaaaaatcagtaaccagatgtggtggaatgtgcctgtagtcctagctactaggaaggctgaggtaggaggattgcttgaggctaggaattcagggctgcagtgtaccatgatcactgatgcctgtgaatagccactgccctccagcctgggcagtgtagtaaaattctgtctctttaaaataaaacataaataacaaatgaaaaatcaggtgataggtacagacttggtataacttatttgaataattgtccacctaatcagtagaatcagtttctgcttttgccccatctttatattatgtgagaaatactgagttgggctgctaacacttattttgccaagaaggtttgatgactttataccaggagtgatgtacaaaatgtggcagtaaagggttttcatcagaactgggggaaagggagatgatgattaacactaaggaatcttgggaccacactgtgaagaccattgtgtgacatagtttaagggattgcttaaccctctggatatctgcattaaggagccttattcccttccccattctctaagtggggcagatttctacccttaactcagatatttgtacaataataagcctcattcaccatttaacctttttttttttcttgcttggcctttccccctatcctttctggcttaaagtttcatttcttggagaatttgtaggagaaatagaaaaatcatgttggacttaagtgtcactatgtgaattttcagccgtagccatgaataaatcttattaaaaagtactactgagtagtattcttaagagatttttagacacaggtaggagaaagaaatcaaaattgtctgtttcacagtgcattattttacttgcaggctttcttgtaattttcttatcagattgacatttaaagtagctatatttggtcacagtagaagttttgctggttatttaagtgcagtgtcactatggaggtagttgaatgaagtcaataaaagtactgcttacatagcattgatgaaagttcctctttacactttacatatgtaagcaagcatggtaaacagtggcttacgtatccttccagaaattttctgtacctctataagcctgtgtgtgtgtacatgtgtcccaattctaccagtaggattatacaatcactactgttctacaactttatttttttcatttgagggtaaatcttgagtgtctttctgtatcaccacatataaatctctcattttttaaaaactctcataactgaactaccatttgtcagcttctgattctgttagttgaggtctgtggtagcaaataacagaaaccaactctggttaatgtaaacagaagatttgattggaaatattggatggttcacagacaggaaagcagtaaaatcaagtttgaaaatgggcaaaatgaaggaaggcaaggcacagccaaattgctgttatcaatacggcctgcttgagaagatgctggatgcataccactggcctctactgctctctcatctccactgtagccaccatgtattgtctcttgatggtccttgatattgcagcactttttcaagattctaagttctagataggagtatctgattggctcagtctaggacacctgtctccctgccctagctgctagggagctcaaagaagagtgctctgatgctaggtagccagaaacagcaaatgtccacctactcctgctttgatgaatatcgttatagataatattgctgttagccttcttgtgcgtttgtgcaagaagtaaaattcctgggtcaactggtatttacattttgcattttgataggtactgccaaattaccatccattaaaagtatgaatttagaaagaatatttaattttgactttggtatatatttcaggtacttacaattcaacaggctaaccaacattaattgtgtatattaactgatgcctagtctatgggaatttagcagtttgattttgttactgttaatacattatttctttggctcttgttaatttaatctgtcaattgcacaagagtttttctgcttacagcctttgattttgatacaaaccatttgtattataatatacgacttagagatcatgtacagtaaatttattagataattatattttacatttacatccagtttgatatatactatcatgaaaaagttttctcttcaagcaactttattgaaatatatttctgaaatactgcagttcttatttggaatttttagttatgaaaggattagtaaaatggtcagattaaagtgtgttaagatacatgacttatctatgtgacctacttggaacactattatttgggataaactcagcatagtgcaaatagtattcttttaaaaacatttctctttattagatttctgcagtgtcaggatcatttcacttatagaatgttcctttcatccctagaattgctagttggaaagtgaggtaacattctttttggttagcaaatgtattgattacaaatggcagtatgtatctgagaaagaacaaattcaggaggttgagtggcgcagtgggggaagaaaatatgattcagaatcaaaaaacttgattttgagtttctgcctcttattatttatgttaaagtgccaacaaatgattcagtcagatttttcctttcatctctgtcctcgtaaatatcaattaaaagagaatagaagtgttccagattcttcccagtttatttattttaccatcattactagcaaaaatgtagatgagatcttttgttgtatatgagttggattagacactacacagtaatttctaggttttttataagccacagtataaggtatattttacattgcaatctaggattcatgtgtgtaaatgcatatatatctctaaaacaaaaatttctaagtgttcttattctaatcgtataaatattttgttataattttttttttggaaacagagttttgctcttgttgcctgggctggagtctaatggcgtgctctcagctcactgcaacctctgcctcccgggttcaagtgattctcgtgccccagcctcccaagtagctgggattagaggcatgtgctaccacgcccagctaattttgtgtttttagtagagatggggtttttcaccatgttggtcaggctggtctcaaacttgtaacctcaggtaatccacccgcctcgaccttccaaagtgcagggattacaggcgtgagccaccacacctcacccatctaattcttttgtaatgctagttccaatccactaaattggtttcatgacctaactagttatggcttactgtctaaaaaacatcacaccagaggacctctctagttccaacaaaaccgacatcctacaattctaagaggtatttataactgttttcttttttattttattttattttatttattttcaggtagagtctcactctgttgcccagtgggagtgcagtggctcactgcagccttgacctccctggctcaagcaatcctcctgcctcagcctcctgagtagttgggactgcaggtgcacacaaccatggctggctaatttttgattttttgtagagacaggatctcactaggtggccccaactggtgtcaaactcctggcctcaagcagtcctcccacctcagcctcccagtgctgggattacaagcatgagctaccatgcctggccgtatagcccagttttattcttcctgatttttcttaaacattctagccgttttccactattaagataaactagtgaggaaagttccatgagttgggaggaagaaaggaatagggatgccatttttgccgcattcttacttgctattagatttaatacctctgtaacttattccctaataaaattatcaaatgctgtattttccaactttttaagatttaaatcatatctagctttgtatttgcaaaaatactgcacttgaagacaaactatgtctttcctaagaaaatttaaattctacctatattcaaataccctcaactttaccaaattaaatttggcttatctaatgaaggatacgttattcatgctagttgtatcattgggagttcaattaggaaacataaactacacaggaatttgaacagagaaagtctaatgtaaacagtccttaactgtaacgtagaattagagtaatgggagaattggctaagaggtagaaagaactctgaagactgtggtaacagcagatagggtagtagtcactacctctaaggctatgcagagcatggaaggaaggacagatctgacattcaaacctcattggaggggcatggctgaggcctactggatgtcagagacattaactaaggggctgaaatgggctggacagctgccctctttgtgctcagcttctatggtgtgtgtgtggcctgagaactccatgaaaagcaacctgaaggagtgctgggggcagatggccatagaggggtgctgagtgctgatgaagctgtcatgccctgtgccctaccaaggtagaaaggtttcagtctcacttgaaggacagtgaagggtggatttggagcaagaaggcagtcaattgaaaactggcacatgagagtactcactaccttttgaaaggaaaataacacttaagtttggggcagataatgatacagatacaattctaatttaatgcagtcatattttcattctctagcgtcatttccccatctgaaaaatccactgttgaataaaattttgttttagaaattgatagtttttttttcttgagatgtaggctagagttgtttgatagaatagtctattactttgtgatctttccagtgagcatgagatgcattaattcattccctgagcatctgcttttaagccagtccactgtgcaaggtcgttttcaaaatacagaaaggcaaatgttactgctcctgaggagtaaagctagatatataaactgataataaaagtaccatgtgataagtgcttaatcaagtatgtacgtatagagtaatttggccttagcagataaagtgagcttgtcttcaggtactgggaaaggaaaaagaagtgatttttcctagatgcattatctcttttattacatattatctcttttatttctcacaatagccaatgaataaggtggtataattaccattacacaaataagcaaacaaggcctagaaacctgaagcaactttttcaatcagcatcatacacaggattcaaatctagcccagtaaatatttgttatctcttaaactggtcgtgtactttgaaatgaagaaggcataagttcaccaaatataaaacgtaggactaaatgcaattgtgaaggatttaaaaagtagatttgatgcatccttgcccttatgaggtttatagtctagctgtgcttgtagaatataataagggctctgactgaggaactggaagaaagtatggcattttgtaagagggggaatgcgtttttcctccttcttggaaaatcatagggtacaataacatttgaactggttctgacaagtagaaatggtaaaaaatcaaaatataaaaataggagtaaacaggaaggtagttgtctgctaagttccacaccttgtactgtccttgatatgaacggtccagtttaactttagtatggaccctgtgtcaggctgttatgagaaataaggctggaaagataaatccattaaacatggtggacctagggaggtacatgtgacaggttaaggtagagtttgaactctattttgtagacagtggaatgcattgaagtttttgaaagaaagagtatacaactagaattataattaactttaaaaccaaatacagtatatattcatattttaatatagtagcgtagacatactagatgttaaatgtaatccttttcttctgtctcatccattctctttttgtctttttctcatccattcctggtgcagtcatacgtagaatagattagaagggtacgggtatatagttagatggtaattaaaatgttccagagaagaggttcctagaggccttgtctaaggcagtggtaatgaaaataaaaggaggttacagatgagagctggaattatcagggtttagtgaaggatatcatagggagtgaaaagtgttaaaaatgaagatcattttcagacacttttccatttctgaaaagtgtatacttcaaatactgcctgcctgcctccctccctccctttcttctttttgagacagtctctctccgtcgctcaggctgaagtgcaatggcgcaatcttggctcactgcaacttctgcctcacaggtttaagcgattcccgtgcctcagcctctcaagtagctgggattacaggcatgtgccaccacgcctggctaattttgttacatttttagtagagttgggctttccccatgttggccaggctggcctggaacttctgacctcaagtgatctgcccaccttggccttccaaagtgctgggattacaagtgtgagccaccgtgcccagcccattttttttatataagagtaatgcctacacatggtaatgttaaaacaatatggaagggcagaagattggatatggtgatgagagatgacattatataagacacaatgggtaaaaagcttttccttatgtgaaaactctggggcagaagtcaactcttctagtgtgggctgtgcatagtaatttccttcccaagaatacagtatggaaaagagggggaaagttcctttccattggagaagcctgacagactaccttagccaggttatgaaggttaaagtcaacagtgatcagtcacattgatagtatgtacccttgatatgatgtgatgaaaatggtattctttctctgtcatcttccttccaaacacttataatcccagtctaatcatgaaaaaattagacaaatttcaacacagggcatgttacaaaatacctaatcagtactcaaaactgtcaagaacatcaaaaaaggaaagcatgagaaactgttacaaccaagaggaaccttaaagaaggcctgacaattaaatgtaatatggtttcttagatgtgatcctgagacaacaaaaggacatgaggtaaaaactaagggaaaaaattagaactttaagggagttaaaggtaaagagattttataaagagtgcaggataaagaataatcccagcactttgggaggcagtcagatcacctgaagtcaggagttccagatcagcctggccaacatgatgaaaccccatctctactaaaaatacaaaaattagccaggcgtggtggcaggcacctgtaatcccagctactcagcaggctgaggcaggagaagtgcttgaacccaggaggcagaggttgcagtgagctaagatcacactattgcactccagactgggcgacgagcacaactccattaaccattgtgtaaccagttaaggtgcttagtaagtagttgctgaatatatcatattattacagttcttcataagtctatttttaaggtctaggccttcagtgaggcctacttcatctagtggttgaaacacaggtctagatttggtttcctggagtccacgtcacacccaagctgagcgagataatcacagaaacttgtcagtgttctttctcttctagcattgacaacagaggctattgtgtttttcccctgaaaccagacagttaaataaattattttatacattcacaggcagaaaatgttcatctttgaaaaaatcaaatgtggcctggagcagcaccctcccctacctcaccaaaaataaaaatcaggaaaaaatttttaataaaaatcaggagaatacaaaggaagatacttctacctttgtaaagagaggtgtgtcttatggaaagcttcctagaggatatgacacttgagttaagtcttaaagatgagtagctgagtagacaaaagaagtcgctggttattagagaaagaacactgaataggctgggtgcagtggctcatgcctgtaatcccagcactttgggagaccaagtcaggcagatcacgaggtcaggagatcgagaccattgtggctaacacggtgaaaccccatctctactaaaaatacaaaaaattagccaggcgtggtggcatgtgcctgtagtcccagctacttgggagctgaggcaggagaatcgcttgaacctgggaggcagaggttgcagtgagtgtcgagatcgcgccactgtactcctgcctgacgacagagtgagaatccgtcaaaaaaaaaagaaagaacacttaataaatgtatgcagaggcccaatgtgtaagagatactgacatataggaacataggctttcagctgagtttatatctcatttactcatttttgtgattttggtctcatcccagaagtgttttaatattgggggtactttaatattgtaaaagaaagaaacagaaatagtagtagatgattgcatcaagggaaagagggtagagggttagttcttcatattgtccatttctttttttaattgattctttagcaactctcagctttgttagcgtacttttttctgcactttgcagtttccaggagaaagatcttttacattctgaaagccacatcctcttgggaactttatttttattaccaaacttgatgcctggaatatagtaggcatgcattcaattaatattctttgaataactatctcttctcttccctcctagctttcactgggcagccttctcaaataaatgctctgtattcccaattttcttttcccacaccactcaatatttcttgtgtttgagtaacttactgattgcactaggaattattatagacagaatcaacaagactgggaaactaacaacgtaagagtcttaagaggaatgaaagatgactcttgattagtgtattaggtttttagggccactgtgacagcttacgagcttggtggcttaaaatcacagaaagttgttctgtcacatttctggaggccagaagcctgatattaggtgtgttctctcagaaggctccagggagaatcctgccttacctcttccagcttgtggtggctccaagcgttcattggcttctggcagcagaactgtactctctatccctgtcttcattcacttaactgtactctctatccctgtcttcattcacttaactgtactctctatccctgtcttcattcactttgctttctcccctgtgtctttgtctccttctgcctttctcctaggacacttgtcattggatttaggccccaccctaaatccaggatccttaattacatctgcaaagatcctttttccaaataaagtcacattcatggttctagggtcaggacttggacatatcttttggggggccattatctattcaatttactacagtaaaccgccagagagtatgtagctgatgaaatggaggttattctcttggatgcaaggggataatgtacggcgaaccaacagcatgaaaacaattccgaaatcgttctatttagaaagagagtgatagctgggcacagtggctcatgcctgtaatcccagcactttgggaggctaaggcaggtggatcacctgaggtcaggagttcggttcaagaccagcttggccagtatggtgaaaccccgtctctactaaaaatacgaaaattagccagtcatgttggcgggtgcctgtaatcccagctactcaggaggctgaagcaggagaatcacttgaactcggtgggtggaggttgcagtgagccgagattgcgccactgcactccagcctgggtgacagagtgagactccgtctcaaaaaaaaaaaaaaaaaaaagtgataaattgcaaatattttcaattctttttttttttttctcactgttgcccaggctgaagtgtagtggcgtgatctcggcttactgcagcctccgcctcctggattcaagctatttcggctaatttttatatttttagtagagacagggtttcaccatattggccaggctggtctcgaactccggacctcaagtgatctgcccacctcagcctcccaaagtgctaggattacaggcgtgagccaccacgcccagcccaattcattttttaaaatatatatttaagttttttaacttggtcaggtgagtttagttggagataatgctctcttagctgtattcatcttgaagaatcctcagtttaacatttgtattaaaactttaaatttgcaaaatgctaccacattttatcatttgagcctcatgacattcctctgaagtaggaatgctattttttttccctagtgccttttttttttttttttttttaaaatagagatggggtctcagtatgttgcccaggctggtctttaaactccttgcctcaagtgattctcccacctccacctcccaaagtgctgggattataggtgtgagcccctggcctgtattttcattttgcaattttatacatgtggaagtggagctcagtctccataactaacttgcttgaggtcacaggttatgaaattatccagatggatttgaacactggtgttaaaactgtaaagcctgttgtttattaattttctgtttgaaaagggcagactttattttttcatgtttcacggtttttcagtttgtaatgtaattacaaaatggctagtttttttgtatttttggtagagacagggtttcaccatattgcccaggctggttttgaactcctgagctcaagcagtccgcctgccacggcctcccaaggtactgggattacaggcgtgagccaccatgcctgacttgcgttttcacatattttaaattaaagctgtttggcttgtggttgtaaaaatagaatcatcactaatattgacgaatcctgcaattagtgggaagttggtttaggacaaggaaaatgaactccagtagaatacccagcacctactcgtatttcttgtgaaggactctttgccttaaaatgaccagaggacttaattagattcttgggccccacgaaagacgtgctaagtctctgggatggggcttcaggaatctgccttttttttaatttttatttttggagataaggtttcacactgtcacccaggctgtagtgcagtgggacgataacatctcagcctcctgaactcaggtgatcctccctcctcatcttccaagtagctgagactactgccatgcaccaccatacccagcttattttttgtagaggtgccatgttgcccaggctggtcacgaactcctgggctcaagcagtcactcctcctgccttggcttcccgaagcactgggttataggtgtgagccatcacacccggcaaggaatctgcatttttaatgggtactacttataattgttacctcattgacttggtatttaaatattcagctctcacaatggtgtcctactgagggacagtgactccgaccctgagtaaaggaagaaggtaaggtattggtagcaactctaatagcagcattaataagtgtagtgatttgtattaattacagagtggtaatgatctgtgtatatccaagatatccacaccaggccttaaaaaacaatgttttgcacatcattaaacaaatattcattaaacaaattcattattcattaaacaaatattcattattcattaaattattaaattattcatttttcattaaatatttcatgaatactagctcaacagatcattctaggtgctttggaggatgaaaagatgaataggaatacagatcttgccctgaaagaactttgtttataaatgttgtaaaaacaggcatttaaataactgtagtgtaagataaaagttagtacatagtaattgtcatttcagagataacatattctgaagtccattaagggaaagatcacatccagagaaatactagaagaggtggagggtgtgcatggctttctgtttgtttaggaaaacaagtaaataactctccaaagtctcagggtaattctttgtgttggactttttcttttttcttaagccttctcaaacctatcaggtttaagattctagttagtgatatttcctacttgcgatagctgagaaaatttgaggtgcaagacttgaccaaccttctcttgagtgtgttcgaggatgggagacttgaatgcatgtgtcaaaagatgtccatggagaagcaggtaataaagatgcaagaaaaacgagttgctagatctccaaacagggagagagggctgagatctagttttggttggtaaaggaatatagtacttctctagcattaaagaaaggataaactacatggacatctagaggaaacttcaagtgaagaagtgatccatgttggatttttgtctttgtttgtttaattaaataataatactgttaagtttttacatagtgcttcctacatgttttcagtgctttatataggttaactggtttaattctcacaactcttgttgtgaagtatgtattgttcttatcctcattttgaaaatgattgcgtgcaaaggccaagtagtttttccaaaatcacccaggtagtgcttttaaccactacacaatgctgacagttcaatcagcatctctggaggtgtgaggcctgagcatcagtttgggttgctttttgtttttgttttttgggtcttttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagaacacagggttgggggtaaggtcaccgatcaacaggatcccaaggcagaagaatttttcttagtacagaacaaaaggaaaagtctcccctgtctacctctttctacacagacatggcaaccatccgatttctcaatcttttccccacctttcccccctttctattccacaaaaccgccattgtcatcatggcccgttctcaatgagctgttggctatacctcccagacggggtggtggccgggcagaggggctcctcacttcccagtaggcgcggccgggcagaggcgcccctcacctcccggacagggcagctggccggacggggggctgactccccccacctccctcctggatggggcggctggctgggcagaggggctcctcacttcccagtaggggcggccgggcagaggcgcccctcacctcccggacggggcggctggccaggcggggggctaacccccccacctccctcccggacggggcggctggccgggcggggggggctgacccccccacctccctcccggacggggcggctggccaggcagagtggctcctcacttcccagcaggggcgggccgggcagaggcgcccctcacttcccggatggggcggctggccgggcggggggggtgacccccccacctccctcctggacggggcggctggccgggggggggggtgacccccctacctccctcccggacggggcggctggccgggcagagtggctcctcacttcccagtaggggcggccgggcagaggcgcccctcacttcccggacggggcggctggccgggcggggggctgacccccccacctccctcccggacggggcggctggccgggcagagtggctcctcacttcccagcaggggcggccgggcagaggcgcccctcacttcccggatggggcggctggccgggcggggggctgatccccccacctccctcccggacggggcggctggccaggcagagtggctcctcacttcccagtaggggcggccgggcagaggcgcccctcacttcccggacggggcggctggccgggcggggggctgacccccccacctccctcccggacggggcggctggccgggcagagtggctcctcacttcccagcaggggcggccgggcagaggcgcccctcacttcccggatggggcggctggccgggcggggggctgatccccccacctccctcccggacggggcggctggccgggcagagtggctcctcacttcccagtaggggcggccgggcagaggcgcccctcacttcccggacggggcggctggccgggcggggggctgacccccccacctccctcccggacggggcggctggccgggcagaggggatcctcacttcccagcaggggcggccaggcagaggcgcccctcacttcccggatggggcggctggccgagcggggggctgacccccccacctccctcccggacggagtggctggccgggcagaggggctcctcacttcccagtaggggcagccgggcagaggcacccctcacctgccggatggggcggctggccgggcggggggctgatccccccacctccctcccagacggggcggctggccgggcggggggctgacccccccacctccctcccggacgaggtggctgccgggcagagacgctcctcacttctcagacagggtggctgccgggcagaggggctcctcacttctcagacagggcagttgccaggcagagggtctcctcacttctcagacggggcggcagggcagagacgctcctcacatcccggacggggcggcagggcagaggtgctccccacatctcagacgatgggcggccgggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggcggccaggcggagacgctcctcacttcccagacggggtggcggccgggcagaggctgcaatcttggcactttgggaggccaaggcaggctgctgggaggtggaggttgtagcgagccgagatcacgccactgcactccagcctgggcaccattgagcactgagtgaacgagactccgtctgcaatcccagcacctcgggaggccgaggctggcggatcactcgcggttaggagctggagaccagcccggccaacacagcgaaaccccgtctccaccaacctttttttttttttttttggtgtggattgaaaactactaatggatagaaaatgattggggattggagctacttcacatggaatggcaaaggacggcatctgtaatgtggagtgtctgtctacgtggagagaaagggggaggatgtgcacaggccttgttcttggtgcagaatgaaagccattggcaggagatagttttttccccccatttcaaattgggtttttatcagagatcccagcataaatttttttaaaagagtagatagttgctttttctttaattttccatttctgttggaaaagtagcaacaataacaaaaataactgtttataggggattcctttctagaagttgttttttggtaaagatttaaatccaggctttctattcgtcctccttttgaaaaaaaaaaaaagttttggaatttgccagcctttactcaaaagccatttttgtttgttctcattctgtttaattctgtgattaaataacaaacatgggctatgtctcagtcttttttttgctgattcctctttacatgtggcttatcttcatcctgaatgtctttcttgaaatctgtactcacatattcacttgtctactcagctttgtctcttgggtgactaatagacatctcaactcaaaataaccaaactggaactgatgatctgtccactctcaatctgctctacctacatctcccatctcactgaactttctgtttgatcaggcaaaacattggatcattcttaacacacttctctttctcaaaaaattcacactgtcaacacattctcttggctctgcctcacaaattcaatttgaactacccccaatgcaaccaccctggtccaagtcaccatttctagccttattgagaaagctccttactggttcacggttttttttgtcttttttttttttgaggcagggtctcactccatcatccaggctgaagtgcagtggtgtgatctcggctcgctgcaacctccacctcccaggttcaagcgatcctcccacctcagcccccatgtaactgggactaaggtgtgcaccaccatgcctggctaagttttttgtattttttttgtagagacagggtttcaccatgtagtccaggctggtcttgaactcctgggctcaagtagtccacctaccttggcctcccaaagtgctagggaaggcatgagccaccacacctgccttctttgcttctactctcatctgcttctacttgtaagttctcattgtagcagccagtaggccttttggaatttaagtaaaattatattacttctctgctgaaaactctccagtgaatcccctattttatctcaataaacttacagagttctttaggttctgtgtgattaggcccctgtcattcctatatcctagttcctaggggcatgactctccctgcctcctgtgctttagccacattggcctcattgcagtttctctaaaatgtgccaccttagaacttttcttcttaactgtttccttggtgtggaataatactcttctctcagtgatccactggcctatttcctcacctcctttaaaccttcatttaaatctcaccttctccatgagggactacctggttaaataacacatcttcctccttccctccaccccagcgtttcaggtcctacatccttgccctgctctgctttttctttttaccatagcatttaacaccctgcaactgattctatttctctccctcttctgtatacatgtacacatttgtgcacacatgttgggaaaaaacaagtttatagtctttcatcccattccacaagtttgtgagcctttgtctttgcactggagatacatgtggctaatgctgaaaatgaatggatcatggttcatgcttttagggagcttaaagtgtaaacagacatagtaatagtgttttactattgatggtagcaacaaacatttgttgaattcttttttgaaactttactatgtgccagacactgttttaagacttacagtggattaacttatttaatgttctcaagtatcctattagataggtgttattaacctacttcttacaggttaggaaactgaggcactaaaaagataactacagatggtctctgtcttttgatggtttgacttagcaatttttcaactttacagtggtgcaaaagtgacattcagtagaaactgtacttcagattttgatcttttatttttactatttttattttattttagagacagggtcttgcttgtcactcaggctcgaatacaatggctcagtcatagctcactgcaacctcaaactcctaggctcaagcaatcctctgtccttagcctcttgagtagctaggactacaagatgtgctaccatgccttgattttttttttttttttttttttttggagacagagccttgctgtgtcgcccaaactggagttcagtggcacgatctcggctcactgcagcttccacttctcgggtttaagcaattttcatgcctcagcctcttgagtagctgggagtttttttttttttttttttaaaatggagtttcgcttttgttgcccggctggcacgcagtggggcaatttcggctcactggaacctccgccttctgggttcaagcgattctcctgcctcagcctccctagtaactgggattacaggtgcctgccaccacatccagctactttctgtatttttagtagagatagggtttcaccatgttggccaggctggtcttgaactcctgacctcgtgatccacccgcctcggcctctcaaagtgctgggattacaggtatgagccaccacgcccggcctaatttttaaatttttttatacctatggggtctcactatgttacccaggctggtctagaactcctggcctcaagtgatcctcctgcctcagcctcctaaagtgctgggattacaggtgtgagccaccatgctcagtgacctatcacttttataagttatagggaaaaaaattctctatattttcttcgtattactatactttgtgatatgatggattcattgttttacatttctaaacagatactcagatgttaaatttatccatgaaaagaaaacgttattaaaattttaaagctctaaataataaatcatcaaggccaattagtagagttagaaagaaacttgatgattgtctggctcaattctctgattctctgtacatatagtaaaattatgtccaaaaagatgaaataatatatggaaagttacacagttggttaaacccctcccatcttctaaaggtagtgaggaaaattcagaattagctgtatatgcaaattttctctctcttatcagtcaacaatttagacaagttttctagtaagaagggtatgaggacagacagaggcttgctttgtacctgctgtgtgctagggacacactcttgcaagtgatttctgtcctaatagagctgggggtcacgttctgttatgggagagcctataaagcatgatacaattaataaaaataatagctttatttgagggccttcctgttctacacactgtgctttttgagaggtgatggttgtttgtgagattcagtatctgggataataagataggcgttgaaaaaagaaaaagggaaaaaagtcagcatccaactggagaagcagaaccagcaggatatatgtgtgcatgtgattagatagatagagatgggagttgaaattgaaattgattgtttatttggtttatgtgattttgggggctggacaagcaagtctgaaatcctcaggacaggctgtaacccacaggtatggctaaagttgctgtccacaggtggaattatttcttctctctaggaagcccctgtcgcacttaaagtcagctgattatggatttttattacttgtatgatgccttcacagcaacgcctagattagtgtttgattgcataactagggtagggcctagccaaactgatgcatcaaaaagaccgtcattttgttttcatttttattgaagtatattatgcacacagaaaaatgcatatatactaagtgtatagctcaaataattgttataaactggacacactcaggtaaccagtactgtacagggtcccttttgtatctatatatttaatttgcttcttataacagttcattgaggtgtagagatttcctccattttatagataaggattctaaggctcagaaaggtcaagtaccctgtgttacagctaataagtgacagagctgggattctaatcagggttttgaggcatatataaagtattatgggagcccaaggctgaaattgattcattcattggcgtatatgattgtgggggctaaaccattagttttgcttggggattggtagaatctttggaacaggaatgttctaccaaagagggtatatgaagctttgagttgtcttaaagcatgaatttaaatttgccagggagtgaaaagttcctttataaaaggtaccagcaaaaagatatgatatcatttcaggggacaatggtttgttgttgctaactatagagtctttacactgtattgtcatagtattaatctcttagagtaataattttcagctcaaaaagaaccttgtgtactgttttgaagagcttgaatttttatattttagtcagtgtgacatgagagtgagttaattgtatctgcattttagcaaacattttcacagtggtttacaaaataggttagaaaggctgaaggcagaaagatctggttcttagtgagaaccagaactagagcactgatgattcagaggagggtagagcatggaatttatgaagacttgcagagagaattgatgagattggtgaaccattagagctggatgatgaaagaagtggagtaattaaggatgattccaggtttcttttaagtatgatctattgggaaacaattccagagattaggaaatactgaaggagaagctgtgttttgttcttttctatcatgggtagggtgaatcacaggttgattgggaggatgatgaacaagagaatgaaaaagaatgaattcggttccgtaagtttgagttttggagctgaaggtattgaagtgtaaatgtttagtaggcagttggaaataattggagtgaagttaaggtggtggatttgataatcactgactaatttatagaagtaggttgaggaccagcctggcaacatggtgaaaccccatttctactaaaatacaaaaaattagctgggcttggtggtatacgctggtagtcccagctactcaggaggctgaggcaggagaattgcttgaacccggaaggcggaggttgcagtgagccgagattgcgccactgcactccagcctgggcgacagagcgagactccgtctcaaaaaaaaaaagaaagaaaaaagaaataggttgaggccacgggactggattcgtcctctcaaatgaaaagtaatgaaaggcagagtggagagtgttgaggaagacctccagtattttcagggttatatggaagaagaggagttggttgtcatagaattaagacatcaaggagataattgtagcctgacaaagccagaagagattattttcaaggaggttgtaggcagatacattatatagatacagtttatggacacaaatatatttgtcttcaataaattgtgctgggaaaactggatagccatgtgcaggaataaattagacctctgtctctcaccatatagaaaaatcagctcaaagtggatgaaagactttggtctttcaaaactagacccaaaactgtaaaactactagaagaaaatattgggaaaatgcttcaggacattggtcaaggcaaagatattatggataagtcttcaaaagcacaaaaagcaaacaaaaaggcaacaaaagcaaaatagacaaatgggattatatcaaactaaaatccttcacagcaaaggaaacaatcaatagagtgaaaacacaacttttagaatgggataaaatatttgcaaactatttatcttacaagggattcatatacaaggaactcaacaataaaaaaaaaatctgatttaaaaatgagggaaggatctgaatggacatttctctaaagaagacacacaaatggccatcaagtatatgaaaaaatgctcagcatcagtaatcatcagggaaatgcaagccagtaccgcagtgagataacatctcatcttagttagaatggctattatcaaaaagacaaaaaagaacatgctggtgaggattcagagaaaagagaattcttatacactgttgatgggaatttaaattatagtcactaagagaaacaatatcaagattcctccaagaactaaaaacaaaactaccatatgatccagcagtcccactactgggtatttatccaaaggaaaataaatcattatatcaaagtagtgttaatatctgcactcccatgtttgttgcagcactattcacagtagccaagatatagaatcaacctaagtgtccagcagtagatgaatggataatgaaaatgtggtaaatatacacaatggaatactattcagccataaaaaaggatgaaatcctgtcatttgtggcaacatgggtgagactgcaggacgttatgtaaagtgaaataagtcaggtacagaaaagtaaatactgcatgttctcgtatccacaataagtagtagcttaaaaagttgagctcataaaggcagaaagtagaattgtgggtattagaggccgggaagggtaggggaaaggtgaggatagggagtggttgggtaataggtacaaaattacagcaggaataagttctcctgttctatagtactatagggtgactatgattaataatttcttgtatattttcaaatagctacaagagaggatttttgaatgttaccaacataacaaaaaatgataaatgtttgaggtgaacagatatgctgattaccctgattgatttacacattgtatacatgtatatcactcttataaataagtacaattatatgtcaattaaaatttaaaaaaaaattttaagaacacggaaactaggtgtagtggcacatgcctgtagtcccagctacctgagaggctaaggtggtaggatctcttgagctcaagagtttttggccagcctgggcaacatagtgagaccctacctctttttaataaaaaaaaaaaaaaaaaaaaagaggaagaagaagaatatggaatcctgaaaatgaggaaccaaagaaataagcattttctgtatttaaccaacacttagtcagaatgagattagtattactagagtgatatatattctctcttgtgaagtgggaaagggttttctggttcttctatcacttaaatgattaccaaactcttagatgattcttgaagtctctcaagaaaacatgtgatttctaactatatatattttttctataccatatgaaaaaattggggatgttaaataattgctcacctattttgaactttcacaccttttaaaagatcatttttctttcatgctaggttttggacatagagcaaattcctttggtatgcttgataactaactcttttaacttagaaaaactgttcttttgtcttctgtcctacacctgaaagtctgttcaaaagagttaaaaattgggtaaaatgagtttgactttgggccttttgtaatagaacaaagaagaaaactgtaagatcacatgttttgaaattccagtttcttttcactgtcatttcttcagaaagattttctccatcccagccgggcatggtagctcatgcctataatcccagcattttgggacgccgagggggatggatcacctgaggtcaggagtttgagaccagcctggccaacatagcaacaccctgtctctactaaagatacaaaaattaatcgggcatggtggtgtgcgcctgttatgccaactacttgggaggctgaggcaggagaattgcttgaacctgggagacggagtttgcagtgagctgagatcaagccactgcactccagcctgggtgacagagcaaaacttcatctcaaaaaaacaaacaaacaaacaaaaaaagattttcttcattccttttgtctaaattaagtatcatttgtttgttttttgagagagtctcattctgttacctaccctggaggtcagtggtgtgatcatagcagccttgaactcctgggttcagactatcctcccacctcagtctctcaagtaactggaactacagatgcgcaccaccacacccatctttttttttttgtctttttttgttttaaaagactgtctccctatgttgcccaggctggtcttgaactcctgggctcaaggcctaccttggcctcccaaagtgctcggattacaggcttgagccacagcaccaagtttgttaccctttctcatagcattctattttctttcaaatcagtcattataattatttcaaattattcatatacagtatattatttcagtattcagtttgtttaatttctctacctgaactagactgtaagctctgtacacaggaaccatgttggttttccacactactgtattttcaagtcctagtgcagtgatacttagcattcaataaagactttgagtaagtgagtgaatgaatgaatgaatggtgactgcttttagtatttttagaagtgcaggatgctatcaattaagcagcctttgtctagtgtgaggatgaggaaatgtttcttagaggacttgaaaatgagtaagaagggggtatggtattcagtatccaattttccttagagggcaagtaggatgaatatagaaaattttcctttgaatttagaaatgtgggagtcattcatgaccgtaacggggtcaattttaatagagtgaaggaatgcaattcagattccatttgcttgtgaaatgaattagcgagaaaacagagcaaggagcttttcccagaaaagtagatctcagacacttattgctggcttatttgtttgttcataggggagtatgataaaatgaactattaactatgctttaaatattttcactgtaacacaaaaaacaaaagtgcacaaaaacagtactgtagtagaggctaccagaaggacctggttagttgtcatctgtgagtttagctgccatatttatctttcacattgaaatattaaatgtgtaagaaagggtgaaaatgtactttagattggtttacagcttccacctaaatcatcagtcctcttattttgcaagaaattagagtactgaggaaatcatggtagattattcacagtgcaccagaaaccctggctgcctcttttccatgtcctttttgtaaagcatcttaatttctgtgaattttgtctcttatttatttttttttaactttcaggtgttggtaaatcatgcttattgctacagtttacagacaagaggtttcagccagtgcatgaccttactattggtaagttttataaaagggatgagaagcactaaaagttttggatagtttaaatggaaaatgctagaaggtccattctactagtgatgatgctaaaatcagtgaaactggatttgttgttacgctgtttaatctctgtcacttttttaaaaatatgtgtagtaaaaataaatattacctaactttgtagaagtggttaaagaagctactgctgaaagacagtagtttttaagatttcaattgtaattagcgatgaaacaatttaagagacagtatccaagcatggtaagagcagaaactttgactcagcttgctggaagttaaatcaagtctctgctactaacttgctgtgcaagccacttccccgtttcatgtctcagtttctctttctgttcaatgagagtagtagtaccaatcacatgaagttactgtgagcagtgagttagtaaatgtaaaccattcaagtgcctggcaatgtggaaagtgctctagactttctcataattattaactgagaaaaaataccactgggcattttgtattttcctcagttgtaaagagtaaatgaaatagttactggtaagaaatagtcaacaaatattagctgttattatttaaaatagtgattttccattgtattaatatgcaaaggaaaaaattaagatgagtgaaaagctaaaaactttaggtaatcttactgtttcgggtttttatttgtttaaaaattatattctgaaagctgaagaatctagctggattattcttctgtggctgtagcccattaacaactagaaattagtcaaatatgaagacgagataattggaaatctagtcattctttacaacgaattgcttaatgaatctttttagccactgactgctcattttctgctgacattattaatttactatttatagcatgttgatccttatgttctgtgtgtttttaaaataccaaatcagagatagagctcatgaatcacattattaattaatagttttcaaccaagctacaggtatagtactttgtggatatattgaaatcttttgttagcaactactgtcattaagactatccgtattctattttacttttgatagttttaagtgtatacaataatgatgggtaaaacaggtaactcatgctggtcctgataactttgttttaacattttgttttgttttttgagaaagagtctcgttttgtagactagagtgaggtgcggtggtgcaatcacagctcactgcagcccccaaatccctggctcattatcttcccatctcagcttcccaggtagctaggactacaggcgtgcactaccatgcctggctaattttttgtgtttttggtagagacagtgttttgccttgttgcccaagctggtttcgcactcctgggctcaggcgatctgccggccttggcctcccaaagtgctgggattacaggtgtgagccaccgcactggcctgtttaatgagctctcttcgctgccctctctataggatttgctctttgcttaataggtttgaaactagccaactttaggcatgactcatttctaagacaactggcaaaacagttgtatttagtataggatactaaacaacagtgttcttccttttcttagaatcttatgtataaatttctaagttggtatggcacaccgagtggagaggatggacctgagcctgctgtcagaagttgacttaagcccagcgtgtccaacccacaacctgcatgcagcccaggacagttttgaatgaggcccaacacaaattcatatattttcttgaaacactatgagattttttttgttttttgttttttgttttttttttttagctcatcacctgtcagtgttagtgtattttatgtgtggcccaagacagttattcttccagtgttgcccagagaagccaaaagatcagacacctctgccataggctatacttgcggggaaagagaaaggagtagacccaagaattgtttggaaaactgtaactcatataaactgccagctggcgtcacactatgtttgctaatggcaggcactgggaaataagagtctgaaagaaaagaaaaaccaaggatctttttctccttgggttgactgtgtgttctccattcctctggctccagcccctgcctggcaggcccaaatggtctggttcttgagctctgataatctttttccgtgtcatctttccagcctaggggtggtagcagcttcctgctgtttgtaatctctgggtttataccccatctcttctttgggtttttgggggcttgctctttactgtaaccaagtccctacattaaattccctatgccctatgtacttaagtgtagtttctgtttttctggttgcactgactggcataccgttttttttctttctaacttttacagttggttgtaaatgacaaaaatttacctagatggttttaaacaaaaggacaatttattattttaatatttaggtgtgtctcaacgtgagggcagggagctagctgggtcagcctggaaccagagctcagagctcttaaggagggaacccgggaaatcctgtttctcattctcccatccttccctcattgtctcccattctcttctcatgcctatttcatttttctctctccctgttgaccattgtttttgattttcctgtctccatgttgggaaatggccattgtcaataactccaaagttcatataccattcaggagagcagagattctctttaactcaatttgaagtttcctagggacgagagttcattggctcaatttggttcaggctcacttatctcttgttctgtccactcttttcatgggcccagaatcacttttgtacaacatggtttccaaattggtagtcgtaggagcaatctgggtgagtagtcatacatagccactaccagaattccctcacacctagctattctatttagtcatcatgtccttatcttttgtcccctgtaatgatcagttctctactctgtttataaaccattgactcctgagctcatgattcttctcagtctgcctctcttgctttctctcttacttttccctaacacgtatagacactatgtgccgtcaagtctttgctgcttgctactccctgaatacttagtactttttcataccctcaatctttctcttctcagaggatgccattgcttgacatctctgcttattacagttcttttctgaacaactgtccatatcccaaaccatagctcccatttaaaggaggtaagatttgtatacccacgcctgtggagaaatattgttaacaggaaaggaacaagtactgtataggcacacagtttcaatataatgctccacaccaatagggattcttagtagctcatgcattagaaatccattgttcataatcaggattagtcctcctaaaaaggcaaagcaaattttatggaagatgaatgtaggaagtcccatctttttacctgctgtgtgttaagggaaactacacccagtacacattcataaaatggattgttttttgttggggtcatagtccagccatggctttagcaacagtctgttattaaagaacaaagatggtagctaacatgaactatttttttaaattgaaattttattttagatcctataaagtgaatgtaaatgtgctctatacattcactatgcagagtctcaatatttaagatgtttcaggatatttgaggtaatgatacttaaaaaaattatctgaagcaaacagaatatttaggatcataaaactgttctgagcatactgataggtgcttaatgttcattgtcgataatgataattacattgtttttactgaaaaccattttttaaagtgaaagccgacccagttgctcttcctctggaagaggaagagtaaaggggtgcttcttgccactaccacttatgtagagttgcatatatacattgaaagggtattcagtaccaccattcattcagtcaagctaaatacaggccagtagaagcagtattgttaatgcatgtttttgccttcattggcccaaggcctacttaacatttttgacacccatcacagcaatttatctttcagagataaaaaaaaaaatagcagattattatcacatatttttaaaaagaacattagaatttttggtaaaataagtagtaagacagtatcttgactctgctgcatacttgcttttgctggatgactaaatgagggtgaaaaatttaaggttggtttatgactaagaaggtattaaatgatagaaaagagaaaataaaagaccgtaaaagtttttaaaagcctctatacaaatattctttaacctttgactatctttgagtcatagaaacagtttataaatagcttcatggacacaattcagaaggtacagactagagccttgctcctcaaaagatggttcatgtgctgttgtgctggaccagcagcagcatcagtatcacgtgggagcttgttaaagaacctactgaatcataatttgcattttaacaggatcgccaagtgattcatatgggcactgaaggttaaaaagcactggaggtaatggcttttaaatattgattacccagctggaaatacactttatgtgctttgccttgtgcacacatcctggcctctcagtggctttacttctccccgccgtgtgatcttggttccaccctgcttcagctactccctcccatagtttctctcagaactcatcattaccaatatctggaaccatttcagaatttagtttcatgcatttgactatttgactttgtatcccatccttcctgctcactttctttagtccctaattactaacaatttttttacctcatcagaattatgccattgattctagtatcttttcactctcatctctcttgtgttgctactttcctccttacccagattcaactttaatagctgtgcccttataatcattcctgcatgcacccacagttttcttgtccctctcatgctgtatcatagtctcgtggctaaaccataggttaaatctagccatctattcctgacatttacagctagacaggtctggagaaaagcacagagccatgctaactagtctcattttaatttcttggacactcacatcaagtaaatccttagtactacctgacaattgtacttttatttccattatattcaccctttagtttcctgtagaacgatatcatactttcttgctctttaagcagacatctttgctatctttactctcagctgataaccttggttttggtttcactcagaaaatagaggcaagtagaagaggattttcacaggtttccaccactgcattgacccacctacctgcattgtgccctataaactaagcctttcccttggtgctgtgggtaaacttaagttcttagccagggcctactgaaggacactgctttagtagttctttttgctttcaggcatcattactttttccttttttgatggttatttttaatgtctctattttcttttccagcttttaatccttttctctcatattagcaaaattccacagaatgaattgttcatattttctgtctacagtttccacctattttatgaacccattccacttatccctcctcccccatgtacagatctagctacttactcaacatctccttctcttagatgtctaatagacatcttaaactgaacatgtcccaaatagtttctgatttttccttctcaagtcttaagatgagtgtatatgtacatacccatattcatacccataccgcattcatacccatcctcccacctagatttactgttcttaacattttaaacaagtaaatataagtaaatagattttcccccaccaataaaaagtaaggtccatgacagcagatggttctctgttttgtttattgctgtatctgcacctggtacatactagggactttaaaaatatttgctaaatatactacctacttagtggaggaaaacttcataaagctgtacttgccattgcagggcttaatgcttgcattcctatatgttatactattcagttatgttgtttacaaataaggcacagcccactaattcccactacatttatttcactacctacaaatggacagtttgaccaatgttagtctagcggctaggccatctatatgttgatttcaccttcttacctatctctcccacttccttaaaccagtcagcctataagaaatgattgctgggctcatgcctataatcccaacactttgggaggcagaggcaagaggatcgcttgatgccacatgtttgagaccagccagggcaacaaagcaagatcccatctctacaaaaagtttaaaaactagtcaggcatggtggcacacacctgtagccccagctacttggtagactgaggcgggaggattgcttgagctcaagagtttaaggctgcagtgagccatgatagcaccactgcactccagcctgggcaacagagcaagacctgcctcaaaaaaaaaaaaaaaaagaaagaagtaaatgattggtggaaatgaaagtatacttttaggacaaagtaatagaattgaagcatcatttcttccatcaggctcaccacaggaaatcagttttaaaatatacctcatttatttgggattcagttttctagtaacttgagttgcctagaacaacattgccaagaagttagaataatagtttaaaagacctctcgaacttctcattaagctctgaaaaagtctctgtagctgatttttttttttttttttttgagaccaagtctcgctctgtcacccaggttggagtacagtggtgccatcttggctcactgcaacctccacatcccaggttcaagcgattctcctgcctcagcctcctgagtagctgagactacaggcacgtgccaccacacccggataattttttgtgtttctttcagtagagatggggtttcactatgttagccaggatggtctcgatctcctgacctcgtgatccacccgcctcggcctcccaaagtgctgggattacaggcgtgagccaccatgcctggccctctgtagctgatttttaaaatgtgaaagtattttcctctcagaatatgatcattgtgaaaatgttgtaaaaatctggagaaagttaaattccctatataactttggccctccagcaaccactgagtggtgtatgtttggtgtgtgttagtgccttctaaagcttttaaatgtattcctaaacacacacacaaagctgttctaatttgcactttccccactgatgtatcaaagtgcgcattcctcctcatccttgcttctactgcagctcattcagtttttaatgtttgtaaattagagtcaaaaaaatttttactttttcgttcttttttagtgaggctgagcatttttcgtatgtttaagaactatttatcttctctttgattttacttgttatatatctttgtcttttttttgtttgctactttgaattattaagggataactagtttttttgtttttttgttttttaactcaaatctactgtggcttcctagccttgctgtatgcaaaaattacatacaatgtcctaaatattcttctgtaactataaatttgcattctatttggtatgtggtcatgtatatcattttctttttttaaattttattttagatatgggggtacatgtgcatgtttgttacatgagtatattgtgtactggtggacattgggcttctagcatacccgttaacccaaatagtgaacgtggttctcaataggtaacttttcatcccttacccccttcccaaactccacttttttggagttcccagtatctgttatttccatctttatgtctgtctgtacccattgtttagctcctactttataagcaagaacacgcagtatttgattttttgagttagttcactgaggataatggccttcagctccatccctgctgctgcaaaagacacgatttcattcttttttatggctgctatgtctttctttaatccctatatagcttgtggcctcacaccattaattaaataagccattcattcttgtcctaatacctttgtaatatgttagacccctgtatgtaagcaagcaagcctgtttgagggtgccaaaatatgttttgttcatctttctttttttctttttttttttttttgagacagagtctcattcagttgccaggctggagtgcagtggtgcagtctcttctcactgcaacctccacctcttgggttcaagtaattcttgcgcctcagcctcccgagtagctggaattagaggcacgtaccaccagacccaactaatttttgtaattttagtagagacagggttttaccatgttgaccaggatggtctcgatctcctgaccttgtgatccacctgccttggcctctcacatctttttttctatttcatgaggcaatatcatactgtggtagttattgcaactttgtagtgtacttcataccaattggtgttctttctttcctaagttttcttgatcatccttgtgcatttgttcttccagatggaactttgccaagttgcaagatttttagtgaggcttttaaatttgaaaatagttttattcaatacatgggctaatttggagataatttatgtttttacagcattgattacctgtttatacacataatatatgttttcacttattcagactttcttaaatgctgttcagtaaaattttatggttttgttcatataggccttatgcttttttaagtttggagattgtatagattttgttgttattgtaagtaaatttttttcatcattgttaaattattttgcatgttctaggtagactttttagtcctatctgtaagttacaattttttcctaagccaaaatctgtttctcttaattttattactctaatttttgaccaaagtctctagaataatttccaaattgaaaatattataatatttttctcagtataatttgaattattctagtgttttaccattaagtatggtgtttgctgttttgttttacatagaaaattgaggacattactttttgtatctagttttcctttatttctagaattaggaaaaatcaggccaccttccctcaagtctccattttgaacttctgcagtgtctaggtttcaggaacaggaatgggggataggagtccatatgttaccatgctggtaaggaaggctgtttgctctacacctagctgtgctctctgcttagcaccccacctagtacctcagcagcctagaagttctagccttgacattacaaggaggcctgaatgggcgtgccccagccttacctaggtaaggagccacattctgcctctgcacatatctgtaccagtgattacctggctctgacagatggctctttctcacagggtctcatcattagtcatgcggatggtagtttagacattctagtgcataatatggaataataataattatacctaacatattaaatactatgtgccaggcattgttctattttatatgtaatcatccttttaatcttaaaaaaaaatctcatgagataggtattatgaataccattttacagatgagaaaactaagacaaagaaggggcttaataacttgcacagggtcacacaaccaagtagatattgattatgaatgctcagtaaatgatgcaaggatgataacgattggagacaattagaaagtgtacctattcagagtatttgattgtggaaggttggaagtgaataacatatctgagaaaataagcatcactccccgacaatgtcaggtaaatgaggtcttgactttgactccacagaaatttatctagcagccaaattggctgttaattgaaaatggatctgggaagagggcgtcaaaggcatagagaataacaatttatcacataaaaaaaaaggagaaggaaacctttctaaatgggattctcaagcatgtatacatctaaggaaaatgattttaaaatgttaatattccagagaagaaatcaagtttttggtttctatatttgtttctgaggcttccaagagactaggattcagtattttcatttgccacatagaatgaaaggggaattggacccagttatgggaaggtaaatgggaaagagttatatttctgaagctgaaattaaagtgtgtttgttttcgctttgataggaaaacagaaatcatagtttttcagtaatcagcacttgtcaatttttccttttgagatgtgtatttttttcccaccaccattttttaatctcatgactaaatataatacaatagccttttaactggtctctttgcttcttgtttctgtttgtttgtttgtttgtttgtttttaaattatccatcctgacctggttgataagtgaagttaagatgtctattgtattatgacatattcctggtttagaaacattcttgatgtttacttaacaggtttatttaaaattggatgtatttttagaggcaaaatctttgtttaaagattttaagcttcataacttctgtctgcttactttattaattgtttttatttttgttttttgagacaaggtctcactctgtcacccaggctggaaagcagtggcacgatcatggctcactgcagcctggagttcccaggctcaagtgatccttccgcacttcagcctcccaagtagctgggaccacaggcacctgccaccatacctagctaattttttaatttttcatggagactgggtctccctacgttgtccaggctagtttcaaattcctaggctcaagcaatcctcccgtctcagcctctcgaattgtgggattaccggccacactgagcctctgggcccagctgatctgcttaatttgaataaagagacgaacatactaaaacccaattctagctaaggtaagcaaagagaatattctagaatgtctgtagttatgtatggaacctacagtaagttggaaacttggtcttggaattgggcaggaacaaagcatcttggagcccaggaagcagaaactgttaagagctatcctgcagcaggagcagttgtgttagcttctcatctgctcggatggaatggtcacaggtcagtttccgtatctttagccctctgctcaagatatcaattccagagagggagcatctgcttgctgttgctagccttgccttccttacctgctcacccttggtatcagcagcattgatgggtctgtttctagtttgtagttgttttttgttaaatttgacgttatgagcaatatagatagttttggattgtgcttaaaagccaacccatccctgacaatggaaggaaaaataaaatttttctctctctttctcatttgtaggtagaaacaataaattcatgaaaaagcctctactctgtctgatacctcgctgacatgtagaattttgtgcttcagtatactccttttcagtactgagtatttcaaagaacatctgtatcttacttagcagctggtttcttccctcaactaatttcatttttcatgtcattaatgggttttgtgtatgtccccaccctgtggcacagaacagatatgaatatatatattcatatagatacattatgaatctatatgcatatgtagatgcatatatatgtaaacactgtaatggttttatgtggcataatttttcaatttttcatttttcagtctgatacatcatgactcctggatctcttttctctagctttcctgtatttctgagcctaagaaacataaacatcatcttagtttcttggtattcattaggcctgtgggatggaagaagtattataatgtagagtaaaagctcatcgttttatgtcatgggacaaattacctttgtttctcacccttctaatcacagttggggagttatgggagatgctgaactggaattctgatattgggcagtgtgctcttctctgggaaactagaagttgtttttctgacaggatgacatttggtttctggggaccatgtgtgtcttcccttcaccctgactctgatctaaatactgattgaacatactctaggcagtaatgacttgatataagagatatactactttcagagttgtcttcacaactgtttgcccttctaaaattatctcctatttttctactcctattttgatgattgaatgagtgctttccaaagatgataaatacaagttaaaagccaaagtagtaaacttgtaagtgtgaagtctgtgttccctttgtcctgtaatcctatttcttataatttgcctaaaattatagtaagttgaaaaatgtatgcagaaagttcatttcagcattcactatttagtgaaaataggagaacaacctaaatctgtagcaataaagtaccaaattagcaaattatctgtacacaaaagaatattatgcagacatcaaaaataatgccatagttttatgtttattgatttgccaggatgtttgtgatacagaataatgtctgtgatgtattattaaataaaaagcaaattgcagagcagcatttatatgttcccatttgtgcaggattgtatacttatttctgcatgtgtattcatggagcactgtctgggaagtatgttaaaacattgattatagctagtggcagatttggagatttctttccttgctaattattcatgcttggaaccaatactatgatattgaaatatatctatcccttttagtgttttttataccatattaatgtaatttttaagaaattttaatatttaacatttgtgtttaataattatggctcttggatctctttttttaatttttatgttactgagcctgcaaaacatgaagaccacagttggtttctaatattgactctgccacatttcagtatcttagtattttaattatgtccttagcttatgtcttattagcacctcttccttagcttatgtattttctaagtataggaactgcatttgttaaagttgatctgtatattacctagcatagcatgtcttggaagtaaacattctgtttttaatccttgaaagtgagatatattcccactaattttgtaacaaatcatttcctactctatttaggtgtagagttcggtgctcgaatgataactattgatgggaaacagataaaacttcagatatgggatacggtaagtataggaaaagtgcactgtatgatctcagtaaagttactttatgaaagtacatcgtatatttgttttaatgttattatatgcctgttatggtttgttagacactgacttcctgcagccatgagatgaaatgtggtgctggagtagactggtttttcttatgcactgttttcaatagatgggccctgggtgttggtgttagtgagcatatctgagtgaatgttcacgttatgtggtctaaattgaaatgctctagaaactgtatttttaagaaaaacaatcagcatgtctcaagtacacataggaagtaaaataagaatatcaatattatacaataacttattcttcaggcttattattttaaatgttttagtcctaacaacttgaagtcacgttgctcttaattcagtatcctaattctgtcatacccttgttcattgagtacctattacatgtcatacaatattgtttttaatggtgattcctcatctgaaccacaatatacagaaaatgatttgagtgactgttttctctattctcccatcttagatgcataaaagtgaagttactgtattatatacattgggtgccttaaggtagcaattttcaaaccattttgtttcagaactactttatacatttaaaaattaatgaagacccccaaagagctttagcttatatggcttaaaggtattaatatttaccatattagaaattaaaaatgagaaacttaccaaatattcaatcattaattcattttaaattaataaattacttgttagggtagataatataattgtaatggacactgtatttttccaaaacaaacaactacatttttctagtgagactagtgatatctgtctgcttaatagaagacactggattctcatacctgcttctgcactgagccttacgtatgttgtttaattgaagtatattaagaaaatccagcctcacacaaatagttgggaaatggaggaccacatggacccttaaagtctgaggaattcccaggattctgggatcacactttgagaaccactgctttagggcattaggagataattcttcacagaaccccagttgagaaaacctgaaaggtctcctgttgtgtcaaagaacatattctctaaaccagcaaatgagatagaaaagatgggatttaatcatcatatacccgtggcctatttttctccagtcactcagtcttagtttctcacttgtcatgtgtagtagccattgaaagaaggaaccttagagaacatccggtctcacagactggattccctagaccaagcaagttgctgaaggctgctgtgggacctgggtttcctgatacttcctatgtgtcacagttttcccttaaatgataaccgtacatctctgtcttgccttgtccttgaattgtccactcgactctgggttcttgtgtttttttgcctcttcttcctcagtgaagagtcatacttttactatttctcaaggatttcccacatgagcctaaagcatctcaaaacatttgatttacattctctcaggcagcatctcaaaactgcatggaaaagaggaaaataaaatacacaaagtcccttttttcctagagatttaaaattaataatctccaaccaaaaagaaacattttctacttctgtattaaaagaggttctctcttcttgttttggagacagggtctcactctgtcacccaggctgtagtgcagtggcacaatcatagctcgctgcagcctcgagctcctgggctcaagcagtcctcccacttcagtctcctgaatagctaggactacaggcgtgcaccaccacacccggctgagttactgtctcttattcagaactgatttacgtaaactaagttactctttttagcttataaccttgtgtaacacacatctttgcattgtgtagtgtgaaccagactactgttattcttcaataaacatatttttcattccttatacttttgcataaatacttgtattgcttgaagtgccgttttttgttttcttttccatttaaggcaactaagatgtcagctctttggtgaagcctttttgacccccatcggaataacttattcttcctgtaatattttgtgcatatgtctcctgtagttctgatcccactgtcatagctttttgtttacattatctacccttctcagaataagcattatgagggaaggatccacctatatcttatgcagctttgtatcctgcattcttagcttggtgactgataatacagtgtttggtaaattttactgaatgaatgaatagagaatctcattctgtctaagcaacttgtagggtcactggatgtgttcaggagatatctactaaagtacatcgttttgaaaaggaaaggttaatatagtaatgataattatgtgatattttaggcataaaccacttcattgtctgtaggttattttagtttattcacttgttcttctattcttaaagtagtcccttaaataatctttgttttttgaaacttgagtaagccattcatttcctagttgtctgttttgtagattaactcgtcatacatcattttgatagaagcctggttttttgtgggttttcttgtttttgtttttgcttgagttgatttctttgcacaacaataaacttgcaaaagaaatctaaaataatttcttatgctggacagtatgagaaaggaagagaagaaaaacccttgtttgtgttcctctaggagggtagagggctcgttttctttcctctatttctgagagagatggtggtccgtttaaagacatcataacatcccagaaagaattcgaccacttccagcttctacatggagagctcccagacccaatggcctgttccagatttaaaggactgtttaaaatagtttaacttatttcttttggaggttgtttcttgagtctttgtcttacaggttttcctcttttgtttttgtttttttgggggtttttttttttttttttggttttgagacagcgtcttactctgtcgcccaggcttgagtgtagtggcatgatcacagctcactgcagcctcaaacgcctggcctcaagcaatcctcccacgtcagcctcttgagtagctgggactacacatgcatgccaccacatgcagctaattttcaaaattttttgtagagatggagtcttgttatgtttcccaggctggtcaggcttttctcttattttcattgactttcttcttactttcatacccaacttccaaaactttttaataaatgtaacctaatacacattaagattggtctcacacttagtttatatctgagtgaaacgggattttccatagcattaatgttttacagtgtgtctgtacatttggatagccggttgcatttttggtagcaagggttatgtctattcatgacccaagatgtttacaaaaccatcctagagtccttcaagggaaaattagccaaatgttattatttgttttatcagccttatagaaatgaagagttttcttagtatcttaggatatttgtctttttttttttttttttttttgagacggtgtttcactcttgctgcccaggctgtagtgcaatggtgcaatctcagctcaccgcaacctccgcctcccgggttcaagcgattctcttgcctcagcctcccaagtagctggaattacaggcatgcaccaccacgcccggctaattttgtatttttagtagagacggggtttctccatgttggtcaggctggtcccgaactcccgacctcaggtgatccacgcctcagcctcccaaagtgctgggattataggtgtgagccactgcacctggcctacaggatgtttgtcatttttatcttcaaaaaatttaaggagttttccttgcaagattttcacatccaccacctttgctttcttttgccagtagtgagaatagctgctagcagatactccttggaggcatgaaggccatcaatcagtttcacagctggaaacagtgataagagtctatcagtgcctccctttaagcactgacacttggccctttactgagttacttttctttcatttattaaaagccaaagccaaactgtaaatattcttttctgccaggggaagtcaaagaagaaacatacgttgcccccggtttctgttcattggcagaaaaaaggcagaggtgtgttctcactgttagaccctggccagccattactgccttgttctgctcttgttctttttctcttactttttctcttgccttctattcctctttcagttgccttccagcatatccaaatacatttgatttcccagcccctccaaaaaaaattgtaatatggatgttttagttaagttcatttatccactcagcttccctagaaatattcctattttacatgtcttatatcaagtaagtcagtgaaacttttgaccaaattgtgtgaaaactaacatgctaaaagtttcttctcagcaaatcacaggcattttttttctcctttgaaaaacatgttactttatactcttgacgtattatttctaaaaattgaatattattttgtttcaatgcatcagtaaggatggatgaccagatgcagtgagccagggagaggacctggaaccctgagggctgaaaacaatactgcctccccacttctgcctttcctctctgctcccattactgtcacttcctccctctcccccaccatcccttaagctgggagttgaggggcttagagctccaactgttcttcctccttaggcagcaattcatcaacatttttttgaacaactacagggacaggaaactgtcttagacatttcattgtactttagtgattacctcccacctgtggtctccagtttttcttacgtggcagcactaaaagaatctgacatcggtgatcatatcctattttatctttttttttttcttgttttttgaggcaggatcttgccctgttgcccaggctggagtgcagtggtgtgatcacagctcaccacagcctccacctcccaggctcaagtgatcctctcacctcagcttccccagtacctgggactacaggcactcgccaccactcccagctaatttttttttttaattttgtagagatgggattttgccatgttcccaaggctggtcagaaactcctgggctcaagcaatctgcccaccttggcctcccaaagtgctgggattacagcgtgagccactgcgcccagctaagccttttttccaaagtaaatatcctcaaattttttaaagcattcaacttgtgctgttttttctaggtatttccacccattgttacttttctcaggatcccacaactaactagtgcaggttgactttttcaccacccttgctgtgtacactaagacagcctaaaaatcactttgattcttactgatcttactgtcacctggaatagaagttttgtacatgcatgtagatttcaaaatatttcctctcaattatagcagttccttgatagaggtctaaatttttttttttttttgagacggagtctcgctctgtcgcccaggctggagtgcagtggcgtgatctcggctcactgcaagcttcgcctgccgggttcacgccactttctcctgcctcaacctcctgagtagctgggactacaggtgcccgccaccacgcccggctaatttttttttttttttttttttttggatttttagtggagacgaggtttcaccaagttagccaggatgatcttgatctcctgacctcgtgatccacccgcctcagcttcccaaagtgctgggattataggcgtgagccaccacacccggccaaggtctaaatttttaagttgagtcttttaagtaaagtacctgagatttaatgcttgggcaagggacagtttatttggctgtttagaaatccttctttccttcttttggttctcatctgtcttctacatagctggagctgtttgataaataactagcaatgcaagtaagagaagtattactgtaatactgattctcacaaatcttaattttctcactttattggctctttgggatcaatccaggtaacatatttgagtgcctactataaatatactctagtactctgagttaagctattcctcaaggataactgaagaggaaaaaagataagcatttgagtagtgtgttcattgtatctaatcaatagtattaaaaccaaatgaccacatgaaagtgcttttggatttgtgaggagaaaaggataactatgggctgtggtagacaagctttcccagctttgtgaaagaattaggggcttgagctggtcctcaaaggaaatggaaattggataggtggagagagaagaaaatagtgtttcaggcaaggagttaagcagaggcacaaaagcaggaattttcagactatagacaagatatcagtagaaaaaaatggacttgtatgagcaagattttgaataagaaaaaattcttgtgagacaagtagaggtctgattctcaagagcttaggactttaattcaggatatttagagatttttgaactacagcttaatatgtataaagttatattttgtgggagtagaagaggaagaagaggtgaagattactactagttgccagcctggttactacaaatattgctattcaccaaaagactcagatgcatgggaaagccagtttaagggattctttatctggcagttacaaataagctttaaaattatggtgcaaaggatcaattttgatttagcaatcctcacatgaaagatgaaggtgtaagacttcttttgcacaaatgttccgtgactttaatattaagcatcactaaaaatgagcatgtttttatctcttaggcagacttgttctgctctacttttttgcatctctgagtattttgtgaatgtttttttgttgttttgttttgtttttgttttgtttttgagacagagtccagctctgtcacccaggctagagtgcagtggcgcaatctcagctcactgcagcctccgcctcctgggttcaagtgattctcctgcctcagcctccagaatacctgggattacaggcacgtgccaccacacctggctaatttttgtattttttgtagagacggggtttcaccatgttggccaggctggtctggaactcctgacctcaggtgatccatccgccttggcctcccaaagtgctgggattacaggcgtgagccaccacacccagctaatcctgtggatttttaaattaatccaacagttatattgtgagccaagagaacttactgtccactctggccactccaccccaagtttgttttgtggtgctgttcacttaggcaatcattcctgtttgactaaatgtgtttttctttacactctaagctaatattaggaatctcttactattaaatacaaagaattttgtatcctgtttggtttcaagcttccaaaatcccttttaaccaacagtttatagtgaagaggatcaaacacaacatttataattcctaagttaacttttttttttttgagatggagtctcactctgtcacccaggctggagtgcggtggcgcagtcttggctcactgcaagctcctcctcccaggttcacgccattctcctgcctcagcttcccgagtagctgggactacaggtgcccgccaccaagcccggctaattttttgcatttttagtagagacagggtttcactgtgttagccaggatggtctcgatctcttgacttcgtaatatgcctgccttggcctcccaaagtgctgggattacaggcgtgagccaccgcgcctggccctaggttaacatttttgtttcacttaaaacaatataggtcaatccgagtttggataggtatatattaaagcaccttttttttttttttttgagacagtctcactctgttgcccaggctggagtgcaatggcatgatctcggctcattgtaacctccgcctcctggcttcaagtgattctcctgccccagcctcccaagtagctgagattacaggtgtgcgccaccacacccggctaatttttgtattttttagtagagatggggtttcaccagttggtcaggctggtctcaaacgcctgacctcgtgatctgcctgtctcggcctcccaaagtgctgagattacaggcgtgagccactgcgaccagcctaaagtgctttttaaaaatcaaattactttgctttaatacgtcaaggtagttaacctttgggctaactttatgcagttagttgttatataacagtttatttatagttagagaagccataataaaaaaaaaaacttcactgggcaagatttatttcaaggctaccaataccattatcaaagagaataggccagagttgtgatagttttcagataagtaaggtctcaagaatttgtaaactattctgaacactcatctttatttattataaagtaatcgtagatcttaagatgcatagctacagtcatagtcttcagtgggaattgtgtttttttatttgctcgagcttttgtttaattttgtagtgggcagaagtctagattcaaatgtattgtgtaagttatttccatattggaacgtgttttgttctttgcaaaacagttcagaaggaatgagaatggttataaaagtttgcttttctccttttcctaaatttattttgtcttttactctttactatctcttatctaggctctaaactggaagttgtggatcttatagtagtacttttctagcaatgtgttcattttaattcatcccacagaatgtccctggagagattggtttaaaggacttttacctttgcttgatgatcagccatgggcaatattagagctataaacctgatttttattttgaactaataaaatatgtatcttttttgtattacagtagctcttccttatccatgaggaatagatgctaacaccctcagtagatgcctgaaattgcagatagtgctgaactctatatatactagtttttcgatcccataacagagacggctgcagtttaagcatccctaatttgaaaatcccaaactttttgagctttcacatgacactcagaggagatgctttttggtgcattttggattttagttttcagattagggatgctcaactgataagtataatgcaaatattctaaaatcagaaacacttctggttcaaagcatttcagagaagaagtgctcaacctgtactaagtgactaccaggcaggtagtgtagtgtatacagtgaagataggctggacaaagggatgattcacatccccagcaggacggagcagcaggatagtgggagacttttatcacactactcagaatagtgtacaatttaaaacttaggaattattatttctggacttttccatttaatattttcagactgcagttgaccaccaataactgaaaccttagaaagcaaaacctcaaataagggggaactactgtacctaacacagaatcctttcttggtacataggatttacagtgaaattaatccctaaagatctagtccttagtttttctgtgctaagcagttaaagaagatatttcctgccattgtgccttcagaacagtgaatttggctgggaacagtggcccacacctgtaaccccagcacttttacgagactgagacaggttgattgcttaaagctcagtagtttgagaccaccctgggcaacatggtgaaacctggtctctataaaaaaataaaaaataataaattttaaaaaacaatcaatttaaaataaaaacaaggtatcttctagttttttgttgttttttgttgttgttgtttttctttctttttttttttttttttaaagacacagggcctcatctgttgcccaggctggagtgcagtggtgtgattgtagctcactgtagccttgaactcctgggctcaagtgatcctcctgcttcagcctcccaagtagctaggactgcacgggtaagccacaacacccagctaatttttaaaattttttttgtagagatggggtctcgccatgttagccaggctggttttgaactcctggcctcaagcaatactcctgcctcagcctcccaaagtggcatgagccattatacccggctgtcttcagtttaacctaagctatgtaaaatgatttggctatttttatagcccttttgtgtgatggctttctcactgtctaatttagcatgacattattctaactgccaaaattgcctacccaagagagggtctaattgttattttccacataggagaagttattttcattgaatctcagcacgttaggatttacagatgtccactcagctatgtgggatggagtactgattattttacgcatataactaagacattaggatttcttgtttcacttttttgttgtttttttgtttttgtttttggagacaaggtgttgctctgttagcaagactgaagtacagtggtgcaattacatctccctgcagcctcctcacctgggctcagatgatcctcctacctcagcctcccaagtagctgggggcgtgccaccacacttggctaatttttatatttttggtagagacggggttttgccatgttgcccaggctggtcttaacccatttatgcaggaagttgcaaattttttgtgtgaaaaatcagaccttggcagtgaccttgagcagtaggatataaataactcccacaagcttagcattccaataatggaacactaggcataaatgggttaaaaactcccaggctcaagcgatccaccagtcatggcctcccaaagtgctgggattgcatgcgtgagccaccatgcccagcctatttttccactttttcactcaacaggctttctctgaatgcctgctatatgccggacccagtgcctagcacacacttagtcacatgcagggggtgggggatgggggagggagggagtatagaggaagggtcaacaagagcaaggtattgtagagtgttgagtgttaaacagggtagaatatgagccgtccatgcgcattctgagggtgggaagggctaaatatttacattgcaagatcagaactcagaatgtgtaaacatcaatatttttcaagttaggggattttgaatataaaaatcgttaaaattggctttacgtttacttaattaaaatgcttatgtttttgcaaaagtaggaaaagaagggattaaaaatgaaaaataacttcttataagagctgtctcggttttaaactcagacagaacagtcacattcctccccagcaattcttaaaaaaacagaaattagtaccatgagtaaaagagaaattacctagctttgcataatctcttgtgtctgtttcacaagtggatataaagatgacttttacatcctgttgccttttgacaagcattatatatcaaatacagagaaaattgattaagtgtggagaaaaaaacttatataaattaaattcagaaccattttgcttttcataataaaatgattgctcaaagaattccatttgatgactgttgaaagctcactgcagtttatgatataactgataaaatctgcatccttggccttccaacaacctttacaccagcagatggtgggcgtaaagatgtcattcatcatttatttacaatgggttttatttattctagtgtcaacagctgccccagggagtgggttattgaattcaaatgtgaggctctgggttatttgcttcctttcaaatttgtcttcagagcttagttgctaggagtccattctgtcctttaataatgattcgtgtattgtgaagccattcagtaaattgggttgtcagggattgccaaaaagggtttagaggtcttgcgggctggggaggttgcaggagcgactacatgtgcactacatgtgcgtctcgttgacttgagcaatcttgagcaatagcggtgttttgtaactttttcctaagactggtgaagttaagttttcttgtctctctttatgcactccttccctacctgctcttattctgtatatgaataatatgaaaatgtagaggacattgtattaaaggaaactctccaaccttttttttcgttacaggcagggcaagaatcctttcgttccatcacaaggtcgtattacagaggtgcagcaggagctttactagtttacgatattacacggtgagaacttgaaaactttgcaattcagtagttgatacagagaatttttctaaatagatgtggttaacagtaatgaaagaatagcttagcctttctgccccggctactcacctttaaaactgcatcttgagtccaatttaaatttactacagaaacctgcaactgaattgtttttcttatttgaattagcaccttcaaattgaaatcggccatattatttattcattggaattttctaaagtgtgattacatttaatttataaactgaaatacaatcagtgaactctaaacccagatatggtgcttaaaactacttctcgttacataagtggatatggctaaaagtggttctctttaaaaatatgtatattgttcgttgtatactgagggaaatgctttgaacatagtaattaaattattatttatgtttaggagagatacattcaaccacttgacaacctggttagaagatgcccgccagcattccaattccaacatggtcattatgcttattggaaataaaaggtaaaaaggctaatttagagcttacattgcattagtgatgaagactgtactgtttatttgactactttccttaacatttgttcaaatgtgagttaccagcctcttaaattataaaatttcggaaattctaaggtgtttcttttgatttttaaaatgatgttaataagctttgttggaaattattactgttattattagaaatagtttttgtgtaaagaaatactttaaaaagtaatctgaaggagttttatcagattactgatgtaaagtaaagcctactgatttatttggggagttggattgaacatctttgtgctgtcaatttaaaatgctattatatgggaaaaccttcttgcttgaccagtttccataaacttctaagagtgtgggaaagttttcactaatttttgtagaaacttacagtggtaagaaaatattagtattttcaaaatgctaggcaccattctttttgttttgttttgttttgttttgttttgttttgttttgtttgagacagggactcactctgttacccaggctagagtgcagtggtgtgatcatagctcactgcagcttggcctcccgggctcaagggaatcctcctgcctcagcctccaaagtggctgagactgtaggcatgcacaaccacagctagtttatctttttatttcttataaagaaagggtctcactttgttgcccaggctggtctcaggctcctaacctcaagtgattctcccacctgggcctccaaaagtactgggattataggcataagccaccacacccggcccattcattctttagggttatattaataaaatactctgaagagatgctgtttttagataggtaaaatcatgacttatatgataatgaagacatctcaaaacttttatctcattaattaacaagataaggaaactggtaagatatttcagccagttcaaaagggaactcaaattactatacattgataatcaaataaagaaactgaaatgaatttacaagatggatgcaaaactgaacagtattcacagggtattaattgtattccacaggacacagtctgcatttccatggacaggaattatttgcgtttattcccacaagttaacttctctctctgcagtctttgaaaatgtgtgagatgcagttaaaatagtactatcaagaaaatttttaaatgaacagcctagggccaggtacagtggctcacacctgtgatcccaacactttgggaggcccaggtggaggattgcttgatcccaggagttcaagatcagcccgggcaacacagggagactccatctctacaacaaattttaaaatttagctagacatgatggtgcattcctgtgattccagctactcaggaggctgaggtgggagaatcacttgagcccagttgaggctgcagtgaactgtgttcatgccactgtactccagcctgagcaacaaagcaagaccttgtctcaaaaaaaaaagaaaatagcctaatttttttgccttaagaaactagaataagagcaaatcaaagttaaggaaagcctcctgcccgttaaaaaaaaaagagagagagaaaaccaatgaaaccaaaagctaattcttcagaagataaaataaaatagatactgatcaggaaaaagacaaacattagcaatatcaggaaagaaaggttgacatcactatagataaaaaaaagagagagaatattgtaaacagactaaataaatgaagagatataaccatgttcatggattgtaaaactaaatataagatgtcttctcaaatttatctaaaaattcattgaaggccaggtacaatggctcacatctgtaatcccagcactttgggaggccaaggcaggagcatcacatgaggcaaggagttcaagaccagcctgagaatgtagcaagaccctatctctacaaaaaataaaataataattaaaaaaaactagctaggcatgctggcacacgcctttagctctacttactcaggaagcagaggtgagaggatcacttgaatccaggagctcaaggttgcagtgagctatgattgtgccacctgcactccagcctgggcaaaagagcaagactctgtctccaagaaaaaaaaaaaaaaaaaaagatttattgtaaccctaatcaaactatcaaacattggcagacttttttgggagggtagatattgacaagctgactttaaagtttatgtgcaaaggccacggaatagccaaatcaactttgacaaagaggcacaatattggagagaatttactattctacaaattttaagatttattatactatagtcaatttactattgtttggcataagcagacatagatcagtagagccgaataagaagttccagaagtagattcatatatatatgatatattaattttttgacagagatgctaatttagttgaagaaggggtaatctttttcatcaaatggtgctgaaacagttaatagtcatatgtaaaaatatgaacctcaactgttacattataccatttacaaaaattaactggaagtggatcatagacctaagtgtgagagctaaaactacttaaaatttctaaaagaaaacaaattgtagtgaccctgttttggcaaacatttcttaaatgggacagagaaaagcatgaacttatagttcagaaaaaaaatcaataaattgttctttaactgaatttaaaacttttgttcttcaaaagacggttacactattatacaacatcgtgacatggttaatgatgatatagtgcattctggaaaaatgctgaaagagtggatgttaagtgttctcaccacaaaaaacgataactgtgagataatgcaaattagctagattaaccattccacagtgtatatatactttaaaacaatatgttgtacatgataaatatatgcaattttacctatcaatttaaataaataaatttgaagaaaaacggttacaaaaatgaaaagacaagctacagactagcagaaaatatttgtgaaaaatgtatctgacaaaggatttatatctagaatatatgaagaatgcttataattcattaataagaagacatccactttttaaaaatgatctaaagatttgaaccagcaattactacagaagatatactactgatgggaacgtaaaatgatacaatcactttggaaaacaatttggtagtttctttagaaattaaaaggccgaggcgggaggattgcttcagcctaggagtttgagaccagcctgggcaatgtagggagacttcttctatacaaaaataagaaattttttaaaaaagtagctgaacatggtggtacatacttgtagtcccagctactccagaggctgaggtggtaggatcacttaagcctgagaggtcaaggctgcagtgagccatgatcatgccactgtattccagcctaggccacagagcaagaccctgtctcaaaaaaaagaaataaagcacacatctatatttcctagccactttactcccagatgtttacccaacataaatatgtcttcatgtgtccacagaattatgtacaaatattcataccagctttatttctaatagccccaaactggaaacaacccaaatatcaattaacagatgaatcgaaaaatagtgatacagcattacaacagactacaactcagctataaagaggaatgaactattgatacatgcagcaaaatggatgattctcaaaataattacagagtgaaaaaactcagaccaaaaataccatgtgattacatttatataaaaatcctagtaaatgtgtactaatctgtagtggcagaaagcagatcatcagctgcctagggtgcaggggcaagaagggatggattacaatggagtatgaggaaacttttgggagactgatggcttcacgggcttacatatcttaaaactcaacaaattttgcatttaagtacaacttcttttatgtctgttacacctcaaaaaagctataatgtaaaacatcgttatactgtatagattttagagtgttgttttaatagaaattgagatttgctattaagagaaaatattacctaagtgatatttacattataaaaagctaaacattgtttacttctttgtgtagagaagaaactattatcatattctctgaaggcctttcttgggtattcttttccacatttaaatcatctcactaaacctttttaaggttataaagctattggagggaagttttagtctttctatgatggaaatagttattctgtcattcaaggtatgaaataataagaggagaatacttggaaaataaagagaatttttatccttttattttaccaattttttccttgtggctgaaacatgatgagtgacagcttactggtggcttaaatttggtcaccgaccactaggagctgatagttcaaatgtgagaagaaataaacaaagcatagtatgtaaacgagatgtttctgatgatcgtaggtgggtgacctttaaaatcaggagtataacgaacaagaaagaacagagagaaataaatgagatgattatttttagatgaattgaactgtggatagacatcaaaacagggaataagcaatttttgaattagacgcattaagcagtagggagccagtgaagggcagtgacctagtcagagcaacagatgacacaaatttttcttactatggcattttattaataaattggttatataagaaataggaagcagagatttaaaaaatgaaagttttttaatagtgtaagggttgtaatgcaaaccctaaacaaaaaggggccataaattaaaagaaagatacttaagtaacctaagcaacttaagtgggattcagagggagtgaactaagacaacaatatgatgtaatgcctggaaaactgaggtatttttaaaactttgcactaagtatatcgtcaagtactatggcttttgagttttttgatttgacctatagtaagaaatgtattttacatcatgacctagtaaataaattgtgtatacacctacacatataacaaaatattcgtaaattatacctttatacgtaagttccatgaaacagtagatggaacttatgtatataggtgatagactctgatattttatattgtttcttttttttttcccttcccaagatggagtctcactctgtcgcccaggctggagtgcagtggcgcgatctctgctcactgcaacctccgcctcccaggttcaagcaattctcccgcctcagtctcctgagtagctgggattacaggcacccaccatcatacccagctaatttttgtatttttgtagagacggggtttcaccatgttggccaggctggtcttgaactcctaacctgaggtgatccacccgccttgcctcccaaagtgccgtaattacaggtgtgagccaccgcacccggcctattgtttctttttttaaaaaaaaattctgattatttcctactgagtgatttttacaattcattgagtcatgacacagtttgaaaaatcctacccaggcttaacgcagtgtctcagtcctgtagtcctagcaattgggaaggccaaagtgggaggatcacttgagtcctggagttcaagaccagcgtgagcaacatagtgagactttgtctctgaaaaaattaaaaaaaaaaaactgccctggaaaagccttggcacgtgtatacacaaatatatatatatattttatatatatatgtaaaatacatatattttaatatatgtattttatatatatataatacatatatatataatgcttattgtaacattgtttgtaataatgaaaaattataaataactttgccttatagagaatttaagttgtattgcattcattcagtagactgtaattcaccagtttaaaaacaaactagatctgcatgtattatatggataaatttgaaaaacatagtgttgaccaaagttaacaagttgtaaaacagtagctacatctgaatttttaaagacatgaaaaagaaatactatttatggttataaacatgaggataaatgcaaaaacatgcatgagaatgaaaacaccaaatttaggtagtggttacctttagggtaagagggaggagagtgggatcagagacacacaggtggtgattctgctgttgctgattttatttcttaaagggaaagaaacctgaaatctggcaaataatatgtcaaggctagctggaagtatgtggacattatattatacatcttttttcatgtataaacatgtaataataaataatatataaaaagtaataaatataataataaagttttttaactttaaaaataaaacacgctttaaaagcaactgctacctcccctcccccccactaataaaattctagtatgataaaaatgaataccctgctttcattggaaatttctagcttacactttctctctcactccgtttctccttttctgtctctctctactccttctccctccctccctccctctctctctctgtctatatcaattttgctttaagaggaaactgggaattaaacaaactgggatcaatgatgtaatgtatctttagtactttggattttctaaacaatttcctgtagtttctgagagttgtattttaatcacattcatagaaactcagtcagtctggccaatggaggagaatagtatagtcctgctctttcaaattatgttaagcaaaatggctttcttctctgggaatgcactgtactcaaagatataaggtattagactagaggctcccttaagttacggctagttctaacgttctaaaactctaacacagaatctttcttctgttggattgttagttctttgaaactagacagtgtgttctaaatactaaccctcataataccctgaataatacagttagtatgttaaaaattaattaaaagaatggtcatcacaactttgaattccatggtacactttccacaaatgcttctgtttgtaccatgttgattagtaatgtgaccctttctttcccatgtttagtgatttagaatctagaagagaagtaaaaaaagaagaaggtgaagcttttgcacgagaacatggactcatcttcatggaaacgtctgctaagactgcttccaatgtagaagaggtaaataagaggccctttaaaatcttcatctttatacttaatagaaatgttttatatatcttcattttacttattatttaagtttttagtcggatggtctttgaacatcataaagtaggaaagtttcttccctttgaaatcccttgtaacattcaccttctgtcagactcttaaatcatattgagccttctaaagcctgaatgttttcttacatttttgtacgtattttcactccctccctttttctaaacaatttcctatagtttctgagagttatattttaatcacattcatagaaagtcagtctggccaatggaggagaatagtgtagtcctattctttcaaattatgttgagcaaaatggcttctctgggaacccactgtactcaaagatataaggtattggacttcttcgtgttgcatggtagggaaatcttttttgtgttgcatgggagggaaacaaggaaccacactaatgaaatttggaaatgtttcaagacagcagaacgtttgtagctatttatatccacttctgcttatttttttaattttatttatttttttaactgtcaatatattaccacatcaccacttctgcttaaagtattctattattgctgtgtaacattttacaaagcatgagaattctgtttcatctattgatgaaatttgtattatttcagttatttccattgatgaacctgaactattggaacttttctgaacacagtgtattcttttatgctctatgtgtttgtgtttggaggtagtatgtatatacatattataaatagatgattacgtagttgatcctttctaaggtaaatgtattactatactgttattttataaaaagaggtaatgaagctaagaaaagtagtagtttatccaaagtaatacttagttcccgatttctagataagaacagcttataagagcaactacagaaagtagttctaaaaaacaaatgagttaagaatcactgccgtaaggataacagaggtcagggtcctgggcaacagctagcatgtgccttcaatgtagtaagcagtcagtaaatatttattaagaatgatacttggagctcttctgattaacccttgaacctaaaaattgactacagtaattctacagcattggtattttcaccgaagaattctttcttaggtaaaatattatacagtcatgtgttgcttgacaaaggagatacattctgagaaatatgtcaccaggtgatttcatcgtcacgtgaccatcatagagtgtacttacataagcctagatggcatagcctactactgcacctactacacacttctcttagtagaccttggtgccagaggaatgacacagtgatgatttcccttggttttctttttgccacatacccgagactgggtgctagagaaacaggcaacctagaaaggtcaacaggcacagaaaaagaaagtcttctagccagagaaccaggaaataggcaggtcagaacagtgttcgcaagccagaacactcttagaaagtaaccattctactgtagccaaacatcacagaaaaaattgtggctctgcttccacaatccccaggcagtaatgaagtagcaccctaccaccaccatttcccttgttggagtggagtgagaggaagccaactaaacagtggtttaaataagacccagagtctcataacatagtatctaaaatacccatgtttcaatagaaaatcattcatcatacctagaaccaggaagatcttaaattgaatgaaaaaaagataataggtgccaacagtgaaatgacagtggtgtttgaattatcttacaaagattttaatgcagcaatcattaaaatgcctcaacaaacaaggaacatgcttgaaacagaagagtcttagcaaacaaacaatctgagcaaaagaaatgcaagataaaaaaaagaaccaaataggaattttaaaataaaaaaaaatacaataattgaaattttaaaactctttcaaagctctttgtacactagaaaaaaaaacttagtgaatggactcaacagcagaatggagataaaggaaagaaatagtgaactggatgatagaacaatagtaactacttagtctaaactgcagagagaaaattgaggaaacaaatgaacactacctcagggacttataggactgtaacaaaagctgacgttatatgatgcatcataagtcctagaaggagaggaaaaaggaatggctctgaaaaatactcaaagaaataatggctgaaaacttcttaaatgtggcaaaaagtatataaacctacagattgaagacagccccaaagaggttaaacccagacaaatccacatgatgacgaacctctgtatggtcaaatttctgaacgtgaaagacagaaaaaaaaatcttgaaagcagcaaaaaatagcaccctacatataggggaaaaacagttctaatgatagcagatttctcatcagaaaccatggaggacagagaaaatagcacagtgatttttgtttgtttgtttgtttttattatactttaagttctaggttacatgtgcacaacgagcaggtttgttacctaggtatatatgtgccatgttggtttgctgcacccaccaagtaatcatttacattgggtatttctcctaatgctatccctcccccagcccttcaacccccaacaggccccggtgtgtgatgttccctgccctgtgtccaagtgttctcattgttcagttcccacctatgagtgagaacatgcggtgtttggttttctgtccttgtgatagtttgctgagaattatggtttccagcttcatccatgtctctgcaaaggacatgaactcaacttttttatggctgcatagtattccatggtgtatatgtgccacattttcttaatccagtctaccattgatggacatttgggttggttccaagtctttgctattgtgaatactgccacaataaacatacgtagcacagtgttttgcaagagcagaaagaaaagaactatcagcccagaattctttacccagcaaagaaaaaaaagaattagcaatgaaggtgcaatcaagacattcttagagaaggaaaaaccaagaatttattagtagcagatttgcataaaagaatggctaaaggaagttttctaatagaagtgaaatgattgaagaaagaatcttagaacaccataaaggaagaaaaaaacataagaaacaaaaatatggataaatatgatagacttttttcttcaagtcttgcaaattatgtttgatgtttgaagtataaacaagtaaccactgtctgatgtgattatcagtgtattccacaatattataagccatggggaataaagggatttgattagcccacaggaaggcaggagaaggaaaatagaaaacaaagtaaaatgtcagatgtaagccctcatatatcaataactaaatgttggtggtcaaaatacacaaatcaaaagggattagcagagagaattttaaaaacaatgacttagctatatggtatttataagaaactcactccaaatacaacagtacagttaggttgaaaataaaatgataggaaaagttatacaaatattaatcaaaggaaaacaggagtagctatattaatatcacataaacttaagggcagaaaaaaattatcagagtgggacattatataatgataaaagaatcagccctccagaaagatgtgacagtgctaaacatgcgtgtaccagatatgtgaagcaaaaactgatagactgcgaggagaaatagagaaattcacaattacggttggagacttcagcatcccttaggtgctcacagaatatataccaagatagaccgtgtcctgggccataaaataaacctcaatagattttaaagtattgaaatcatacggaatgtattctccaaacaaaatggaattaaactagaaatcagtttaacagaaaataggaaaatctacaaatacttggaaactaaacagtacgcttctgtgtgtcagtgagcaagtcttgaattacaaaaaacacattgaactgaatgaaaatacaacataccaatttgtggaaaatagctaaaacagtgttacgagagggaaatgtatatcattaaatgcacacaatagaaaagaagaagtctcttccttatacgttatacaaaaattaactcaagatggattagagatttaaacataagacctaaaaccataaaaaccctggaagaaaacctagacaataccattcaggacataggcatgggcaaagacttcatgactaaaacaccaaaagcaatggtaacaaaagccaaaattgacaaatgggatctaattaaactgaagaacttctgcacaccaaaagaaactatcatcagagtgaacaggcaacctacagaatgggagaaaaattttgcaatctatccatctgacaaaagggctaatatccagaatctacaaagaacttaaacaaatttacaagaaaaaaacaaccccatcaaaaagtgggcgaaggatatgaacagacacttttcaaaagaagacatttatgcggccaacaaacatatgaaaactcattattactggtcattagagaaatgcaaatcaaaaccacaatgagataccatctcatgccagttagaatggcaatcattaaaaagtgaggaaacggccgggcgcggtggctcatgcctgtaatcccagcactttgggaggctgaggtgggcggatcacaaggtcaggagatgagaccatcctggctaacagggtgaaaccccatctgtattaaaaatataaaaaattagccaggcgtggtggcaggcgcctgtagtcccagctacttgggaggctgaggcaggagaatggcatgaacccaggaggcggagcttgcagtgagccaagatcacaccattgcactccagcctcggcgacagagtgagactctgtctcaaaaaaaataaaagtgaggaaacaacagatggtggagaggatgtagagaaataggaacacttttacattgttggcgggagggtaattcagttcaaccattgtggaagacagtgtggcaattcctcaaggatctagaaccagaattaccatttgaccctgcaatcccattactgagtatataccaaaagtattataaatcattctataaagatacatgcacaggtatgtttattgcagcactgttcacaatagcaaagacttggaaccaacccaaatgcccatcagtgatagactggataaagaaaatgtggcacatatacaccatggaatactatgcagccataaaaagggatgagttcatgtcctttgcaggggacttgggtgaagctggaaaccatcattctcagcaaactaacacagaaatagaaaaccaaacaccgcatgttctcactcataagtgggagttgaataatgagaacacatggacacagggcgggtaacatcacacaccagggcctgttggggggtgggggcctaggggaaggatagcattaggagaaatacctaatgtggatgatggattgatgggtgcagcaaaccaccatggcacgtatatacctatgtaacaaatctgcacatgtatcccagaacttaaagtataatttaaaaaaacaaaagaaaagaagtctcaaaataattttaactcctacttcaagaacccaaagcaaaataaaccataaaaaagaaaaacccaaaataaatagaaaggagggaatattaaagataagagcagagattaattaagttgaaaacaaaaatcagtgaaacaaagagctggattttttaaaaacttcagtaaaattggcagacctctagcaaaactgacagaaaaggtgcaagttaccaattatcagtaacaaaacagaagctatcactacagattctccagacataaaagaggtaattagggaatgctgtgaatagctttacccacataaatgtgacaacttagatgaaatagaccagtttatccaaaaacacaaattgctacacccagccagtatgaaaaagttaatttgagcctgggcaacatggtgaaaccctgtctctactgaaaatacaaaaagtagctgggcgtggtagcaggagcctgtaatcccggctactcgggaggctcaggcaggaaaatcgcttgaacccaggaggcagaggttgcagtgagccgagaggcaccattgcactccagcctgggcaacaagagtgaaactacgtctcacaaaaaagaaaaaaattgaatagccctataaactacaacggaaattgaattcatagttttaaaactccccaaaaacgaaacctctaggtccaaatggtttcactgcggagttctaccagacgtttaaaaaaggaatgaacaccaattctagaccatcttttgcagaaaatagatgtaacacttccctatttattttataaaactgattttactctgacactaaaaccaaagacaatacaaaaaaaggaaaagtacaaaccaatagcctttataaatatataagcaaaactcctcaacaaaataccagaaaatagaatttcaacaatatacgaaattgtgtatgtgtacgtttataaagtatatacatcatggccacatggggtttattccagggatgcaaggcttgctctgtattcaaaaacaaatcagtgtactccaccatttaatagggtaaagaagagaaaccacgtgattatagcagttgatgcagaaaaaccatttgacagaattcaacacccatacatatttaaaaactctcagaaaaataggaattgaggaggacttcctcaacttgttaaagagcacgtgaacacacaccaaaaaaaaccccacaactaatgttatacttaagggcaaaaggtcgaaggccttgttccttagattaggaacaaagcagtaatgtctcttctcaacattaatcaacatattgatggaagttctagccagtgcagtaaagcaaaaaaaaaaaaaaaaaaaaaaaaaagaaaaggcatacaactaagaaaggaagaaataaaaagtgttctatttgtggatgatgtaattgtctcagtaggaaatctcaagggatttgcaacaaaaaaaagtgagttcagcaaggttgcaggatacaaggtagacataaaaatcaatcgtatttctatgttttagccatgaaaacatgaacaccaaaactcaaaatatatcatttttaagcacacaaaaaataaaatgaaatacttaggggtgaatctaaaaacagcatgtgcaggccatgtattctgaaaactacaaaactacttacagtggtgaaagaagtaaaagaaaatctaaataaatagagaggcatactatgcctactgtttggaatattcaaccttgtaaaatgtcacttattcacaaattgatataaatgtttaacacaattcatatcaaacttccagtacaatgttttgtagatatagacaatattattataaaatatatatggaaaggcagaagaactaaagtagctgacacaacttagcaaaggagaataaaatgggatggatccacccattgatttcaagttttgcttagccagtcatcaggactgcgtgatactggtaaagggatagacacatagatcaatggaacagaataagtaacctggaaacacgcgtacaaatatgcacaactaatttttaacaaaggtgcaaaagtagttaaatggaagaagatagccttttcaacaaatggaactctagcagttagaaatccaaaataaatgaacttcctcctaagtctcacaccttaaaaaaactaacacaaaatcctggagttaaatgtaaaatatgaacatatttatcttttaggggaaaaaaaaagaaaaagaaaaatttcagtatctgagccttagcgtatgtgtcaccaaaaggatgattcataaaaggaaaaagtgataaattagctttcaaaaactttagccttgtgaaagactgtttaagtagatgaaaagacacatcttcagagtgggagaaaatatttacataccaggtatccaacaaaagactagtggctagaaataaaaattctcaaaagtgttgagtaattttactcggtagtaaaaaaaaaaaaacaatgcaattacaaaatgggcaagagagatatgagcagatatttcattgaagaggatctacaaatggcaaataagcactagaaaagatctttgacatcagtagccattagggaagtagaaattaaaacttcagtaagccaggcctggttggtgtaagctgctactggggaggctgaggcagcaggaggatcacttgtgcccaggaatttgagactggactgggcaacacagaccctgtctcaaaaaagaaagaaaaacacccaatgagctgtcactacatacctgtcagaatgtcagaaaggctaagatgaaaaatactgagaacaccaaatgctgaagagaatgtggagaaaccagatcactcttacgttgcatgtgggaatgtaaaataacacagccactctggaaaaatggcagtttctttaaacactaaacatgcagctaccatacatcctagcagttgcacccctggacatttatcccagataaatgaagagttaggttgactcaaaaacctatacacagatgttcatagtagttttattcagaatggccaaaaactggaaacaggctagagacattgggttgaaggacactttagtggctgcatggttacagtgtggtccatctataccatggaatactactcaacaataagaagggggaaactacagatactatacagcaatctggataaatctggagagaactatgcttagtgaatcaagccattctcaaaaggttgatcctgtattatcccatctgtgtaactttcttgaaatgataaaaatttttgtaacaatgtactaatactgtagttttgtatgaagtcactactggggggaaactacataaatgttacacgggattcttctgtattatttcttacacctgcatgtgaatctgtaattatcttaaaacaaaaagtttaatcaaaaaataactgtgtacatccaacttaaactgattgagtcctttaacaccatgatgacagttttaaaaatgagaattcatcaggaagaagcctcctaaccacaataaaatactaatgttagaatatggaatatggctatagaagcttgttggtattttatgaattcttgaagaatacagattttcaaattactagatttttggctctgtatgttgcgtttctgcacagggcaaacttttatacaaatagttccctccatatatgtttagcatatgcctagcaaataataattaatgttgagatttttattatgcatagactttattttctttctttttttttttgagatggagtgtcgctctcacccagttgggaatgcattggcacaatctcaactcgctgcaaccttcacctcccaggttcaggcacttctcccacctcagcctcctgagtagatgggactacaggcatgtgccaccacgcctggctaatttttgtacttctagtagaaacaaggtttcactatgttgcccaggctagtctcaaactcctaaactcaaatgatccgcctgctgtggcctcccaaagtgctgggattataggcatgagctgccatgcccagcatattatgcatagactctcttaattacatttctcagaagcagctaaagatgaaattgtactaatatggaataagaaagtcctggttagaagaaaaaccgcattcattcacaatgtccacatgacagatttttaagtaaaaggcatttttaggacaatacacttttattcattagcttatttttctacatcatgtatatcaaagcattttggtaggctcacaatgaagttgatagagctggtgttaagcctcattttattttgtttttttgagacagggtctcactctgtcacccaggctggggtactgtggtttgaactgtagcctcaacctcttgggctcaagtgatcctcctgcttaagcctcccaagtagctggaatgacaggtgtgtgccaccatgcccagctaatttttttttttttgtagaggcaaagtcttgccatgttgcccaggctggtctcagactcctgggttcaagatatcctcccaccttagcctcccaacgtgctgggattacaggctcaagccactgtgcctgggcagcctgctcttaaaaattaacttaatcggtactatcacttaaaaaagtaaacccttatagacatcatctagttttagaagttaccaccgtgtagacattttgagtcttatatcccatttgttgagcaaatgccagaaatatttttacctataaatatttcgatataagtaattttaaaaaatataacacaataccattatcatatataacttaacagcaattccttaatatctaatataaagtcttaatgtcatcccttttatttcattcaacaagtaatattggaaaacaagtatttagtttatttgggatcaaggaagactaacaaaagggtttcttcctccttagagaagtaggaaggaggagaactaaaccagcacttatttggtatctgccttttgataggcattcaccatcagttcctatggcaggagagccaagaccaaactatgctgctgacaaattacaatatactgtctcagagatttaagcaagaattatcctgcagaattagatccaaggaggtaaatgttaggcatgcatggcccattgattcttgatcaggttgacccttggacttagaaagaaacagcaattacagtaattatggggaagtttgttctaagtgctatgccttatgtttttgcttttcaagggctcagatttgcctaactatgccatccttttgttccttaggagaataagcagagctctatgggagaggcggtttagcacagtgggtagaaactgaccgtgggctcagacaggatctatcctcagcttgctctctggaggactctcttctatgagagctgatcatgtgatgggttaagaataaggcaggtattctaatgacacatcccacttgtctagtgacagtggtggttggtgttgggacatttcagagaaggtcatcatcctgttttttataatctgttgagaattattcacatcccagctgatccttggcacctatgtgtagagaaattttaatgcacagggaaccctcttaaaagattttttagactattattatttgttaagattaaatataaatggcacattgatgatgtttagaattggacctgtttccttttgatgttgtgctgtagtctatttatacatgttcaccaagacccagttactgtaatacaagtggacaccatgaagtttaactgttacagttccctgtaagggattggataatttacagcataagataacaacagctttgttccagcactagctgtgttgttgctggaaataagtttactattagtctatagatttcctattaatcagctttatgatttcatccaagaaggatctgttgagggggaaaagaggcaacgtggtaaatgaatgcaaaggatatctcctcataacacagaattatctcgtccaaaatgtcagcagtattgagattgagaaacactgaattagaataataaaacacagttcaactcaaggaaatgaagcacccactcagcataatatatgaatcccctttattcacttagtaataggagggatggtgctatgatattattattaaaaatgagtgcaaatgtcatagcttatgcctgtaatcctggtattttgggaggctgaagcaggaagattacttgacgccaggagttcaagaccagcctagccaacatagcaagaccctgtctctatttaaaaagacagaaagagagggagagggaggagaagaaagaaaagaaaagaagaaagaaaatagatgcttgattgatagacagacagatagggtttggatctgtgtccctgcccaaatctcatattgaattctaatccccattgttggaggtggggcctggtgggaggtgattagatcacgggagcagtttcttatgagtggtttaacaccataccgcttggtgcagttcttgtgatagttctaatgagatctgattgtttaaaagcatgtagtacctcccacctctttctctttctcctgctgtggtcacgtgaagtgcctcgctccccctttgccttgtgccatgattgtaagtttcctgaggcctccccagaagctgagcagataccactatcatgcttcctgtacagcctgcagaaccatgatacaattaaacttcttttctttataaattacccagtctcaggtatttctttatagcagcgggagaaaggactaatacagaaaattggtactgaggagtggggctttgttataaagatacctcaaaatgtggaaacaactttggaactgggtaatgagcagaggttggaagagtgtggagggctcagaagatgaggaaaaatttggaacttcttagagactgcttgaattgtgaccaaaatgctgataatgatgtggacaatgaaacccaggctgaggaggtctcagatggagattagaaaattattggggactggagcaaaggtcacttttgttatgctttagcaaggaagctggctgcgttgtgcccctgccctagggacctgtggaacttggaacttgaatggtgatgatttaagatatctggcggaaaaattatctaagcgacaaagcattgaagatgtggcctggttgcctctaatagcctatctcatatgtgtgagcagagaagtgacctgaaactggaacttagacttaaatgggaagcagagcataaaggtgaaaaatttgtagcctggccatgtggtagaaaagaaaagtccatttcaggagaggaattcagacaggctgcagaaatttgcataagtaaaaaggaaccaaatgctaatagccatgacaatggggagaaggcctggaaggcatttcagagacttcacaggagcccctccctcacaggctcagaggcctaggaaggaagaatggttttgtaggtcagggccagggtcagggccccaccaccctgcacagcctcaggacactactccctgcatcccagccactttagttccagctgtagctcaaaggggcccaggaagagctcgggacactgtttcagagggtgctagccacaagccttggtagcttccatgtggtggtaagcctgtgggtgcacagagttcaagagttgaggcttggaaacctctgcctagatttcagagaatgtatggaaaactttggatgttcaggcagaagcctactgcaggggtggagccctcacagagcacctcttctagggcagtgcagagggaaaatgtaggcttggtgctccacatagagtccccactggggcaccacctagtgcagctgtgagaagatgaccacgtcctccagaccccagaatggtagatacaccaacagtttgcacccatcacttggaaaagccacaggcactcagtgccagccagtgagagcagtggtggggtctgaaccctgcaaagccacagtggtggagctgcccaaggccttgggagcacacccatcacacccctgtgccctggacgtgggacatggagtcaaaagattattttggagctttaagatttgatgactgccctgctgggttttgaacttgtatggcacctatagccccttttttttggccaatttttcgtttttggaatgggagtatttacccaatgcctgtgtccccattgtatcttgaaagtagctaactatttattttacaggctcataggcaaaagggactaatacatatatacatatatatatataatgcttcatttcaagctgggggtggtggctcacgcctataatcccagcactttgggaggccaagacgggcagatcacctgaggtcaggagttcgagaccagcttgaccaatatggtgaaacctcatctgtactaaaaatacaaaaattagccgggcgtggtggcttgcgcctgtagtcccagctactcaggaggctgagacaggagaattacttgaatcagggaggcggaagttgcagtgagctcaaattgcaccactgcactccagcctgggtgacagagtgagactccgtcttagaaaacaaacaaacaaacaaaaatgcttcatttcagtgacaccctgagctgggagggagtaaagactcataggcaaaagggactaatacatgtatataaaatgcttcatttcagtgataccctgagcaaggagggagtaaagactaggaagtactgttaggaagtgacaccacttttatttttggagctgtctctgacctgtgaatcctacagtgaatactcttaaatattttagtatctgtccagatgatattggtacccagatcctttaactatacctctgatattccaactgttttgctcttacctgaatttatgctgcctatcttgaactaggatcttaaatttaaaatggcacccaagacaacactttgaagtttatttccaaagagcataagaataaaatgccctagtcttcctaaactaggtgttacttagcgggaagaatttctcaagacaggatcatagagagagagagtactatcatatactacattaataacactaatatacaaccacatagatatttattgtatacacaagtaatacttggaaaatctggattaagtaaaagtcgacaaatttttctaacagttgcccaagctatacctgggcctttttgagctgcagctagagctggagtggctgagatacacaagcagtgtcctgaggcaacacaggtggtggggccgtggcctgacctacaaaactgttcttccctcttagggcctccaggcctgtgatgggttgggctcctggaaagtctctgaaatgcctaaaattggaattggcgggggatgcgtaacatctcttaacataccatggactgatgtctgtgttattttgcttactctcttatttcatggtcactattatatgttgtggtgggtgcatggagactgctttttcttttttaagctaaactaagaatgcctcataagacttttctttttttcgggtcaattgtcttttttttttttttttttaagatttttttgggccgggcacagtggctcacacctgtaatcccagcactttgggaggccgaggcgggcagatcacaaggtcaggagatcgagaccatcctggctaacatggtgaaaccctgtctctactaaaaatacaaaaaattagccgggcgtggtggcaggcacctgtagtgccagttactcaggaggctgaggcaggagaatggcatgaacccgggaggtggagcttgcagtgagccgagatcgcgccactgcactccagcctgggcgacagagcgagactccatctcaaaaaaaaaaaaaaaaaaaaaggtttttgtagagacagtgtctctcttatgttgccgaggcttgtctcaaactcttcggctcaagcagttctcccacctcggcctcccgaagtgctgggattatgtcatgagccaccatgcccagcctacctaagtcagttgtctttttgaccagagcttcccaaatactaatgtacacttaagaattctgttaaaatgcagattctgattcagtagatctgtggtgtggcctgggagcttgcatttgtaaccagtcctcaactaatgtagatactgctgatccaggggtcacactctgaagagatagagaggctgtagaggagtccagtctgttctatcacaggacaatcaggcagagtgctgtctcctcccatttcctcagagatgttattgcttcaaaccatctcattatattcaccctttccttctctattgattcttggctcccagcatgtaattaagtttcaaccatcttataaaatcctttcactccatttctcctggatgtttttccttctggcttctattaagagctgtctccatttccttgttctttttctcacctgtcttcatagtctgacttcttccaccacggccaaggtcatcctggtcttcctaaaagccacaactaacaaatacttttctgggtttttgtttgtttgtttgttttggtatttatttttacttttagaaaaagtttattataaaaaagtaattgcatgaaagaaagcttgcaaaatagagaataagtaaaagaataataaaaacatatcatgcataatatgtaaaggctagaagaaaatacaccaaaatgttaacagtaatgatgactgtataggcgcccaaaaagcaagaattatacctttttttttctgcttttctgttcttagcttaaacagtcctttgggaatatttgatacttttgactactcttcagtaaacttctttcttagctccatgacaccgttttctttctttttctctttctctctctctctctgtgtctccccgcccccggtcctgctccctctccctcttcctctccttcttcctctccttcttcctctccttctcctccttctctctctcctctctctccttctccttctccttctcctcctctccctccctccctccctcttcctttacccccaccccacctcactggccttccccagattttttttaccagttctttgttccactttgagatatcacctaagtctgttacttcaggtaccattttaggctgtatgttcagctccaccctgacagctgctgcctagacagttgtgctgagtgatcttcacacccttccgatttaacacatccagctgaactgatagcccttctctattctagtctacagatcctctattctatagtgttctttctcttaccccttgacattgatttattcagttaatacgtatcacttttcacctgttattgtttctgcctattaaatatctctccaaattgtcttctgtcataattgtatcctaattggacttcctgtcttcatttttcagtcccttacactgtgacctctgggatctttctaaaaatgaaggttgaatgtctctctccagttttattaaccatgcagtggttccccacagcttcagcatcaaactccttagcttggcatgcaggatgctttgattgccaacccctcacaccatatgctctccatagtaaactaggagtcgatcagctttacagtgttctctccccttctccacaaaaaagtattctctgcacttgaaatgcccttccttccgacttgatcctccaagggtatggttaagtctgatccctcctctggaatgtgttccatgacaccagcatgtcttccttctgccaccagccaccacacacaacatctgaattgatagacttcttcttctccttattcctgtgttgtcctgggcatgaattcaccttagtatgatatcattgcacttgtttgtcatgtcggcccaccaaaaggattgagttctttaaagacacagactcttttcatttctgcaacccccacatggtagataacaaaagtttggatgagtaagtatgtatttgcttcaaccatgttcttcttccttcagtctttcattctggttatgctttggtcccatttgttacatgtaggtagaattctgtcctaaaccttatctttgcccaagcattttaaaacatgagattttagaaaatccaggtgaggctgggtatggtagctcacacctatactcccagcacttagggaggccaaggtgggcagatcacttgaggccaggagtttgagaccagcctggcccgcatggcaaaacctcatctctacaaaaaaataaaaaattagccaggcatggtgggacacgcctgctgtactcccagctatgaggtaggaggatcacttgagctcaggagggcaaggcttcagtgagctgagatcatgccactgcactccagccggggcaacaaagggagaccctgtgtctcaaaaaaaaaaaaaaaaaaaaaaatccagacaagcaaattggcctctcatcaggtgcttcttccttcagtagctgcctggaatctttgtggtttgaaaaggcctttttaggtggagagatgttcatgtcataatggcaggctaggtaaacccccacccttcccagaagccttatgcttatgctgctgaagtatttatgctactgaagtactagataccaccaagactatagctgaaaatacaaccagctaaccctaagacagattgcagtaacccaccaagccacctaaactgacaggatagatgaatttctatgtccagagagaacacatgacttactaagacattagtaactaggaagactaccagtttcaagtccccttgctaatacttgcattctgtctcagtacttgaaagtctgtagactttatttgcattgagggaccatcttgtcttgggctttgttgtaactggtggaatgagtatttttatgtagctgtaatgaggttgtaaactgaaggctttgtttcccccttaaatctattctgagtgttaagcccatggatgcataccacaagacttcagtggaaatctgacctggccttcctcagcagttttccagtatcccttgaggatagcttagtttaataaatatttaccactctcctccacattttggtagacttggctgactagcatcagcttcttcacctctaatttggccatcatccccggaacttcatagatgatccaaactctgactttgaaagttgcatccattttctgtacttctaaaccagggtggctaaacattacccaagaaaattatgctaataaatgcatgtcatatacttacacactcacatttatctgtagcttatattcccatataagtgcacaattatatagatcgccatctaccaagagtttcccacttgtacgatgtattagaattccacgtgtctaaaagaaatttttcattccttccttgaaaactgattttcttcctttttaatttatctcaattcatggtatacccttttatctcatcacttaaaccaaaagcggagtcatccataaacatatcaccattttactctgtcacttaaagtcctgttaatttcttcacaacagatattaggtttgagctttgccattcattctcgttgccaccatctgacctttctttcttgggtcattgctctggactcctcagtctccctgtggccagtatcgcccccttgtgattcattctctaaactctcctctgattttgtccctcccctgcttcctaccttttcagggttcctctgcctatagggccacatctctaactttatctcacgttcctggccgtcctcagcttccaacagaattgaacttaaaatctgctcctctgtccagaatgcccttcttcccctcagttttcctaatatatgagtgggagcttacctgtctttcaggccttcacttgcagggcttttctctctcagaagtggtcatgctaccttattcatctaagcaactgaaggtttttcttctatgttcgcatattggatgcatatctatcctatataccacatccttgagatgtaaggtattcatatttatctgagtgtcctcagtgcctggtacaaatcaagcactcaggaaatgcttattaaatggaagaactaaattgctaaggaattaaacatttttgtgttacctctgacagaaagtaggaacaggaaattctttttttaattgaaaacattttaatatttacttttgaatataaataagcattctaagaataacttggagtaaaatttttctttatgagctaagtttaaatccacttgaattacaaaacgtcagtcattggttcagtatactcagtactgaagagtaaaatgctgcaatatttatgatttttaaaactattaagtttacatagaaaaccaattattaatctgcattgcgcagctgttgctatgttatgctgcagcaacaaaccctaaaataaacaactatttttttttaagttctgggatacatgtgctgaacatacaggtttgttccataggtatacatgtgccatagtggtttgctgcacctatcaacctgtcatctaggttttaagccccacatgcattaggtatttgtcctaatgctctccctccccttttccccaacctccctacaggtcccagtgtgtgatgttcccctccctgtgtccatgtgttcttattgttcaactcccacttatgagtgagaatatgcagtgtttggttttctaggaacaggaaattcttaaatgccatattccccaaacctttctaatcaaatagttctagtttcttcccctcttcagtttcctgctaaaattaagatgtgtttaggctccctactttcctttaattagcattgatactggtgatactaatttttgtaaagggtaggaaagagacaaaagatgtaaataatacaaattttatatacttccaaaaataatcctagaaatccaatataatttctagctaaaagggttttaaaggatgtaggaagtatatgctttttatgttcatttttaactgcaacataaaacaaatgaaaattcctttgacttgtattaaagatagctgatcctaataaaggaaagatatatgtagtgagaagactattagattctaatcctgcgtctgctgtaattatgtgtggtcttgggcaagtcgtttctccttttgcagctcagtcatatctacaaaatgagaaaattatagattgtagatttagcaatggcccttttccttctagtgaaacacagagaaactgtatgagagaagtaacaccacaacagctctactttggaactggtgatgctatagaaagagacggggaagaggcagaggttctccctccacagggctgtccctactccatctcattccaaaaggtggcccctgcagaattgccttgaaatacagtttaaaagccactattggatgatatacgagtttttcttcactgacccgaaatcagatagaatcacagaatttgaagaagtttcttaaactccctaatatgaaattctagtctgctgtgcttttcacaggactctcctatctttgcccaatatctaagtcttattaaatatattttattttggggggctcattgtgcacattatatgttgccaattcacttttttaaggtttagctctatttaatcaagatatatgaattgactatagagcattgatcaccatttctctccttgactttggagtgtctgcagggcacatacacatttagcaccagtactcccttctcctgttgttccccatgtgtctttgcatccagacgttcatgccaacagctgacacacctattgggtgcttactacatgtcaagcacggttttcagtgctttacattaaccttcctagcaatcctatgaagtgggctacatttatctttcctttattaggatcatttatctttaatacaagtcaaaggaattttcatttgttttgtatgttgcagttataattgaacattaaaaaagcacatatttcccacgttatcatcctcattttacagagaggctaagcactggttccagagcaacacagctggtaagaagtggtactggggtttgatcctggagagcctggttctagagccctcagtaattctgttcattttaaaggtctaacttcatcccacaaatacagattttcttgaaagcaaaataaagttaacattaattttcttatttgtttacatacttagaatttcttttaagaaatagtgaaaacctttgtaaatcagtatagtgactgtcccatagtaaatacttagtatatattgattattattaacttaggcaaatggatacctgtaatgttcatagcattgacttttagcagttgagaagaaaagccacattttagctacctcatatttctcagttctaagagaaaactaaaagtcgcttgtttacaagataccctgctctgtagcatctgttcaagatatttaaactgtccaaaatactggtcttacctaatttttatcatgccaccaggtggcagcatgttatgtaaggaagtaatttaaatattctattgaagatcatttattttcaatattttgccttaaaaactgcccaaccataataaaaaataaaatagtatctcatgtttccctttgcctgcattctctccagtctattttaaagaccctgttagcacaatatccgtgagacctgccttaatccagccctgcattcttcttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggaccacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagccctgcattcttctatcggttagtgcagaaagtttttttcttccatctttatggagatttgagccattgggcttagattctgccaactaaatgattttattcctacctaaatagttcctattgttcagcaacaatagtcctcctcatctttgtgtcttccatggtacctgcagaagttctgaatatgtggcaacgatttttttcttaatagagacaggggtcttactacattgcccaggctggtctcaaactcctgacctcaagcagtcttcctgcctacgcctctttcagagtgctgggattacaggtgcgagcctggccagtgacaatagttttaacaggtgcccttgggtaaatgtcagtgatatgtaagatccacattagcgtgtgtatttactgaatgtttatttgaattagaacatatttatagtcttttgtggttacggttgtttcaactgtgcaatcgaagtccctgaaattttgccttaagtttaggtattatcagtatcattcagattaactgctgccaaacactgaaagattagtgtttgaggtggaaagcaagagaatgaatggctaaggaagaaaaggaaggtaaaggactgaatgtggcagttaaagtctgggggaaaggaaaggctagtggtaaaatgagagaggcaggcttcttttactgcaacagagcaccggccacatggggaagcaggaggaccaccaaattcagttggctgcagagaaatctgtttatacttcataatcgtggatctgcctagacattgcttgtttcatggtgcaaacagtgaaatcattgaaacaaatgaaatcatttgacatcagtttgttaacaaatattttttcctattctaaaacctattagttttgcctactgcttgtcccttaatgaagtcttaaaagagcttgcccctaaagagatgtacataagcaaaaagaaaccagcaatttcatgtaagcccaccttaccctgtaggtatttccttgctaagggtaattgagtttaacaaaggcggtttaagtacctatgctattttaggtattgtgctagagattcaaaactacaatatgtttaacatctatagataaggtatttttaagagaatagcttaaccattcaaattaaactaattctgtgaagaacattagtactgccttgagatatttaccaaccaatacttaaaatgtatttttgtacattatatatatatggaatgcagtggtctaaagatggattagaaacatctataccttaaaaagtttatatatgggattgatatttaatgaatagagtgaaatgatcaattttttaaaatcccagccaatgtgttatatacatacatatttctcatctttttggaaatgttttgcatcttaagtggaggagattttatctgtgacacccaaggctcttaccttagaacttttatttgacctctcataagccttactagtatttggttaatgttcattatatttaggaactcagcaatttcaaagtccatggccacatattttattgtttgtgtgtgtgtgcaaagcctagtgttattgcaaatagccacatacttttaaaacaagtatattaatgtctacatttgtcatgctgggtttcaaacgcaaaggactcattaaaattagtcattaatcacttagtaatatatattaaatattaatgtttgtcatgaagtatgtaaaacaacccgtttgtattgtatcctctataatatgctcagggggtagaaaatacttgattttattgtctgtaatgtgtaatcagagattgaacgaccaagtaatgtagcattatccaaagattatttgttatatttcagttgtaatggagttaattgcatgcctttcagataaaaaaatactgtatgtacatccttaattcatctggtacaactatgtttaaaagtgcttaataaagtattcagtactatttaggtaataaaattagtagtgacttacttaattttatgtagcatcactttcttaagcctgtttttaaagtgatttattaccagacgggcaaaaaggcaatttttatgcaaattgacacatttaataataacttgtgtagtataaaagtgcttgtttgtatgaagttataactcacttatggggccttgtagttctatgtaacattctagtgaaatgtgcacatgtggatgctcttggaagcacttccagccctgtgaatttatgtatctgttgacttcaatattaggtagcttgatttctaaagccatcacagtaattgacatgttattggaaataaagttaagtttttccttatttatagggataacctcaattttgaagaatgtgaatcaattcatacttggctgaaagccagttccctcttcagtttagctctagcacatacatgaaaagcgcactcgcgtcctaagtgccttgtgaatctgcagtgattaattcttctcattattttgctgcaaattctcatgaccctctgtgatgattcgatcagccacttagagtttatgcatattcatatctctgtgctcctgccgcagacgttcagatctccttcactgactggtgtgtgcttggtgcagtaattgagctgcagtagattgattactctggggagctgtaaggcctttaaaggtgaaaacatatcagtcctgttaattaggaaacaaaagctctgatggcaagttcagcagtcaaatgtttccagtgtagaaaagataaaaggtatgatttgttcctctccatgaatgctgtttactttttaaactttaaattaggtctgtatcagtggtaatggagtatagctttcttttatgaatttttatagaatgctaattgaagaggactttattgattggtactgttatctgtgatctgtcaaatctgatagtttagaacctattcagagtttgtatatgccttctatagcattcgtaatatttatatataatttctaaatattttacatagagaatgcttgtgtataaattttggtatttataggcttcatttggtctacagtatttcaacagtagttttttattttgacaatttaatggcaaagaagttgagccgtcttttctctctttatcgtaagcgtcctttgattttgctttcttaaactatatactaaataatacattatcatggcaaaaaaggccctgagtggaactgtattatccagaagtaagctagtttttacatggaggattatgcagtttacataattgaaatgtgtttttctctgtgtgctgttctcatattccaatattcttttttcctctcatggtcatgatgttttcttttgagatataattcacataccataaaattgatgcttttaaactatacaattcgttagctgggtgtggcagcacacacctgtagtcccagctactcaggaggctgaagtgagaggatcacttgaactgggaggcagaggttgcagtgaaccgagattgcgccgctgcactccatcctaggcgacagggtgagcccctgtctcaaaaatgaataaataaacaattcagtggtttttagtctattcacaaagttacacaaccatcaccactatctaattccagaacattttagttaccccaaaaagaaacctcatactcattagcattctctcccctttttctcttccatctagcttctggcaaccagtaatctactttctgtctccatggatttgcctattctagacatttcgtacaaatggagttgtagtattgtggcgttttgtgtctgccttctttcatttagcacagtgttttcaaggttcatccacattgtagcatgaatcagtacttcattcctttttatggccaaataatattctactaattgaatatctcaaattttgttttttattgactgaacatttctgtagtttgcacttgttggctgttgtgaataatgctgtttgtaatgctaattagcatgtgcgtacatcctttgttcttaatcttaggggaaaggctttcagccttcatcttcgaatatgatgttagatgtagtttttcttagatgccattctttagatcaggttgaggagttcccttctatttcgacttgagtgtttttatcatgaaatgttggattttgtcaaatgctttttctatgtctattgatgatcatgagggcttgtttattaatataatgtattacatcgattgttctttattaatatgttattaatatctttgttctttattaatatgtattacgtcgattgactttcatatgttgaatgttatgatattctatagagcatatataatgttattttactgctttggttttatataatatgaaccaatttctctatatttcaggcatttattaatacagcaaaagaaatttatgaaaaaattcaagaaggagtctttgacattaataatgaggtatatacatataaatattgttggtcaatattaatttagagttcacttttgattactattttatattttttattttataattcattattttataatttttttaattcctaaaatcaatcatgataatcagttaacaccattagtttacagtcatccaactgaaaaattggtatatgtggtatagtagttaaatatttatgttctagtagagcaacactttgtctatggaaatggattaaagtaagtggccctatccattcattgcaagcaatgcaaaataatataaatcccccaaagagaaaagaaaatccacttttatccacatgaccatatggtgtcatctgctttgggaataatgttctggtatataaatgcatgtactatgtactaatgcaagatgctctctctgttatctggcaggaaagagggaaataccaaatttggaaattactcccaatatagcatagcatgttttcaggagactaaattcatatatatatatatataattggcatttggcatagggttttttgtaatgttattttgatcctgttttggtcaacatgattaggataaaatgtaaagctttgaagcatctaattcagagtgttcaccaaagatcatcacttgacccacatccccactctgcatttatctgtatttatttcaaaatgtttatgtggatgtagcctacttattcttacataaatatttttgccattctgtattaagatttctggcttctgaaagaaaagccctggtttctccccagttgcagttagaaaagcattgtgttaggaagccattatgtatgtctctctcatcctatacataaatgaggctctctattacttcagtagtctctgctcagacaaacagcagtttacctaaggtttccaaaaagtacatgattttttcattgtttaatttggagtaatatagtttctaaatcctatcttctaggcttatatgacggtacttcttgagttagtttaaaggtgacaccattcagagactaatgccatataaattgaacagtaattgggcctctatctaaaagggcacattcattgtttctgtctggtttcatatagtagctgactgctttactgtgccttatgcagctttgattgtaatgtgctgttgggagccaacaggccgtgctatttatttggcctaatgccaagtctgactccttgactcctcaagaagttgctaccagcccagagggggcaaaatcaatgagccatagggcatgctttttattaaagaggagtcaaaagagcgaaaagaaaccacatcagctgctgtcaatactgagctagtgccagaaaccccaaggctactactgttgcagaacaactgccaagcactataaatctgagatttactgtgacgtaaagtttccttaagagcttaatttctgaagctactgtattacttttctcaaagtgttgtatttttaggtaaaatccacttgagggagtgagggttaagacataagtgtgagtttgatgaatgaaagaactactctgtgtgtgggttcttggcaagctgccatgtctttggggatcatagaaattattgatgacacagaacactcatatgcccttagcctgtacagctgattcaacatggaacagaaacactgtctagagaaaagattttacgttgtattaaagcagcatgggctttgggtatttttatgctttaaagattacttgcaataattattttaaatgatttctgcattatgagaatttcctgaaaagcagcattatccaataactgtttaccccgtacctggtatgataaagaattattttcagaaacatttccacagtgtttttaaaaggaaggaacatcccttaggagatattgttttaattgttgctaaaatctacttgctgtatttttctcagttgtttgataaaattgtatcataaagaattaaatgagttttttaagaattagttaaactatattgtctggtcatatttattgttctgttctcttttatttcaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctgtataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataa

SEQ ID NO: 16622 - DNA, 28325 bp, Human
gcttgttatccactctttttttttctttctcagcaacataggtttaggctgaacttatgttcatatagctgcacaaatctccacgggtatgaatataaatctatctattcaaatagactctaaaggtttcttaggttatttctcttctttctagaacttaagtaaggctttgatcaccactgataatacatccgttagttaatgcgtgtagagtttccagtctaaaggcaaataaaaagtgaaaaggggccggcgcagtggctcactcctataatcccagcactttgggaggctgaagcaggcagatcacctgaggtcaggagttcaagatcagcttggccaacatggcgaaaccccgtttctactaaaaatacaaaaattagccgggcgtggtggcaggtgcctctaatcccagctactcgggaggctgaggcaggagaatggcttgaacccaggaggtggaggttgcagtgagccgagatcgcaccattcactgcactccagcctgggtgacaagagcaaaacttcatctcaaaaaaaaaaaaaaaaaaagtgaaaaggcaggaacgctgttgttcacctgctgttttaggaattttgctcacgtacagttcaaaatattaagaagctgaaaataaagtacctggtcatgtgtggaaaaacttacagctaaaaggtgagatgaactgggtctagaaggtcggattcacgtgaaattaaaagggcaacgaaagccagaacttaatttcttaaaaaaagttaaaacaggccgggtgcagtggctcatgcctgtaatcccagcactttgggaggccgaggctggcggatcacaaggtcaggagttcgggaccagcctggctaacaatggtgaaactccgtctctactgaaaatacaaaaattagccgggcgtggtggcgcgtgcctgtagtcccagctactagggaggcggaggttgcagtgggccgagatcgcgacactgcactccagcctggccgacagagcaaggctccgtctcaaaaaaaaaaaaaaaaaacagttaaaaccctcaaaataatcccacttgttaaaatacaaaacctgaaaccatttcagtttcttctgcaaaatgagttggagagagtagggttgaaccaggcatgctctttcgggcctttcgacgctgacatcccgggatattacaccaggttcaagataccagcttgcggaaagagagctgctaaacttgaccatatgctttttgcacgacattcgacagctgtccctcccttcaccagctcttttaaggctgcaaatatatctgattcacgtgagagtccctacaagttagtacaacgtcaggccccaaggaggcgcccaataaatgttggcattgcagggccagatcccgagttccagttcagaaccctgctgaggtcaggcttcctccctgcctcccgcccctcaccacacccactcactcccccaagtaattaagtctaaactggggcctgtgcagtgattggccgcgccgggtctcactgcggatgaacttgacttgttccaatgatctgtgacagacatctgcagacagcgcccttaacagaattagggtcaggctggtatcaaaccccaggaacgccaggcattgcctcaaagtagatgcaaaccgttaaatcttccaggactcagaaggaccagagagagccggatacctctggttagctacgcggtccccagtaaagcttattcccctcttcctcccagtgtgtcttgttgccagagcaactgtgggcgtcaccgagctgacgggcggaaacagaacagaaagagtacacgtccccagctcattgatagggccattgcgcagacgcattaacttttctgagttgtagttgagtctgttgatgcagtccgcgtctgcgcattagttgttacgcgccctggccggcctcagcgcctgcgcaaattggcacaccggggagggcggagttaggtcacgagggtgcgcatgcgcaaacagcacatccggtgtggtcgacgggtcctccaagagtttggggcgcggactggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcgggtaatggttctataagtgatcataataataatgtgttactttggtgtgctgcttttgttttcatagtactctatatcagaccaccgccccttgaagttatgagaagagcctgcattgcccttttgttgtgaatggggaaattgaggctcagaaagcttagattatatgcctaataccaaacggctccgtaggagttggacttaaaagtctaaagaaaccaccttcgtgccgctactccacttggtgatccacttcacttaatattggtccggggaaaaccctattccaactttaacttaggtttaacacaactctaaaattagtagacttttcaaatgaaaaacccaaccttgaatcatctctgtcatcttggcctaatcattaccaatctccggtgaaacgtttcaatgaaagtgcaaagaatataaatactggtgcttttcttgttgaatcatcctttacttgattttgccttttagctgctactactttttttcttgttgaggaagctgttatttcactgtcctgaacccaatttttgttcacataactctattttagccttatttttccttttgattccaggatttggtaaccttgtagactgctatatttagcgagaacagtctccatcaatttttgttaaaatctgacttttcttgcccaacggggattcagtgaatactgaaaacaggcgtggcctctatcactggtatcacctgctactttgactttgaaaacatgccagcattcatggtttcttttcagtgtgatcatcagtcaggtcatcagttgtattttcagtccaatatgaggcattatggtaaaagctttggcacatgttctttatccgtaaagagtttatggtctagttggggtacagacaaaatacagcattggaattgtctggaggcctggcacagtggctcatgcctgtaatcccagtactttgggaggccgaggtaggcagatcacttgaggtcaggagttcaagaccagcctggccaacatggtgaaaccccatctctactgaaaatacataaattagccaggcatggtggcacacacctgtaatcccagctactcgggaggctgaggcagaatcgcttgaacccgggaggtggaggttgtagtgagccgagatcgtgccattgcacttcagcttgggtgagagtgaggctcagcctcaaaaaaaaaaaaaaaaagtctggtgacagtggtgctgtgcttaaagttacagacctatagaatgcttattgtacatttacattgttctgacacaccagagatatttcttagaatttaaaacaggtctgaggatctaatgacttgtgtactgaagttgcagattagccttttgattggatatttagttaccatctttgacttttgtcctagatgaccaagacctagttgtctgtggtggcgtccttgccttcaggatgtgttaaccatcatccgaccagatacactacccctttgctctaagtattctccaccacccacccaccgccctctgccacggtactatatgtttttattagccagcccggagaaggaaccttgatgagaacttttgatttaattttgtttgatgtttttgtttccaggtctggaagagtaggagcaaggcagggtctgaaagctgattttaaaaaagatgccttctccatgtagaagtcaccctgccttcataagcctctagggtctagaatgatttttcatggatgctttgaagaatgtggtttgctgaagagtgggcatggactagagttatagattatcagtgtaataaagccagaaggtttttttgagcaaatgactttcacttatgccaagacctgtttttgagcccgttgtggctgaaattgaattggcagactggactgcctttctcctctccagtgggaactaggtggcttgtcattgaagaaaaacctagtaaaagggcatattagtaatggggccaataagggggattaggatttccagatctgttagataacagataatagagctatagaaatgaaagcaacttcaagaaaagaagggattcatgataattcttagttgccacagaagggtatgatttacccttcttttgacagcattgactttcctaaatcctgcctcttctgccatttgttagcctagatcatcaactggagactggttttaatgggaaatttggacgcttatcctttgttttgattgttggcaaaggtagccttgttcctttttatggtgctggggtttctaactttcctgtggaatttcctgttgcaagagaatggaggagtccagtgagctgggagagggaaatgtaggcgatactgttgaaggattaggtagtgctgggtgctagatgtttgaatgccaggccaaggaatttggactttttttgagatggagttttgctcttttttctcaggctggagtgcaatggcgatctcggttcactgcaacctctgtctcccaggtttaagcaattctcctgcctcagcctccgaagtagctgggattacaggcatgtgccaccacgcccggcgaattttgtatttttagtggagacggagtttctccatgttggtcaggctggtctcaaactcctgacctcaggtgatccgcctgcctctgcctcccaaagtgctgggattacaggtgtgagtcactgtgcccggccaggaatttggactttatcctgtaggtaatagtaaagcttctgaagatgcttttttttttttttttgagacggagtctcgctctgtcccccaggctggagtgcgccatctcggctcactgcaagctccgcctcctgcgttcacgccattctcctgcctcagcctcctgagtagctgggactgcaggcgcctgccaccacgtccagctaagtttttgtatttttagtggagacagggtttcatcgtgttagccaggatggtcttgatctcctgacctcgtgattcgcccgcctcggcctcctaaagtgttgggattacaggcgtgagccaccacacccggcactgagggtgcttttttaaagaaaggaaaagatttaaaattggtgttagcatgtaggatgaattggagggaaatgttctttaatcttctctatttttttttggcagtctattctcttctattccctctgcatgtgttagtttagcatatgctctttggaaattgaccagtacattttaaaccaattcagaacgctaccaaacctttaaaaaacctgttgttattgggcctgatggtatgaaaatagtctgttttcttctattccctcatagctgagagacttaaccatggtttcaagaaggaaccagaggtagaaagttgtcattgagagatctttttttgtgtgtgttttggatcatcagagtataatatattggctttaaaaggacctcagaggtagaatatttttctatttgagacagatttcaaacatccagtagctgactgtttatcttgtagttagatatctctagaagaggacatctgtcccttttttagagttatattccagtgttggcaaccctttagtttccttttttgcccaactgaaagctgtgctcatttaaagtgctatttaggagggataagtagaaaacattaagactgtcctcaaaataagtctttggtcttgaaacaagttttaattcatttcccaactttcatctgttctgttctctaatctatatgaggtaattttgtcttaaaaaatagttttgtttttcctagtttacaaattcaaaaccagtttgaatctgtaaggcaaggaggcctagtccagagttttctgtctcacgggagctattaggctgttgtggactggggtccagcatttcttttggaattatccatcagatctgtggatcctaatattatctctcataactgttatccgagagattagaagtttgccacccatgtgcctgatagtcttgtttctaaatatctttcatatcattgctactttttcatcctctgttttagcctctcaatatctcttatgaagactactgtaatcctccttactggccttccggcctctggtttccagtccatcttctactgtgtttgcaggcttgatttgacttgcaaatctgattgtgtcactcccatgtacaatttgtgtttcccaaagtaaaattaaaactttttttttgacatacaggctctttcatgatctggcttcctcgctgtctgcagcttcatctcttgcctctgcctcctctatactctgctccaacagtattgagctacttgtcattctctgaacactctcatgtgtcaaactatttgcctttgcttgactgccttcaaaattccttcactttttagacttctcagctcaagtgcaatttccttttttttttgttactgtttttaaagagaacaaggtcttgctatgttgcccaggctggcctcaaactccttggctcaagcagtcctgcctcagcctcctgagtagctaggactataggcacacagcactatgcctggcttattgccctttggaacccttccctgactctccagcagattgaggtctttcctctgtattcctttttcaccttgtatgtgtgtgtgtgagagagatatggcattgtgctgtatttgggtgtctgccttctctctggaaggtgagcccttgagggcaggggctgtcttctcatctctccatcctcagtgctgaacactgtatatgttaaatggtgagcaggcctatagtcatgtcaggaatagtgagcaatgatgtgctaggttctctgccaaggtgctgggaattcaactgtgaagcacacagacgtggcttctactctcacagagtttgtaattagtgggaaatacagacaagtaaatatggatatggtgctgatggagaattattggtgagaatgggaacacaatgtgcatccaaccctgcctagtggtcctgcaataatatttctcttatacattcgccttcctaaagtaggcttcataaatcactctatttttcctcttttcctttattcttagttggtgatcttgcttttattttttcactaaaaaaaagaagtagataagaattccttcatcttttcaccactgaatcataacagatcacctacttttatacccatactctctgacttctcatggtggatgatgtgtctctttcctgtgaaagctctgcttgtgcagaggatccagtcttcccttgctcactcagggactccgcttctgcaattattcctctgttccgtgtcattaatttctgtttctctcctggatcattcccatcatacaaacatgttctaatattgtctatttaaaaaaaatccgtttgaccacagataatcttctagctaccatcccatttcctttccatcattacagaatttcttgaaagaataattaatgttcctacttcctcccttaactattcattccttaacccactcttggtattggtctgtcctcgctacttcactgaattacttcactgaaactactcttgccatgttgcaacgtttagcatttaatgtaggtattggcttctgtgtaaaaggaaagttttttcttgaatacaacactctcctgcttgttctgtctcacctcactgctttttcctttctgctgttttgtgctgggcgcttctctgactgagagcatggttgtagataccttcactttgtatttttttttaaatagataaacttaaataacacctgtatacctacaactactcctttatatttttagttttgaactgtcccccgaattccaaattagtaaatccagttgccaacttgatgtcttcacttgatgtctgatatgtaccttgaacttaacatgtccaagatcaaacctgctcatccagccatctgcctcttcaccagttagtacgtggtgtcaatgttggttgtggttttttttttttttttttttgagacatagtctcactctgtcacccaggctggagtgcagtggcacaatctcggctcactgcaacctccatctcccgggtttaagcaattctcctgcctcagcctcctgagtagctgggattacaggcacgctcccccatgcccggctaatttttgtatttttagtagagacgaggtttcgccatgttggccaggctggtcacgaactcctgacctcaggtgattcacccacctcggcctcccaaagtgctgggattacaggcgtgagccgccatgcccggccggttgtgtttttaaatgaagaaatttaagtttccggggtcccttgatttctcttatctcctgcatctgtttcatcagcaagctctgtcttctccaaaatatagcctgtatgtctttatttctgtccatttttactaccattcccctgagctctttgggtcctaagtaattcttctgcttctttttattttttatatttttgagacggagtctcgctctgttgcccaggctggagtgcagtggcgcgatttcggctcactgcaagctccgcctcccgggttcacgccattctcctgcctcagcctcccgagtagctgggactacaggcacccgccacaatgaccggctaattttttttttttttttgtattttttagtggagatgggtctcaccatgttagccaggatggtctcgatctcctgaccttgtgatccgcccgccttggcttcccaaagtgctgggattacaggtgtgagccactgcgcctggcctatttttatttttatttttatttttttgagacgcagtctcactgtgtcgccaggctggagtgcagtggcgcgatctcagctcactgcaacctccgcccttggagttcaagcgattcttctgcctcagcctccctagtagctgggattccaggagcctgccactgcacccggctaattttttgtattttatttttagtagagatggggtttcaccttcttgaccaggctggtcttgaattcctgaccttgtgatccacccacctcggcctcccaaagtgctgggattacaggcgtgagccactgcgcccggccttctgcctctttttaaccttgcgaaccattatactgttccaccgctcttataactgaatccatactgttttctgaggcttaccatgcccctcaggatttggcccttgtgtccttccccttgatcactatagtcttgttggtctgtccttgatttttttttttttttttttttttttttgagatggagttttgctcttgttgcccaggctggagtgcaatggcacgatctcggcttactgcaacttccgcctcccgggttcaagcggttcttctgcctcagcctcctgagtagctgggattgcaggcatgcaccaccaagcctggctaattttttgtatttttagtagagacggggtttctccatgttggtcaggctggtctcgaactcccgacctcaggttatccacccgcctcgacctcccaaagtgctgggattacgggtgtgagccaccatgcctggcgtctgtccttgtgtttataacatgtcaagattgttcttactgtctagaatgctctgcccccagatttttacatggttggttccttatctttcaaatattggtcttaaatagcaagctcttaaagagaccttctgttatgattgaatttaagaaaagcttcccagtcactctttattatcctgttttattttcttcatagtacatatctctacctagtagttcctggtttatttgttaacttattgattatatgtttctctccataggagtgtaagttccttgagagccagactgttttgttctgtgccatattcctagcacctgaaatgatgcttgtcatgtagtagatgtttagtaaatattttatggaataaatggacatttaaggggatagagtaaatcagaattgctaaaatggaacagactgcttgaagaggtagtaaatttccatctttggaagtgcccagggagagactgaaggatcattggtagtggagcattttgaacaggcttttttttttgccttttttgtttccaatgcatctgagagatgtgatatccttatcagtaacacaggctctggaaagttgataattctccatctggaggtggcttaccagattctgtaagtggtgagtatactttggaaagcttcccacgtgattagtacgcctccccaagcatggccaccccctaccacctcttgggcattgtatacatcaaatggggtgttggtgtttatgacctctgaggtcctttccaactttgtgggactctgattcatatgttttcattgaaataatctggttaccatgatcacaataataataacatcaatttattaccttatccaccttcatggataatttttctttttttccctcatatttcctcaaaactcaacaccgtgttctttactccaatgaccactattaatagttttctatttcttcagatttttttctagattctaactgaaatgacaagataattatgtatatcattatatgtaaataaaatattttactttttttttgagacggtcttgatttgtctcccaggccagagtgcggtggcatgactgtggctcactgcagcctgcaacctctacctcctgggctcaagcaatcttcccatctcagcctcccgagtagctggggccataggtgtgtgctaccacacctggctaattaaaacattttttttgtagagacagggtctccctatctttcccaggctggtctcaagctcttgggctcaagcgatcctcccaccttggtttcacaacatgctggggttacagttgtgagccaccatgccctggccaagtgaaattaggaatgggctgggtgtgggggctcatgtctgtaatccctacccttaggcaagcagaggcgggaggattgctgggcaacatagggagaccttgtctttaccaaaaacaaacaaaaaaattagctaggcatggtggtgcatgactgttgtctcagctactcagggggctgaggtgggaggattgtttgagcccaggaggtcgaggctgcagggagccatgattgcaccactgcactccagcctgggcgatggagtgagaccctgtctcaaaaaaaaaaaaaaaaaaaggattggctttttttcacttaataagtcttagatatgtttgctgtcaatgtacagagaatttaccttattcttttgaataattgcatgggatttcattgcatgtcagttgtatagtttaatccccttgatgtttagactgttttaatttttttttcaactttacaaacatactttcagaatgtctttgttctgtaagataaattcctttgtcaaaaggtaaaatcattttaaatattaatggatattgctagttgctctcccaagtggatgaatgaatctgtactttctacagcaggggtttacactggttacccttgcttcagtcattgtctttaatatttttaagggtctggatacctgaaaggatcaatggtgcttccatggtgtttacatgtttaagcataatgaaaactgttgccatggtgacaggctctggagaactagtctgatagttttctggcctttggattagatttgtttgttgctttttcttagttaatgatgggatgatgctagcctgaagcgagtttaggttttcttaagcaatgtaataatttatcacaggcataaagatacttcggaagagtgtattcctggaactgcctgtttttttttttttgtcaatggtgactgttagaatcttcaaggggatggagtgtggcagtggagagttctcatgaattatctctcttaggtcttctgccttttttgagacaaataagcagctgctagaacttcgagatcaaagatagtttatcgagaactgtgaggttctcaagaatgagcgtgctatctttataaactctgctacccattaaatgaatattctattagaaaataattcacatttttataactttttatcattcagcccggaccctttgttgttgcctcaagtgcatccccatctaggtataattagaaacctttaaatcagcagataagagagctttgtgggttttttggttatatatttttttctctgagaaagcctctaggtttcagtgtaactctgagaagtaatattttttttcctttaacagagtgcgaaatttaattgtacaacttgataaatttttaaatgtacctgtctaaccactatccagatcaagatgcaggacattaccagcaccatagatgcctccttgcatcttcccagttatcctctccctgtgaaagataaaaaccactatcttgccatagattggttttaccaagttttaagctttttgtacatggaatcatatagcatatacttttttgttttgttttgttttgagacggagtctctcttgcccaggctggagtgcagtggcgcaatctcggctcactgcaacctccacctcctgagtttaagcaaattctcctgcctcagcctcctgagtagctgggattacaggtgcgtgccaccatgcccagctaatttctgtagtttttattagagatggggtttccccatgttggccaggctggtcttgaactcctgaccttaggtgatccacccaccttggcctcccaaagtgcggggattacaggagtgagccaccgtgcctggcccttgttttattttttaatttttttttttttagatggagtttcgctcttgttgcccatgctagagtgcaatggcacgatcttggctcacctccacctccacctccaccaattctcctgcctcattgcctcagcctgccaagcaactgggatcacaggcatgcgccaccatgcccggctaattttgtatttttagtagacaaggggtttctccatgttggtcaggctggtcttgaactcccgacctcaggtgatccgcctgcctcggcctcccaaagtgctgggattacaggcgtgagccaccgtgcccggccttttttttgtttgtttttggtcaagataaaacatgacaaaatttaccattttaaccatttttaagtgtatagttctgtggcattaagtacatgtacattgttgtaaaatcatcatcactatccatatccagaacttttttgtcttccgcaactgaaattcagttcccattaaacagtaactcctcatcctcctctctgtcagtccctggcatctaccattccactttctgtttctaggagtttgactactcttgatgtcatataagtgaaaccacatggtatttgtccctttgtcatggcttatgtcacttaaaataatgtcctcaagattcagccatgttgtagcaggtatcagaatttccttccttttaaggctgagtattccattgtatgtatacatcacactttgcttatccgttcttctgctgacacttgggctgctctcaccttttggctattgtgactaatgctgctatgaacatgggtatgcaaatattgcttgagagcctggttccatcccccaccctcccaacctcccagatggagtttctctcttgtcacctaggctggagtgggacggagtgatgtcggctcactgcagcctccacctcctgggttcaagcgattcttctgcctcagcttccctagtagctgggattacaggcgcctaccaccacgcccagctaatttttgtatttttagtagagacggggtttcaccatgttggccaggctggtctcgaactcctgacctcgggtgatccgcctggttcagcctcccaaagtgctgggattgcaggtgtgaaccactgtgcctggccgagatcctgctttcacttcttttggatatgtacccagaagtggaattgctggattatatgatatggcaattctgtttttaatttttttgaggaaacgcagtactgtttttcacactggctaccctatttgattttcccacttgttagtgcacaagggtttcagtttctctgcattcttgccaactcttgtttttttgatactagacatcctaatagatgtgaggtgatatctcgttgtaattttgatttgtattgccctagtgattaatgatgttgagcatcttttcatatgcttgttggccattcctatatcttctttggggaaatgtctattcaagtcctttgcccattttaaaatctggttattattttgttgttaattgcattgtaggggtactttaatatattctgatattaaccctttatcagataagtgatttgcaaatatttttccccattccgtaggtgccttttcactgttgtgccctttattgtacctttatcacagaagttttaaactttgatatagtccaatttatctatttttactttgttgactgtacttttggtgtcatatccaataaatcattgctaaatccaatgccataaaacttttgctctgttttcttctaagagttttttagtttttggtctttatccatttcggatttaggtctttgatccgtttcgagttaatttttgtagtatatggtataaggtaagggtccagcttcattcttttgcctatggatatccagttttcccagcatcgttggttgagaagactgtttccccattgagtggttttgtcagtttggttgaaaatcatttgattttgtatacgagggtttttgtgtgtttcttaaaaaacaaagcaattaaattgattcattttttaactgtagtaaatgtatttttaaaataaacttataatggaaaacctgaatcattatccctaaatagaaggtcacactaaaaataccatggagctaggcagatgtgttcacccgtgcctgtggtcccagctgctcaggaggctgaggtgggaggatcgcttgggttccagtccggcctgggcagcaccaccagaccctgtctcctgccgagttctcagtggctctgtgtggctgcatcccagaatattcctcatctaattgagggggtacatttgttcccccagcatatacacttaggctctgccctgtggtctctgtgtgggagctgggcttttttgtctttggcttcctctgggtacctgccaggttccagctggtttggccagccagtgtgtattttttaagttttgtccgggcacggtggctcatgcctgtaatcccagcactttgggaagccgaggcaggtggatcacaaggtcaggagttcgagaccagcctggtcagcatggtgaaaccccgtctctactaaaaatacaaaaaattagccgggcatggtggcgcatgcctgtagtcccggctacttgggaggctgaggcaggagaattgcttgaacccagcaggtggagattgcagtgagccgagatcatgccactgcattccagcctgggtgacggagcgagactctgtccccgactccccaaaaaataaagtttttgattgtgttgcccaacttacttgtgcaattcatccatttttgtgtatagcagaagttctttttcattgcagtataatattctattgtttgtatatgctataatttatccattttactgttgatagacattagattgtttccagtttggggctatctgggtatcatttctgtgtatgccctttgatgtatatatgcattcatttctgttagagtagaattgttgggtcctcgggtatgtctgtgttcattagcatatttattttatacttctatataatcatttttttgtgttttgcttcttgtgcagtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgtaagtgatgatcatagtccttgtcctataatgttgattttaggaagagaaattggatgggactggttttgatcatggttggccaggctcccatactgctattgacatttgcagaattttccattggtctgcaaagtatgcattaatatcatcataattcatcagtgctactgctcttggtcattgccttgtctttctgttcttcaaatcattaaggtaatagaaaattaatgtttgtagctagtacaataatttctgtaccaataactccacgaaaataactcggagattttggaagagacataaatggtaggttttgcctttagatttgttagttaatttttttctgattttgatctcagatgacttttaatgctggaccattgttttcatagcacttaaatttgatagcatccagtgtatgttgaatgaatgactgtgggcatttgctaatatgtgccttaaagtagaaataaatggggaaattgggttaacttgggagaagactttaaaatataagatgggatgctgcttggttcatttgccattttcacttttttagcagtagagttctttctcccttctcccaaacaaactcttacaaaaagaatcttggtatataaagcagaagtagaattggagttttttttgatggacagaaattgaaaagccctctctgcttggccttcatcacatatggtacgccctcccctaaatcgctccctcccaagcagagttctaaagctttaataaatatatggctgttttccataccgtatgtcaacactgttactttatatatgagacaacagaggcctagaacaatccattggccttccctggccacatagttaagtgtttgcagtgaagtgccctagtctagcggtgttcttggccccgtactccttccggtatcccatgtagcttactgatgaatgcatgcaatctttgcctttgcattgcaaaatgtaatgttctgggtggtagagaaaagagaaccttaggagatctcatcctatttgggggaaggatatcctaggaccaacctcttcctgtcaccacttggaaagctgtcatttttatactaaccagcagaaatctagtataagagttagagcatctatgtgcaaagtggatgcaataatgtggaagtgactatacttccttttctgacatgaattagtcatttacttataatatgttacctaaatcctttcctttgatactgcctcaaaaacagttctgttagttcaggtaaggtatcattttggtagtggtaagttgacagtgaggtttatttcagtgaaaaactttttttttttcttttctgtttttttttttttttttttgagatggagtctcgctctgttacccaggctggagtgcagtggtgcgatctcggctcactgcagactccgcctcccgagttcatgccattctcctgcctcagcctcccgagtagctgggactacaggcgcccgccaccacgcccggctaattttttgtatttttagtagagacggagtttcaccgtgttaggatgatctcgatctcctgacctggtgatccgcccgccttggcctcccaacagtgaaaaacttttaagaaccactttgttctgttattttaatacaatttaactcattagacacctgattaagacttgagttatcctcttcctcccttcctccctccccttctatgtgccagccaatgtcttgttgttgggaatataaacaatattgttggctgggcgtggtggttcatgcctataatcccagcactttcggaaggcgaggtgggcgattgcttgagctcaagaatttgagaccagcatgggcaacatagcaagaccctatctcaattaaaaaaaaaaacccaaaagtgtggcttctgccttcaagacatgtacagtctagtaggggagaatacgtaaacataacagttaaaatacagcccatttagggcctcgctataggtttgaacaaagtgctgcaaaaatccagagaagagagcagctgtaccatctgggagcagggacagcagatgagttatctgagcaatggataacagctattgctagttaaaatgaactgttaccagtggataaccttgaatgcaggtagaaaactgacccaccaacattgaccttctcacgcttgcaaatatgagtaacccttgggcttcctgatagagccttctggaaaggtcatgtcttctgattgcttactctagatttctgaagttctttttttctagatgagtcatggtgtgtacttaggaaggggacacagcaaacatttcaaggatgttttctaggctcagggagataccaaatcatggaaaattatttcttagggctgtcatgattggaggaggactctactgcagagagcttagtatttcaaaattatgacaaaagcaaagacaaaaaagcagtctcagcagaaactgtgtactgcagaccatattaacaacctaggaccacctgctcagctgggaattatgggcccaaagcatagcaaaatcctcaatcccagattgcagtgttaaatctttctatggagagtatgttcatagaaaaatctttctctctgggggattgcccagattgtttttcatagagatccttcatttgaattatactatactgtcctgctctcagtttttaaaaatatacatttatttgctccttttatgtgcttctaactcagctatatgtgcactgtgccacagcactttaaaaatagttccaagtaaattctcaatatttataccagctcagaaggtagaacaaaacagattgaatgtctttatattttccaactaagttgagagtttgatattaaaaaaaaaattctgtaatatagctgatcttacatgaatttgggggtgacaaactctaacctactctgaaagaggcaggtcaaaagaaaatggcattgggttaaaaaaataaacaattcaaggggaagtaaggaagttaacagataatgagtgctcagtgtgtgctatgctttaagtacttcttgttctatatcattttattttcagaataatttcacgaggataggcttgctgttctcatttacagatgaggaactgaagttgagagagcctggctaggatggctgagcacggtggctgatgcctgtaatcccagcattttgggaggccgaggtgggtggatcacctgaggtcaggagttcgagaccagcctggccaacatggtgaaacctcgtctctactaaaaagacaaaaattagctgggcgtggtggccggtgcctgtaatcccagctactcgggaggctaaggcaggagaatcgtttgaacccatgaggcggaggttgcagtgagcccgaattgcaccattgcactccagcctggcaagagtaagactctgttttctaaaaaaaaaaaaaaaaaaaaaaaagagccccttgctagaaatcttacaactaatgtatctatccaggtgatcaagaaagactcaatattttttattttttagactatacaaatgaaaatacaaaagcaaaaattctcccagtgagcttctgacccccagaaatccatgcacacctgaaatgatcagtttttggtgtgtaggtggcggcatatttttgaatgaatccatgacagaaagaagctcagtggatttcagtatttaaaaatgtatatactttagttttttccatgtttgttcttctgtgtttctttgtgaaattctttttttttttttttttgagacagagtcttactgtcttacccaggctagagtgcagtggtgcagtcttggctcactgcaaccctgcctcccgggttcaagcaattcctgccgcagcctccccgagtagctgggactacaggcacttgcccggctagtttttgtatttttagtagagatggggtttcactctgttggctaggctggtgttgaactcctgtcctcgtgatccactcgccttggcctcccaaagtgctgggattacaggcgtgagccactgcacctggcctgtgaaactcttttttttaaaaaaaaaaaaaaatctcagtccatctcaggtgttctgaagggtaatgaggaaaagaaggacagaactgtattggatcacagtttgagaattaaagttcctgatgaattgggccctgggtcagaaggaagggtgaactgggcccaaagggacaaaaccttgcttgaaaatgtgctcagctcccagggagatagttgccaaatgcctgtgccttgttagcattgttttgtttttataatggagaccattctctcacaagtcttaaaaaattcagtgtttgatcctagctggaacaagggggctacagggttgggcagaacattttaaactctgactggcagcactgtttacaaacatgaaattatgttggcttttcgaattcagttaaagtatagtaatctagaaaattacctcgggaaggggaacttgatgttattctgtgggctttgctgccacctagtggatggtatgtttcatgtgttgagcggctactacaaaacatgaggagttgagtttgggggaagaagctactgatacctgtgttaaaaaacctagtttctttccagtcattggggggcagcagaggtccaggtgggtttagatgctgggttgggggttgctttacattctggccagaagtgggcaatgtcgagttaggaacaaaagggcatagaaccctaaagtggccctagattttgttgtgtgggggaagaccaagactgtgcacatagacccgcaggtttcccgtttgatttctttttttcacctccttagtttgagagcttctttttttggtttgttctacgtcttttattctcaatggtgacctcccacgcaataatctttaattttttgttggtggaggggcccatttagtttttatttcattttctctttgatatttccaccttatattgaattaggtcctgccgccaaataagctctctcagagggaactgtcctacatttgtaggaaatctgaggtagtcacatcataacttttttcaactcatttttctctgtttagaaggtgagattaattatatatttttttatgtgctggggtctcgctatgttgcccaagctaggaactccctggggtcaagtgatcctcctgcctgaggcttctgtgtagctggacctacaggtgtgtcacagtgcctggctctgagattagttctttacctttcattcttaaaactttgaatctacttattttatttgctaaaaagtgctaattgatgactttacttgtttattgaactctattttatatttggtgtatttaaggctaccaaagaaaaaagaatatcgaaatagatttatatttatgaatttcattgctgccctaacttactgccttattttctccatcctcccagcttggatgactcctattccaagtcattcccacccctcaggttgcataggagcccttagtctactgcattcctccagtgctgcacttatcacattgttatgaaactattcattcactttcttctctctcccactggactcaattgtgaacagtaacagtgtgtgtttgttgaatgagtgtatgaatgaataaaccttttttttttttttgagacggagtctcgctttgttgtccaggctgtagtgcagtggcatgatcttggctcactataacctccgcctcctgggtttaagcagttctcctgcctcagcctcttgagtagctgggactacaagtgtgtgctcccacgcctggctaatttttgtatttttaggagagacatggtttcaccatgttggccagtatggtctctatcttttgactttgtgatctgcctaccttagcctcccaaagtgctggaattacaggcatgagccactgtgcccggccaaataaacactttttaactgcaagaaaaagttatgttattaagttacttggatgctaaaacatggaaagtggtacgaaagaaaaaaagccaaggcaaagattcataggagaggctgtggggtggggaagagcatgagacaagaagtcagaggaggggctggtgcggtggcttaggcctgtaatcccagcacttggggaggccaaggtgggaggatcgcttgagcccaggagtttgagaccagcatgggtgatatagcaagaccttgtctctaccaaaaatcaaaagaattagaggggcgtggtggcgtgtgcctgtggtcccagctactcagaaggctgaggtggaaggattgcttgagcgtgggaggtcacggctgcagtgaactgtgatcatgccacttgcactccagcctgagtgacagagtgagaacctgtctcaaaaaaaaaaaaaaaaaaatcagaagacttgtattgtaggctttgctctgttaactagttgaatggacaaataaacttacctctgagcctcagtttctctgtctgtgttgtgagaggattggtctggatgttcatcaaagtctcttgccactgttaatgcctctcagcatgattcttgatggttcttttgtgtttgaggaggattgtactgtttttgtggatcctcatttgggctttgctttctgttttctccttaatcgttgctttttattcatattttcagattcccattatccatttataggaggcagaaagttaaatgattataacaagatgcacatatttgtatgaagccttttacaaaaagtaaacatttgtaaaatgtcttctagttcccacgttaacaggcttgtaggattcacatacattccacatatacttttacatacatcagctcatgtgatccttccttcctacccagtgatgtggagacagacaaatagtagtattcctattttacacttgaggtaattacaccttggtgaaactttagttgatgtatccaggccctggaactaataagtgactgagggggaactggataacagacatttggactctaaacctttatattccttcctgttatgtttaggactctcagatgatggctttatatatatgtcatgttagagggttttcattaaaaatattaaacttttctttttaagaaatttttatttattttaaattttcatcagagccatcagactggattcttttcttttttaaatgggaaaaatttggcagagattgataggaaaggatgaaggccggctatctcaaatgtttctgcatagttggccatacttaatatggtccaggagaaatggaggagaatgcaggtcaggagacctgactttggctagggagggtgatcctggaccagcactgtccaacagagctttttgcagtggggaaacattcagggtctgcaccgcccattatggtaaccactagccacatgtggttattgaacatttgaaatgtggctaacagactgaagaactgaatttttaatttaactttgactaagtttaaatagtcacctgtgtctagtggctgtggtgttggacagcacagctctggacagatttgtcaacactatcaggttacagttttctcatctctgtaatgaaaggattaaagaagctgatctctaaagctcctttcattttttagaaatacacagtctgtgccttctaaaactggtgattcaaattgagctgtaaacctagaatttctgcagaatggtctttgattcacattatttctaatttcagttttaattgggtgactagaatccaggatgagatgaatttgaaggaaaatcagtatttgaacatatctgcccagtgctagtgtctgaatagagatattgctggagaagaatacagattccaaatagaaatgaccctggctggcattatcttttctatctctacagcgtcatttttaacagttctttgtgttatgccttgctttctttttagatgattagaacaaactgattaaatggcactgtcttctgcccaggtgaaatagactgaagtcacgctaacttttctcagtaggtgtcttcattttgcatgtcttgatatcaggggaggagattttattagtcagtttcctgaaacctttatgccctggttaatagttgaaaccattcttcttagctgttgagtagtcaattgtgtgagctaatatttcaaagaatcctagaacctctgcttttagaatagtgtctggtaaatagatctgctttaaaagaggggaagcagatctttgtaaacagaattttctgaaaaccactatcaaagagacttactctcatgagtcaatttttgcctttcacgtggactggcctcagcatcttagatttaaatgttttaatataataaaatctttaaactttgattttgtactaaactaggatttcttttatatttctaaaagtgtcaaggctttgttcactgaaaatggcattatgatctagtcctctctcaccttggccattagaaatgtaatgtagccaggcatggtggcctgtgatcccagcactttgggaggctggggcgggtggatcacctgaggtcaggagttcgagaccagcctgaccaacatggtgaaaccccatctctactaaaaatgcaaaaattagctgggtgtggtggcacacgcctgtaatcccagctactcagcaggttgaagcagagaatcgcctgaacccgggaggcggaggttgcggtgacccgagatcacgccattgcactccagcctggacaacaagcacaaaactctgtcttgaaaaaaaaaaaagctgtaatgttatattggctgatagtctattgccagagagtttgctttaagaaatttgatggaatgaataggtgagtttgaataggtctgtttggttttgtttggcactgtgaacaccttttgcttcctgttattgctctttcttttatacatttcttataataccactgattcaggaatgttctgcaattatgtagcatttctgtaaataccagtgttagtgaaataaaagcattctggctgaaagtccaaaatctctcctttaagttctgatgccagaatctccaggttacttacttgacccaatataccaaataaggtagtgccctttttcctcctggggcagcccggttcttctgaaaggtagtatttcccagcctcttttgagtcatggtacacgtaggagattgcagtatttttatggcacactgggaaaatcagttgcttatagctggagacattggagcccctaaggctggaggtcactttccaaccagagctgtgctggagtccagtaggtgggaggctgtgctttgagggactaaaggaagcctgtatcttgtggtgagggttccacctcacaagttacagatctcagttccatttggctctagcagcaatgtggccacttctgttgcggttactctttcttcacctttttcttgccaaaaataaacttatctttaaatgaaaactaaattatttcttatattttggtcctttgttatagctgagattgggaatttttctttctttcttgaatccttacttccctaccctgcctccccaccaatggaaatctgtgcttcataagcattttagattccagaaagctctttaggttaaactacaaccctctcacctcaaagaatttgtgggccagggaagtcagtgacttatgtgaagtcttgcggctaattaatggtagagctggagttaggacacatgtctcacagttcctagttcgttttgctttgatgtgcttgaaattcagttttgacattaatttttctggatactactcccataaaatgttctttgaaaaatacttgcttctttctagtttttctcgcctggtttaaatattgtcctgagtgtgggaaccccataactgtcttgtgggttagaatttagatggaaggatttggggccctgtctctagtatcataagacatttaaccttgctgcttttttcttctaggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctccatatgcctctggctctgtttttattctttgctggtatcagaatcctttttttctcttcagtcctctgtgctgaactctttatgagttggtaacttacagctgtgaacctgcctccttgttttcattaagtatatttgaagttaatggcaaaaggcagtgctgacaaccctgggaaatggcagtcctttgtcttcttcctggagcaggtaatcctttactaatccttcgattgttacaggtgcttccactcttatgacagtgcattcctggaactgcatcattatgcactctgctagaaattgaactaagtatgtgctaccacatttacatctgtttcaacatgttttagtggtaaaagtgaaatatatttctcttaggcagtgtagacagagtgaaaaatgggggttatgtatgtgttgacttataagatacaatattttccaaagcaccttcacaaatattctctcattttattcttgcaattatcttaggggttcctgtcctcattagttaggtgaagaaattgaaactcagatttgtgacttgcttaagatcagagttcatgacaaagcttgggtggaatgtaggtctgctggctgaagtctgtcatgttcgcagccctgttttcatcttgggtgctgttgggttgctatatatggggcggaagctatgttgagaatgccactacttaaatttagccaactaccgagaatgatgagtttcaagcttctccaacttggctgcacgttagcatgacttgggtaatgtaaaaagaaaatcccaacgtccaggccacaacccacaccaattaagtaaaaatcgcttggggtggcttctgtagtttgtaaagctacccaggtgattccagagcacagcaaattggagaaacactgctctggattcttgctactcaaaatgtagtcattgactaccagtattggcatcgcctgggagcacaggcctcaccccaaacctacagaagcaacatcttcattttaacaaggtcctcaggtgatttatgtgcacaataagatttgagaatctctcatctacagcagtggttctcaaagtttggcatgtctcaagattacctaggaacttggtgaaaagcttgggcctgtatgtttcttattagctctctgcctaactgataacacactgagtcaggagtccgcaagcttttccttaaacaaatgggcatggctatattccactatcactttatttataaaaattggttgtggctatgtgggtcatggtttgccattcttaagtgatactagttcattgagattatgactgagcagtttaatctgcacttttttttttcttttttgtttttgtgagatggagttttgctctcgttacccaggctggagtgcaatggtgtgatctcggctcactgcaacctccgcctcctgggttcaagcaattctcccaccccagcctcccgagtagctgggattataggtgcacaccaacatgcccggctaatttttgtatttttagtagagacagggtttctccatgttggtcaggctggtctcaaactcctgacctcaggtgatctgcccgcctcagcctcccaaagtgctgggattataggcgtgagccactgtgcctggcctaatctgttttaaaacttatatacagatgtcacagaccctatcaggaggcttccggataatttttagtctagagaaattggaattttgaataagaaaagcatctggactttgagacacgggttgaaaactgggaataatagtaattttatgaaggaagacattgtaattgcagtctttaatacataggttttgtttaatttttcataatgatcttgagatacatgggacaggtattaaattcccatttaccaggtcagctattgtctcagaggttgtgatttacccaagccagttaccatcaacaggaaacattcttctttggtgtgtcttttcaatatttgcttcggggctaaaacctacagactgcttttgg

SEQ ID NO: 16623 - DNA, 98037 bp, Human
caggcgctcagctgaatttctgataaattgaaggtctctaaaacttggctggaagtgtcttgggcatccaagagacacccgatatattcaaactttcagtaagtatttaccaaaataatatcatgtgcatggtgaaaatgacgggaagacgaatctgatacaaaccattctatttaggtgcagacatggtagtgaagctaaaaacataagcgctattatatatataacatactgattgtcataaaagatgtacaaaaaatgctaaactcagaggaaattacttcctgctgggaagaatctggaaacacatctccacgggtaacagaatcagatacagaatcacaaaaggtgactgctacaacagatttcagtaattaacagcaaagaaacaagagtagttcattttggctggcgtgtaagtactaaggaagcagaaattaagtcgagaaggtaggtttgcatctgtattgttgactggctggatattaaccattttcaattttacctgaaagttctggtctttttgctgcagctttaagcatccaacccggtattaccaagatgacttagagttcttgactcaagcatacagaagaaactacaagataatgtatgataactttgtaaagggccatataaaagcaatacagtattttcaaaaatcttcaacacgttgtttaagaaactgtagacctgcaggaatcccaccaccagaaccgcagtcaaagcttacaaagactcaaaggagagacgcggaaaggggggaaaaatcagaatgggaaggcaggtggcaggggaaaaagattgaggtcctgccctggtggtaggggctcatcttttccttttataggtgaaggtggaaaatgattttctgaagttcccgaattctcctccctccaaaggccaaggagtgaaagtacttaataggaacttgcggaggcgtggttcaagagctccgttttgccggagttaggagctccgccccgaggtccccgcccattccccgctggggtcctcccggccgggctgcctctggctgggttagggcggcctgtagagcggcctcaccccacagggagcctcacgggggcgggccgccgccaggccagcccggaaaaaaaccgccttccaacggaagcggccctgagccccgctcgccatttcagcgctctgtcccacagggaccgtccggcccgggtccggcccactggttggggtccacggactcacctcactttgcaactaaggtcaaaaataagcattccctggggcacgggcggccaggctattaacacccttccgccatgacccaattcggaagtgccaaatgcaacttccgggcaggagagggaatttcggagccctaaactgttgtccatctccgtaagtgaccagacgtctcagtaaaataagggccaggaaactggacgtgtaatccggagtatgaattaacttgtctaacatgggatgtgtggtcacccacggtacctctttgggcttacttacagatgcatcccttcccagacggctcagctgttgccccgggtaacggtgagactggcgaaggaaaaaaatctacgtcaccctggaaacaggaagccaggaatctccttttgccattatcagttatggccgccttagcttcaacagtaacttccgatcggggagttgtcactctaccctgctggaggcttactctgtagcccggctagccagaggcgcccagtgggcgggagacggcgtagaggaactgaggaaaggacaagggcggagagagagaagctggcggcactgcccgtctctgattgggcagcttctcttgccccggttccgcccatttttcttgcctagcgagtgacgggcccacggcagaggggtggggcggggaggctggagcgagagtagtggcggggcgggcggggcggggcgagtgggggaggggcgggcggggggcggcggttgggcagcgtcgcttcttaggaggaggaggaagaggaggaaggagggcgagcgaggaggatggcggagtcggggctcctgacggtaactcggggccgatgaggcggagggtgtctgttggtcggttcttcctgcctgccttcctgtccgtcgggcagtcgggctggctgtcggtagggggaggccccgtgcgccctgacaggcgcgagccggcagcgccggggcgaggcccgaggggccggggccctgggaggcgccgccgccgccgctttcctggttgctgtctccgggagtgcggggcccttggagccggctcgcgtgggagcctgcagcccggcgcggagaggaaggcggtcgggtgtgacagcggccggggccgggcctgcggcggcggcggcgggcggcccggacagcgcctgggcgacggcgagccggcgcgagggcgcgggccgggggcccccggcggacagtctctctcctctcggctccctgggcccccgggcccagtccgcagggcgccccgagtcgtgtaaatcgttggcgagggcccgggcgcagcggcggtcatacagggtggggtctcttctcgccccctccctggagtccaccttgctctcccgttctcctctccctaaaaacccttgagtgaagagtgctggatcggctctgggtgtgttgcctagcgaagcgagttgtagcccttcgagaccgcctcgtagaacatgcccgatggcaacctctccccgtgatagcacagcttttagggagagaggaaaagtagtctcactcttccccgacttccccaggctcataacacaagaggctttggggcaagacgatttttcccccagcacctcaatatccattgtttttgtaccatccccctccccccatgcctaggtggaagagtaatgactccaaagcattaacttgcctttctctttatttcttttctttctttttcttttcttccttcctttctttaagcaggcagtttgtgttattgtggaattatggatttacaaacaggtggaataaataccgattcgggagctagaaagaagatgctttgtgtgtgtgtttaagcccttacagttggcagtttgatttttcttgtctgttgctttgtatcgtaatgggggtgatgagaataaaagaggaagcactgttttgcaacctacccaaagaaatattttcgaagtctctggggatgctgaagcaaaattaggttgcagatgtggactgtatagtatttgcctccagcgtgataactaccagcagtgtctaggcttacacctgtgccatttcgtatacttttcttagataccgagtgcgtctagtttctactcaagagggactactatatcaaaagctttttgttacggttttcagaatcctaaggtacatttgtgtaaccaagtgtttttgtaactaaatgcagcaacaccactgaaaaatagttttaattttaaagacctcaatttattagtgtacttactaatctttaccctcatcctccatgctgtggactgtagaactgttactgtgtacttgaagagacttagctattgcatccaatttgtaacattcagtaaggttatatttataatttgaatttatcaagtgttgatgttttgctgtgtgacagtgaaaagaattttaggaataaagtatgcaaatgaccattcgccacatatggaacttagactgagtatgataaaccttttgtctttatttggacataaagtatattgtaaactttttatgtaattataaatacacatttgaaaaatagacaaaaataaacacaaaactgaataaaagttttgtctaaggtttgtaactttcaaatgtctgaaatttaatataaagccaacatataaaacaatattgaaatcccagtttcaaattatggacatgtctttaagggtactgcattttcccaaggtgcttgttcagttttatttttagtttttaattgttatgggtacatagtaggtttttatgggttatatgagatattgatacaggcatacaatgcataatagtcacattagagtaaatgaggtatcccatcatctcaagcatctaccctttgtgatacaaatatccaattatactcttagttattttaaaatgtgcaattaaatttattgagtatggtcaccctgttgtgctatgaaatactggatcgtattcattctgtttttttatatccattaaccatccccacattcccccttcagtttttgaggaaacagctacattaaaagttgacatttgttttctgatcgctcattattaatataatttttaagttcaaaaaattttctcataaattattatggattaaagagtgatattaaaatatacattaatagtttgcagctagatcttttttttttagtttttaaactaccgtattcagaaagttcatcagagctgtttttctggtagttgtagcaagtaaaaggtcatgcatcaacttctgaactacaagccagttggaaatttgaaacatttcatgtttaaatagaaacatgaaaattacaaattcctttgtcacacttgctggaattacgcctttaaaatgttactcttttttctgtgacttgggtcagggaagaatgacttttctctttccacatcagagagacataaactggaattctatgtggaatgtttccaaagatggcttccgagtagtgattggtatagttattgctttggcttacctgtatgaattatggaggatgggtgaataaacttgaaattctttattatacaggtggataaattatagttatatttgccttaaaaatatgctcattttcaatatttgttgtatcatttaatatttctggaagacttctttaaactgttcagatattttgatttttttgtaaaaatatttaaatacagaaatctgtgttttaactaaaagatacaaactctatatgtagatataaggatgcatatttttggaggctgaagattaagtgaaatgtatctttagaatttggtttactatatgattcatgtatctttcatgtatgaaaaagccttaagattaatgcttataacaaaataagattttaaaaaaccccaaacaataaaaaacaacaaaacaagttaactcacaaatccttcagtgagttctgagatttataacttagacttggaagaattttgctactcgtttataaaatatcaattaacagaggaaatttaaatataaattggatattttgacatttcttaatgagactagtagggattggtattttgctatagatgaataaatggaaactgtaatttatcagtagaattatacattaagtacttttatgtgatacttaaatgagtacttcaaatattaagtgagttggtatttttgcttgttggtagacctgtatttcatgcattatgtgttgtgcattagacatataagttggctgaatcttagactaattaatggacatatatcatctgctatccttgtaatcccctattttaactgcttggccttctgaattttgtttcatttacttgttacactgcatcaaagttgtgccctgtagatcttttttgaaatattttctcttaatatattaaatttttatattttccgactgtgtaaactgacttttaaaatctgaataatttctgaattacagatgacctatggtatgcttgaacttcatatattatagagtgttcttaaaagtgtttgttaatcattacagattgaaacataagtctgagaaacttttatgttctaaaatatataattgaattattttaatataaattaatgttcattctggttttgtttggtattttcccccgggtctcaactttttaacacagcatctttaattcagcaaagcagagtttatacacgcaaaaggatattttaattaccaatgatccttaagcttttgagataatggtagtgtatgtgcttcttgagaaagcatgcagttcccattatcaagatttaaaagaacactaattcattttcacactgtatatctcattccaacttctctaaaggtcagaactgattgcaaaaagtagtacatgctctaaaatgtaaggattcatttatgagaaagagtgaacatactgcttgtagctaaaacattacaggagaccttaaaaaggggtataattggtccctatgtgaaatgaacctgacatatttttataaattatttgtgcatgactatcttttgttgatagcactaggaagacttctaacgtttaaatactttatttgccctcaattactatttaaaagtcctataattttaagtaattttacagctgacaaagataaatatttttttcttttagtttttctaatgtcttggaggtaaagtggaaatggcctgttttgacacataatttctagaacttggagttaatttgatcagttacatttgggtttttttcagtttccagttttgtgttgtataacacttcttcctgctttcagtactttctcagtcttgcaaatagtctttaacttttcaattttgttctataaatatttcttagtaactacagtttcacattcaccaatgtcatggaacttctgctgaatgccatgtgtgtcccaggctctgtggatacagagataaatatgtttccttctttcagtaagttcagagtttgttgcatgaaccggacaagtcaatagttaattgttaaacaatgtgacacatgcttttaacagcagtatatacactggcaaactcagatgagttaagactcacactgcacgtataactggcaatgcctactggaggacaggactggaatgaactcttgaggaataagtaggataggggagggtaataaaagcacaaaggttagatatgtttaggtccacttgggcagttagagaagaataacagtttggattctagtaataatattaggtcatatggtagacttcgattaaagcttgtattattattaataataatatttcttgtgttcctaattttatttgggctttgaactgcagatctgtattaatgttgaccaaactattatttaaaacttcaccttcaacacctgtgaaaagggaaaaattttcacctatttttcattactattttaattaaatacaaggagaatatatcagtgtaacgtggggaataattcccaggcttagaacttggataatgtttcaaaatcatacttaaggccgggcgtggtggctcacgcctataatccctgcactttgagaagctgaggcgggcagatcgcttgaggtcaggagtttgagaccagcctggccaatgtagcgaaaccccgtctctactaaaaatacaaaaaattagctgggcgtggtggcaggcacctttaatcccagctactcgggaggctgaggcaggagaatctcttgaacccgggaggtggaggttgcggtaagccgagaacatgctactgcactccagcctaggcgacagagtgagactctgtctcaaaaaaaaaaaaaaaaaaaaaattaaaataaaaagcaatacttaaatgtcttttctcagcatttatgtatcatgttaagagtaacatttatgaactttcttagaattcatggtaaagttttttttttgtataatcatttaaaatgtactcttttttgagtacactttaaaaaacactttccatacttacttgacagtgccactctttaggtaagtcagactgtatggtcaacagttataccctagaagcaggctttgtaattgtcttgtatgatttaaaagttctctgaacttgagaattgactaatttttcacgcagtattttttgggtttttttgtttttaagacagggtctctttttcacgcttttttttgtttttgttttggttttgtttttgttttcaagacagggtctcgctctgtcacccagactagagtgcagtggcacaatcatggggctcattgcagccctgacctccctgggctcaagtgatcctcccactttaacctctcgtgtaactggactacaggtgtgtaccaccatgcctggctaatttttctattttttgtagagactagcttttgctgtgttgcccaggctggtctcaaactcctgagctcaaacaatccacctgccttggcctcccaaagtgctggaattacaagtgtgaaccaccacgccggacctttcatgcaatataatttaatatttcttccagggcgtatcatgtgaggcctaattttgatatcccaaactccattccctgcagagtgccatagttttctgtgttaaaacactcatttgcatttcttgatgctcctaattatttttattatagaaatctgagaaatttaaaaatattaatattttagcaattgccttaaacatgttgttacacctcatttatcttgagattacttataggaaactaaaactatctggtgtcatcggcttggttactacctcatgcactcttcatgtagctaaactctaatcacccttcaggcctcaattttgtatcccagactttgggagaccttcctttcatccctagttaggttcttctgtttgaaggtatcctagtgcttttacttccttttttataacactatttttgtaatgatatatttgatgtctgtctttattgctagactgtaagccttaagatgagcattgagtatgtctgtcttatttactgttccaccagtatacaatgtctagactttgtaggttccaagtggaaaattagttttagatgaatagtctacagctccaaaacaaactgaacaggcccaaaggaaggacaaagacatgtcataatgttcttgtttttaaacacacattttctgtttttagagtccttcaagccttaattcaggcatttttattcctcacgtagtgcacaatttttaaaagtttggtaaccaaatgtaaaaaggactgaaattactcctagagggataagagagttgaaaataagagcagaagaaaaactcgaaaagccagatgcaagacattttgtaaaaacagcagtttatagcaacttaatgttatgacaaacatgcgtagaatctttcaagacactttgttttatacatagaatagtatagaaaataatgatctaggatcatgaagaagaggttattggatattagtaaattttgttaataacctcatgtattttggaaaaattccattcaaaatgatacaatttaaaacttttactgtgttaagcttttcttactgggaaggtttgcttaatgaggtaaaatatagtaggtaacagtatttattgaacaaaatttaagttgaaacaaataattatctgaaaatactgatcagtgcagtataatatactaccttgtaatttgtagaggtagatactataattactatgtgtttctttgtttactttgctatgaaatatgtaaaattgagtagcaacatttttttcttgacccacttttaatgaaaacaacctgttgcattgataagacaaaataactaagtatttcttcaacttttattctgttaaagaaaataagcttaattccttggcattgcctggttaaccggactgggaaaattaggttgaaagtcatagttctttgctaaaagtatgtggtgtctgacagattgggtgacctgaaatagattatatttaattcagtttgggtttgtatatatctgcgatatagaattcaaaatttcaccagagctttagttctggttcaaataaattacattttattttaatattgtgatctcttgaattctgtgactataaggataggtaggagagctagttattttgctcctaaaacaaatattggtttatctaccatgtgctaattgcaactctaaactcatagaaatgggatgcttatatactaggcagcttaaaatagtaaggttttatgatttaatcttgaagacatttatttctgtactttggaagtagtgatttgaaattcttaatactagaaaatggcctagtttcagaacacccactaagcaactgtgggaactcagtatgctaaatggctggtagtgctgcagtattttttaaattttccccacctcctgttatataatagcttatagtagtacaacagaatatgagtatttgggacgagaacaaagcatattgaaaccgcaaaatgatgtgagattgtgtcaggctttgtgttgggcaccaagcaccttaagatagtcagatataatgatggttagtgaatgtttgaaataaatcaagtggtaatgttttaggttgcaaataaggctcatgaaaataattatttggaggcttgagaaaaatgacttttaaaatggagtcactatttttaaaacacaatactcttttattagaaaaagtttgataactctgatataaatattccaatgatgcttgtgtacaatacttaaagcttttagtgaaaatagtttttatttaaatatttcccctggccaagtgtggtggctcacacctgtagtcccagcactttgggaggccgaggcgggtgggtcacctgaggtcaggagttagagaacagcctgggcaacatggtaaaaccctgtctttactaaaaaaacaaaaattagctgggtgcagtgacgcatgcctgtaatcccagctacttgggaggctgaggaaggagaatcgcttgaacctgaggggcagaggttgcagtgagctgagatcacactactgcactccagcctgggcaacaaacaagcaaaataatttcccgagactgttgtgcaaccccgtcattgtagcattgtttcagcctatgagaaccagatactgaaattgattagaaactattaaaaaaagttcactatttacttttttatttaggaaaatatggttataaaggaatttgataaaacatacttttactagcttattttgttaatttataaagggaccaagttgagcctgcactagttgtaaaagatagattaatattaaatgtttcagataaaaggttttatgatatgaaaaaggatggacttaaatttgctttaaacatcagctgtatggcaggcacagtagcttatacctgtaatcccaggagtttgggaggctgaggcagatggatcgcttgactcacaagtttgagaccagcctgggcagcatggtgaaaccccgtctctaccaaaaatacaaaaattaacagggtgtggtggcatgcatcggtagtcccagctacttgggagactgaggtgggaggatggctggagcctaggaggtggaggttgcagtgagcctagatcttgccactgtactccagcctggggaacacatccagaccctgtctcaaaaaaagtcagctgtataactcctgtagagttagctctgtgagtaataccttaatgcatatgaaaaaactttcctggctttttctcaattggaactcaattatacctgatatttgcaggtatatatgtgtattatataaataccataatataacaacaatgatcctgtgccaagatcttgaagatttttgttttatcaaagaaagctgaaattgtttaatataattgaagttttcttatattttgtcatattcaaattctttgaaaattgataatctataaatagtagattgatgtggtaaaaataaaaattgttcattagcacatcttatggccattatccagtttttataactaattatgcaaattgataatatttgagttgcttccaagagcaactaagaatcactaatgtcaacatttttttcttcctggcatgatttaaataatatatcacttgctacctgcaaattactacgtgatttacatgtttgtggtatggaaatttttttcatatcaaagcttctgatgtgggaatcttatttcatatcaaagcttctgatgtgggaatcttattttgagattttctttatctgcttgaactgctataataaaataccatagactgggcggcttaagcaacagtatatatatttcttacagttccgaaggctagaaagtccgagattgaggtgccagccgtttctgttcagggcgaatgaagagtctcttacaggtcttcctgctgtatcttcagttggcagaaagtgagagagcaagttctctggtctcctcttacaagggcattaatcccattatgaaaaccccacccttgtgacctcatctaaacctaagtacctcccaaaggtcccatcttcaaataccatcacattggaggttatagcttcagcataagaatttgggaaggacacagttcaggacatagcaggattatattcacaagatagtagttaatacataccagttgggaattgtagggttgtgtttaatgtgttaaattacaaaaataaagtatccctttatgtatattaaaacatataagagctgcctttcaatatcttgagtaacttctgatgggagaaattccttattatccttaaattgagtatggctgcttattatgtttcttttgatcttatatgaggaagattttagctttgtgatattttttaaaatgtaatacagagataatgagattatatttttaaaacccaaattataaaagttctatttaataaaccaaactgtcagaatggtagataaatagttgaacatagaggtcttttaaagtctcagaaatggaccatataaatgtaagaaacgccagttgttttataatcatggcaacttactaaatactgactgatactcaaatataagataccttgagaccacacactcctagtcttgttattgagagcgcatttatttttgttttttttctgacagtttccgatagtttaaatagagtgagtaatggaaaggatttataatgagatagacttagtgaagaaatatgtggctttatatgtacaaaaaagtagtagttaaatttaattaacagtttttagtttaaaaggtctgaaaatctttttttctttgaaaatactatattgaatattgtagtcatcttagtgtatgtagcagttatattttctcttttgctttacactggtaattaaatagccttttttttaaaattgccagtttgcatgggaaatgaaaagtaaagtatatcttgggaatacttaagttgtgtatgacatgtttggagttccttggcaagaaaggcaatttaagcaaatattcacgagtaaatctttttttttttttttggtagtgtttgtgtggcatttaaaacttttcagataatgtttggtcatttaccatttgacgtttaccattatatcttagtacttttgagacttttaaatcccctcttccctatcctgccttttaactgtgagactttggtgaagaattttgcagtttatgcatatggtgagttgaagtgttgtacaagagagctgtaatcccaattatggtttatattgtggattgggtaaacaggaattttcagttctttgctctaaactcttgttttcctagaatgtaaattacacgtaaagtcttttgctttcccataagaagtaatgcaggtttcctaaaaaactcccatttgctgctatataaaataaatcagtcccatgtctctccatgtctttccaaaatattttattttgcttccttaccaaggagggaaaaagttgaatgaatgaatttgaagatgctatgagttgtggactcttgacataattctagttaaatggacaagtgtagaacattttatttttgtggacagccgttagcctctatcccctacctcaggttcacttgtgctgcttaaaggtgtgcttttccatttctctgtaaacaataacattcttttgagcatgttaattgtgggtgttttgtcattctttggaccaatcttttggtcttctaactttgaaagctcctttttaaactcttaaactgcaaaaatatataggtttacatgatttaggtgggagagctctttctttttatttaaaagaataagaagcctttacatcttaataaataatgggaaatacaattgaaatcttgtcatttttaggtattcatgtcaaaatttgagtgacctggagttaattttaagtaggatataggggaactccatgcatgagatgaaaccttgtttattgttcatttatcatgttattaaaccagtatttattgagcatttattttgtgctcaataaaaggttcataatattatgtttagagttatttatagagtaaaaattgctgtctagaatggcagataaagccaaattagcaagtatttattgttctttcaataaatataagtgttatatgtgctaagtattgtcctaagtactagaatacaactgtgaaaaaggcagaagggttcctgttttcccattacctttaaatgagagagtcagacaactaacctgccaagtctaataatagcatgataagtgttctgttaggggaagttttaagtgggaacacagaggaggtggtatgcagaaaggcttttgaataattaggaaaagccttcccagacctctaagctgaggtctgaagagtaagtaggagttagctcagtgaagaattgtaaatctgtgtttctggcagaagaatatagcttgtgcaaagtccttgagacaggagatagaagacgctgccatgggatgtgaaagaagttcatgtgaccatagtgcaagatgggaagtattagagttgtggcaaaagtatgcaggggctagatcttcaagacatgtgaattattattaagaaatttgggtttaatcctgaggactcccctcagttcttttaattggacattaacctgattagatttgaatgtttgaaagatcactctaattacaacatagtgattaggttaagaacaggatgggaaagtggatatggtgagaccagttagaaggctattagaagagagaatttggtataccttatagcagggtaatggcagtgagaatgaagagaagccaatggcattgagaaatttggggagaaaaattgataagatttggtgattgtcagaatgtaaacattgaaggggagagagaagtcaggatgacaccacctggattcctagccccctttcaccttttttggttgattcctgcttagatgttatctcttttaagaagcctttcctgattcccctaacctccaaggctaattcaggtgccttccctttgtgcttcaacagcacttactcgacttttttcttgctttactcacttgtgtataagctttcaggcaaggattgtgctttattgttattgcatggtttgcaccttgcaaagtgcaaggtatactaagtgcattacacttagtataaatgttgaccaaatgaaaatatactttttatatttataaaaatttaaatgtaattggagaaaattggttttctgaactgctaatattcaaaacttgttttacaactttagagtgagtcatatcattccatgtacttctgaatgccacttgtaaaaacagtttatattgtaattctggctggaagtagtagatatattaagttctttatgggtaatcatagactaaatgatctctgattattatatagatcttttatgcattcagattttctttgtaggtaaagttttaattggctttattagtttaaaaattaacatcactatcagtgttacatatattttgtttcaaaatgagagtagctttttttctaattatgaaaggagtgattactcattgtatacatttaaaagatatacatacagagataaaaagtgaaaatcacctgtaattgaaggatagcattgctaacactttatgttcttctagactttgaaaattttatatatatttatgattatatatgattaagttaaaagaaaaattaacagtaaatacttatgtttgtacaagataaggtattaatatcatttatagtaagaatcttaatagccagtatgtagccaaataaaccaataggactaggatactaaacttcaattattacaggagaccaggcaggtaacataaatgagtgaacccagtaggggaaatatatgaggtggttgaattgtagaacacttggagagggcagctccttttcaatgtcagttgattttcgtcattaagaagtatggagctgggcgcagtggcatgcacctgtagtcccactactctggaggctgaggtgggaggatctcttgagcacaggagttcaaggctgcagtgcacactgatcacacctgtgaacagcctagacactgcactccagcctagacaatgtagtaagaccctgtctctaaaaaacaaacaaaagaaatgtggatccagtccagtgatgcccatatcttttgattttttttttaacgaaagtttggatttttttgtgaggctcccaaagattaaattctggcaaattaaaaaagccacagtgtgtgttaagcacgatgtagctattagctgtattttgtttgaataccacaaacagtggaagaatggaaagatctgcacactcttactaatatgtagatttaaataatatatcatttgcatacgtcagattgatgaaaatgattactaatttgcaaggctggaagagtataagttgatgcaggctctttggaagaaggcagtttggaactacgtataaaaatttaaaatgcatattagtttggacctgacagttctactttcaggaatctgccttacagaaatattagtccctgtgggtgaagattgatgttcagtgaagcattatatatcttggtgaaaacaagattaaaaaatgtaaaggaaaatagaaacaacctaaatatcagttgataataggaatgattaaattatgatatagccatatcacaaatcataggcaatgaaaagatgaaatatatctgtattcctgtgtggagagagtctagaatttactatttgttagttacatacaaaaattataatttatatacataaagttatactatgctgtcatttttaatatccgtacaacattgcatagtaccataatttagtctattgatgtacattaggttatttctaatattttgctatttatatgcacattgcagtgaacactccctttacatatgtccttgtagtgttgtctcctaagatatattccttttatatcttacatggtgacaacattaaatatctgaactctgtgacatcttggggacatacatttacctctgataatttgctatttgtatgacccttgaattgagtaaatgcaccctaggcatggtagaccagagaactaaccagaaaagtggcactgtgtttagtcatcctagattctttaagatttttaaaggtaacttaagtagtagtttttgtctagtccatacatgcatgtggtgtaaaattcaaaagatatagaaaggtaaagtaaatctttctcccactctgaaacctcttctacccagtttctgctcctgggaaactactatgagtttattcatccttctgcacatattttatacatatatgtatactttctgcacatatatgtgcatatatatgtatatattttaagttttttgtaaatgatagcatactatgctgttctacagttcactttttctcacttaactataataatatctaacacttacgtagtgctttgttctaggccctgttctaacaagtgtttttgtattgattactaatcttcatcacaaacgtgagaagtaggtaaatattattcccttaccacagaggaagaaactgaggcacagaaactttaaatgacatgctagtaggttgtcagctggaaggtgaactccagcatccagcagtttggctacagagtcttttatattagcccatttgctatactaactcaattgttgcctcattctttttattaactacataatattcccttgaaaaaacttcagtttatctaactaggtcctagttggtggacatttaggtgtttccatatactgctgttatagatgatgctagtgtgaatatcctggtgcttataaatgcctgtgtcattttgaatatgtaaatctctttcattttcatccattcaaatttgggagttaggggagtcttgtgttcatatagttacattctattttgagatctaatatgagacttttttttcaatgaatgtatttagctaatttatatttattatatcattatggttatagcctcatcttttatagctaatggactaagagataagtcaaggtatgttaacaattgaaatatacttaaagatgtaaagcagtacagtataaagatattagcattcctcagtctatttactctctcacgttttgttggttatataaaaacattatcaggaattgtaacaattacattatattctatagccatagccatagttttagaccaatagttaagtggattcaaatgctcaaagtttgttattttcgatagttttttaaaaatcttttagatggctgaactttatcatcaagtattttcttaaagtttatgaaaactattccttagggttttgcatatttaatgatgttttatgctgggggtaaattcttgagtactctagatattgcttcactgattttttttttttttttttgagtcggagtttcgctattgtcgcccaggttggagtgcaatggcgcgatctcggctcactgcaacctccgcctcctgggttcaagtgattttccagcctcaacctcctgagtagctgggattacaggcgccctccaccctgcccggctaatttttgtattttttttttttagttgagacggggtttcaccatgtggccaggctggtctcaaactcctgaactcaggtgatccgcctgccttggcctcccaaagtgctggtattacaggcgtgagccaccgcacccagcctgcttcactgatgtttaaacattgattccctcctccttcacatgttaagatagtaatgttttttgcgtagattctcaaaggattctctttttaaatctttgagaaacagtaattttactattgcagtatttatcttgattagtctgcatcagcttttcttaggaaagggcatgtccttttcttttcctttttttttttttttaacagtctttattgggctcagaccaggagtccgtgggtcttgaggacctctgtgtatttgtcagttttcttctccatgttcctcttggcctgtttccgtaggcttatgagctctttcttcttccggtagtggattttggctttctctttcctcttctcctccagggtggctgtcactgcgtggtacttccagccaacctcgtgagccaggtgccccagataggcaaactttcttgtaggcttcagacgcacaaccttgagggcagcaggaaccaccatccgctttttcttgtcgtaaggcggtgggatgcagtcaaacaccttgaggcggtccagagcggcctggcctcgcttggtcttgtggggcagcatacttcgcacagtcagccagaagatggggctgggggcccggaagtggtaggggcgtcggaaagggttggtgttcatccgcttgcggaggaaagccaagtacttcaacttgtttctgtagaaattgccagaaatgttgatgcctttgcagcgtacgaccaccaccttccggcccagcagtacctgtttagccacgatggtcgccaggcggcccaggagatggcctcgaccatcaagcaccaggacctgcacctctgccatcttcggctgccccttgggaaagctgctttttttttttttggtccaatcctgactctgtgtttcagtgatgccaaatgaggtctgtgaaagcttcaaatgtttcaagcaagggactgttgggtttgcttttctgactgtcatgtaatttacagaactgaactaatagttttaagatttgaagatgcaagccatttccctggcttgagctcttctagcatccctctttgccttcactgtatttagtagaccctctcatatgttatggttagggatatgtcttagtttgttgaagaagtagtttgtgtttctgtttctcactctcttctcctagttgttttcagatatttttaagaggaaaagaggggaccataccatctttcaaattagaaatcctaagagctacaggtcagtccagttttgtcagaattaagataactttaagggataaagtatgggctgatgtagttttccgaaagccaaaaatagttcatttacagaggctcttttggataaattttttttattaaacaaaatcacaatttaacatatgagtttgattatatcagtttgtagttatgaagtcttgtgcattaaaaagcattaagaatgaaactagtaagtctgcaattaagaattaagcatgagactagagactaatgcctaaagactaataactaaagttagggtttagttttagagtgctcatcagttcttcagttttccttagatggtgattcttctttcaactgaatctgaaaattaaactttcatgtacaaagttctgctactagaatatttttaagtcctttagcttaatgaatgttagttctggaataatctggtattctgaatggcatcttgtttttcaagggtagtgtccatttattttcctcacttaattggtcctatatgttaaaagaaatatgtttgaaaaattttgatagctagtgggcaagccttcttctgttctctgatttgaacatattcttatattcatttgcctgagtttcattttacctgtggcacctgagagaagctaagtattttttccaccccatttcttttatgtgactgactgtatatttcttagtctcaaatataaaaacacatctaacagcttcacagaaaattttaatgcttggtagattattggagctttcaatttttagcctttgttactctagttattgatcatttcagtatttttaaaatctcaattacatttttaataatttataataataaaatttgatcaatgttttaatttgataatagtgcctatgtttactactaaataagtgtactttgagcagttgaaacactgtgagatattgatagatatttcccaaaaagggttttgtgatccaaataaatttgggatatcttctatgtaatataataatgtactttgcgaagaacgtatagaacactaataatttctacttaaaggaagagtataattagattggaagcacttcttattccaaacctatttgatagtggaactaaatgttgtagaaatacattttgggaaatgctgagaatatattatagaatattttcagatcagtgtgttgttaacggtattccagtacatgtatttgcatgtcagttgctttttaatagggataaatgataattgctgtcccaggatgtaaatataatcagaacatttaactgtggtagtatgttttctataaatctgagagttttttgacatggaaattttgttaccattgattttccagactaaaagtaatttttgagtgcctcctatgtattaaacatcaaaaattgatcttctttggaactactttctgttaagtcttagcaggaggaattttggaaatcttgtagccctcccgacttatttttcagtaaaaactgaagcctagaaatgtagcttttgcctaggtcacattggaaccaaaccctataactccagatttttttgctattttttttactgccttaaaaattttattttatttatttatttttttgagactcggtttcactgtgtcacccagggtggagtgcagtggcaccatcatggctcactgtagctcctatctcttgggtcaagccatcctctcaccttagcctcctgagtagctgggaccataagcacgtgccaccatgcctggctaatttttatttatttattatagaaatagggtttccttatgttgcccaggctggtctcgaacttctggcctcaaccaatccccctaccttggcttccaaaagttctgggattacttttgagtacattgcttttgagatggaaagctaggtggtatctccacttaacatgagaattgaggtaagatatcgagtcatccatatgatgttagattgatgttagattatgacgtatgtcaactttgatgttagattataacgtatgtcaactttaatatatgtagaactcaagtttctagacatctagtttccccctcagttctctgaattatttttctcctaggcaagagaaaaagtagttttaaaataagcatgtatccttaccaatattactactaaggaataatcagtgctagtttttaagaattggtgcacaggccagagatggatgagtcagattcttttcccaattgagctacatcatcacttcctaatggtcaattatggaaatattttcctactattaatggaaaagtggacttaaatgactatgaagttaatctctaaggtgctgaattaaaatttatagaatatattctttttaacatacttttcagaagataccattctgttgaaaataattggcctcttggttatatgaattatgcatttagacataatgtattattggaagaaatttctcttttaaatagcagaatgataaaagttattagtgccatctgtagaatcaggactgaaatgataggagaaaaatttttttttgagatagacatgtggattttgtgtattttgttggccactcattttactcagtttcccaagactagaaagcaatgctgcctttcctaatcttgtttcatcatagtttcttggggtttatgtgtctaatctttacattaattgtggtgtatgttcttctatttcttcttctgtgcctctttcagagatgcgtaactctcacatacctttatatttctcttagaaaagaaatgaatcatattaggaagaaggcacatctttagggttaggttcaaaagtcagcatatacgtgaaaatagtgtatattaaaaatgtccattcaaagtcctctaaatgttcaaagtataatgtgattttgcatgtatcatgtatgtaaattcaattatttatagttatacaattttatatagagcttatattaacaaattattcaggtgcttcttaggtattgcagcatgtttatgaacatttcaatttactgattctgtttattgtcatctttatttactgtgatgattttatcagttcctctcttagttatttaatggttttctgttgtctttaatttagattttttctttaacaaattgaggaactgtcaccatccactcaacctggccacttggataattggtatacgttttttagaatgtttggatatgttgaaaaatgattcacacactctttctatagattgaccacacacatttgtctttcttgaggaaagacaaaatagtggtatttgtggtggggttttttttttttttttttgtgacagggtctagctctgttgcccaggctggagtgcagttagcacaatctctactcactgcaacctccatgtcctgcgctcaagcagtccttccacctcggcctcccaagtagctgagacaacaggtacatgccaccatacccaactaatttttaaaatagttggtatttacgttatttttctctccccatctctcactttttttttctaagttgtgataggtgtgtagtgatctgtcattgtgattttaatttgcattttcctattgattaatgatactgaacatcttatttgaacatacttgttttctgtatctcttcttccgtgaaatgtctgcctgagtctttgcccattttctgcttgtattatttcttttattaatgttgagtttttgtttgtttgttttgcattttcctctgttgcccaggctggagtgtagtggcgcgatcttggctcactgcaacctccgcctcccagactcaagtgattctggtgcctcagcctcccgggtagctgggattacaggtatgtgccaccatgcctggctaatttttgtatttttagtagagacagggtttcgccatgttggccaggccagtctcgaactcctggcctcaagtgatccacctgcctcagcctcccaaagtgaggcatgagccactgtgcctggcgtaatgttgagttttgagagttctttttatgtttaaatgtaagacttttgtcgaatacatggtttgcaaatattttctaccagtctatataacctgtttttttcattctcttaacaggatcatttgtggggcaaaactttttaatttcgatgaagtgcagtgtattgattcttttcttttatgaaaaaaaatttttttttgcctacgaattactagtatttgaagactttcttgtatgttttcttctcagaattttataggtttacattttacatttaaaaccatgattttgaattaacttaaattttggattagttgaattaattttatatacactgtgaaatttagattaaggtaattttttgtttttgttttagcttatggatatccagttgttcagcaccatccaaagaatttttcattctctgctaagacaaaattcattcgtttgttttgtactttgaagggttctttacccacgtgtgattttgattcatcatacattggtcttctggctctttgagttacgcagattttctaaatgttgacacattttatcatacagtattaaataaagacatttgttaataattccactgatttcgtcaggaaggtctttaaatattgggttgctttaaagttcatggtggtgaatgcatgctttctaaagttctaatttttatttagggtctaactttatcactggcaacaaatattctgttattttgtttttgtttttgtttttgagacagggtcttgctctgttgcctagactggagtgtagtggctcagtcgtagctcactacagcctctaactcctgagctcaagcaagtctcccgcctcagccccacaaggtgctaggattataggcatgagccactgtacccagctcatttgtttttgaattaacaggctcatttcctttattttcaagaaaatgtctgccaaatactagagactgaagagccgcacgttctcctcaactggctcaggttttgataatccataccaggctacctctctgtaataacatcctcttggtctactcggactctttcatgtatatttgaattactttctagtgtccttccatttcaacccaaagtactcactttatttctaatagggcaggtctgttagcaatgaattcttctggtaatgctttcattttaccttcatttttgaaggatagtttttatggatatagaattcttgttagacagtttaaaaaaattcttttagaactttgagtatgtcctcccactgccttctggcctctatattttctgatgagaaattaaatgttaatacttagtatctcttgtacatgatgagtcacatctcttgttgcctttgttttgagttttttcatcctcagttttctaagatgaagaattctttctgtctgtcagcagtttgataatcatctgccttcatgtggattctctttgaatttatcttcctcggagtttgttaagcttcttagatgtatagattgatgcttttcttcagaattgagatgttttcaaccattatttcttttccttctttccttctgggactcccattatgagtatgttagttcacttcatgatattccacaggtctctgaggctccgtttctttttctttattctttttttttttttctgttcctcatactggataatataaattgacctatcttcaactttgctgattctttcttcttcctgctcatatctgctgttgaacccttctagtgaggtttgcatttccatgattgcactttcaactccaggttatttggttcttttaaaaacaacttatatctctgtattgatattccctatttggtgagacattgtccttataccttcctttagttctacaggcatgttttcctttagttcattgaacattttaaaaatagctaacttacaggagatttgatattaaattttcatttacaacttttacctaagtgaacatgggctatcatgaccttctgtgagcctgtgtcttcaactccagggcgtgatcaataataaatggctgagttgtcctgctggaacactgaaaccttgctaactcactagagaacaaaaagtagtctcaccatgttaaatattaagtgagtaacttgtgtttgtcaaattgagaacctattttcttatatctaaacaaggaagttaatcttgaggcagtaggaatggaattaagcattctggtcacggaaagtcacattggccttctatggatcagttttaacagtctgcattctccttttcttcttggcaacccagaatctttcaaccaactcttttagcacacttcttccacatattatcatttcagatcgtcttttgccccaactttgccccaagtggctgtggattggatttgatctcaccagtctcctctttcttgctcgtctcaaaggaagacctgcctattatctccctgcttttttgttattacagaaaaactgagaatgacaaaaacataccttggaaaatttattatgaaatctgaaatgtgacatgttacaaagttcataagctccttgttccatagtatattgttatctccattcttaggatattctgttgtgatactgttttctgctttttattttgaagttggtacttatccaggccctcttaccattttaccattatccagtgaaaatttatggattctacctttatgtgtgctccttctgcccacagtggaaaatgaagataatccagatcacaaatgaaaagtatgtatctttgagccaaaaaaaaaaaaaaaaagctgacttagaagtgtttaataagtccaatatctggatttcctcagggacagtttctgttatttgcttttcttcctgtgtatggttcatattttcttgtttctttgcatatcttataattttttgttgaaaattacatttggacattttaaataataaatgatctttgaaataatgtggacattctaaataatataaaaatgtccaaatagtggagacttataataaaataatttgacaactatgaaaatcacattttgccctctcttcagggtttgttggagtacttgtagttgtttcttcatttaatttcttttgtgaattaattctgcaaactctatttgatgtgtgtgactacctcagtagataattcagtctctagttggttagcttagttgttgctaatgactggacaaagatttctttacatgcctggaaccagtaaatctcctagtctttgccagaggattttgtgtgtgtgtgtcttggggcatgccttcaacactcagctgggtagttggcaactctgccttgtccttatgtcctgcttgtgcagagcttcaaagcttaggcccttttcaggtcttccttgagcatgtacacagccttaggcatgtgtatgaccttctagattcccagtaatatgtcagagcttttcaaagtctgttacgggtatttcattctcagcttttccttttaagatttaagtctgttgctccaactgttattcactgcctcaagtagatatggtataaaacactttcctgtaatttttttcaatgaatatctccctggggaaaaggcgttttgcattgtgcaagctctgagtcaggtcacatacggtcagcattgcaaatagggtcttcctggaaacaagactgctcaagcaataatttggggagaatgaagctttgaatgagctacaactcttgctgctttttaacgtagcttctagagtgcactgggaatgtgagctgtcgtttcttcaagactactgtggatctggagagcaagggatgggactagggcaagttaaaatagaaagctcatcattcttaatgagattgagctttttaaaaataaatgcaacttggatgcaagctttttattaatttttagagttctgataaagttgattctattttccagttttctttgtgcttttgtggaagagacagtttttagagatgcttactctgctgttttctgtgatgtcgcctccacttgggctttgccatcccacactgacagacctccatgtttgactctccctatctccaccccaaccccactcagactctgactctccatgctaggcttaccctgtgtgtgaataccttttcaccttgcttgaaatcttaactgttcatgttgcgcagcctcctccttaaccatcaatcaagcctattatgtagaaatcttcctcactctcatagactccagtatcacaccctggttcatcactacctgtggatgttcttctcacccccaatcaggttctgattctctgtgttgagctatcttcctatgagcatacccaccctatcccaattggcctcttaaacatcttgtgggttaccatcatatgtcagtgttcatctcttcctgttctaactgataccctacacagaactgcatctttgtgggattgtccttttcatcctactcaggccctgagtaggatttttttaatcaaataaaaatcccttcagtttgaatagtataatcatgatatcactcagtgaaatccttgatatcttattattgtagtggtaacttctgatgggtatgggaatgacaattctataccatgccttctttatttttcattttagttttactgagataacatattttgaagctgatcatttatatttcttaaagaagaaatttattctaaaaaattatgtctagatacattaatttgttgttttattcatgtagtaaccatttcttgggcatctagtattggccaggttctaggctctgaatatacagctgcaaaccaaatagtcagaagcccctgctttcacagttttcacattcatagaggagagggagatgatagacaaaataaataagtaaatatattttatgaggtagtaaatgttgtgaagaaaaataaagcagggtaaaaagaataggaagacatttctcttttatatgtagatcaagaatgagatatttgagcagggaacaaacaatgtggatatttgagagaaagggctgtatctatgcagatggaatagctagaacaaagacttcatgtgtgagcatgtagatctgcattcaaagaaaagcaagattaatatgaatggaatgcaagtacctagcggggagagttggagaaaagctagacaagtgtaggggctagatcatgtggagtcttggaggttggaggtaagggcttgccttttattttgaaagatgggatggcatcagattttttaagcaagggagtgacttcatcatatttaaaagttaaataggaagagtgatgttagtaaaatgtcagaatagtagttttcagcatttgtttcttcacagaagcatttcgaataaccactcatagacaaaaataccttcacaagagctaaggattccaaatgatagattgtagcacccgggtgtagcatagatacaacaaatgatgcattgaagaggataggaactacagttgcacattaattgtttcaccccttcccaagcctgtgcagcacagtatggagatagatgccctccaagtggaggaaggagagtcaagtgagcccctaactttactgtgaaccccagcactagaaccacctcagtgaaccccagtgccaggctggcacccatggacccaggcaccaggccagatcccacagaaccagtctccagacccatccttgcggatccagtaactgaggctagcctgctggagaagtcaggcagcaagcctgctcgtggactatgccagccatgctgtccggaatctctggacaggctgactggtaaagggcttcctatgttaaagctcctctgtaaagactggagaggtgactacttcttcaaatatgcagacaccagtgcaagtccataaggatctcaaatgatcagggaaacgtgacaccatcaaaggaacaaaataaagctttagctatgataatttgttgataaatatataatctaaaaagatataagttgtgtcctcaataatgtaaacttggagagggtgtggagaagttaagagtttttgtatgtgattgaaattaaatttttatcagcttaacaacagactattataactacaagatgtcttatatacatttcgtggagaaaaacccctgtaaatacacaaaagataaagagaaagcaaataagtaccaaaaaaaaaaaaaaaatcaaatcgcaaaggaaaacattaagagaagatgaaagaaatagaggagctacaagatagtcagaaaacaacaaaatgacaatgttaagactttatccacaattacttttaatgtaaatggattaagttctctaatcaaaaggcagagttttttaaaatatatttttcaaaagatcctacagtattatgcctaaaagagattcattttagcattaaggacacacataggctgaaaatgaagaaatggaaaaagatatttcacgcaaatggtaaccagaagagaatggggtggctatatttatgtaagataaaatagacttcaagtcaaaaactgtcataagagacaaagtcattatacaatgataaagaaggcagttcatccagaagatataatagttgtaaatatatatacactcaacatcagagcaccaaaatattttttataatgagaaagccaagattctaaaatcttaacagaaatgataggaacaatagatagtaatataataatagggacttttgtacctctgctttagcaatagatagattagccagacagaaaatcaataaagaaataacagacttgaacaacattttaggccaaatggacgtaacaggcatatacagagcattccattgaacagtagcagaatatacactctttttaagtgcacattgaacattctttaagacacattaggtcataaaacaagtgttaagaaatttgagaagattgaaattgtatcaagtattttttgtaagcataagagtatgaaactagaaatcaataacaccaggaggaaaactggaaaatttacaaatatgtggaaattaacacattcctgaacaaccagtggatcaaagaaaaaagggacatttgaaaaggtgtctcgagacaaaagacagtggaaacacaacatagcaaaacttacgtgaagcagcaaaagcagttttaagagggaattttatggtgataaatgcttacattaaggaaaaaagaagataatcaaatgaacaaccttactttgtatctcaaaggactagaaaaagcttgtccaacctgtgggccacatgcagcccaggatggctttgaatgtgacccaatacagacttgtaaactttctaagtttcttaaaacattatgagagattttttgcattttttttttcccagctcatcagctggcgttagtgttagtgtaaattacttgtggcccaagacaatccttcttccattgtggcccaaagaagccaaaagattggaaaccttgtactagaatccaaaccagacataaagttgttagaaggaaaggaataataaagatcagagcagaaataaatgaaatagggactagaacaactgtagaagagataatgaaactaagagttggttttgtgaaaagaaactgaactgacaaatctttagctagactatgcaaaaaaaggactcaattaaaattacaaatgaaagagaagccattacagctgatacaacagaaatacaaatgagataataagagactacaatgaataactatacacaaacagatggatagcctagaagaaatagaaatttttttctagaagcatagcgtctaccaatcatgaagaaagagaaaatccaatcacacccagtgactgtaaggagactgaatcagtaatcaagaacctcccaaaaaagaaaagctttggacctgaaggctccactggtgaattccaacaaacctttaaagaagacatagcacaagtcctaaaactcttccaaaaccttagaggagggaatacttccaaactcattttacaagtctggtgttgctgtgataccaaagccaaacaaggacactaaaagaaaaaaaaaatacaggtcagtatctctgattaacgtagacgcagaaatcctcaacaaaatactactaaactgaattcagcaacacattaaaaggttcacacacagtgagcaagtgggatttatcccagggatgcaaggatggttcagcatatgcaagaaccaataaatgatacaacacattaacagaatgaaggacagaaattgtgtgatctctcaatagatacagaaaaaacatttgacaagattatcactttgtgataaaaactcaacaaattagggatagaaggtacgtatctcaacaccataaagattatataagccctcaggtagctggaagcttgtcctcttaagatcaggaagaagacaaggatttcttctctcatcacttctagtttataaagtactgtacatctgaatcaaagcagttagacctgaaaaagagataaaagatgtggaaatcaataaggaaaaagtaaaattgtctttctgtagataacatgatcttatatgtaggaaaccctaaggactccgccaaaaatgttagaattaataaatgaattcagtaaagttgcaaaatataaaattagcttacaaaaaccagttgtgtttccataaactaacaatgaataagaagttaagaaaacaatcccctgtacagtagcataaaaataaaaaggaataaatttaacaaaggaggtgaatgatctacacagaaatcgataaaacattgatgaaagaaattgaagaagacacataaatggaaagatatcctgtttttgaatttgaagaattaatattattaaaatgtccatactacccaaagcaatctatatatttgatacaacagctatcaaaattccaatgatattttacacagaaataggaaaagcaatcctaaaatttgtatgtaaccacaaaagactccaagcagccatagcaagaacaattctggaagcatcatactacccgatgcctccataattgttcaaaatatactacaaacctagtaatccaaacagtgtggtactggcataaaaccagagataaagaccagcagaacagaacagaaagcttataccatgtgtacaatcagttgatctttaacaaagatgttaagaacacagaatggagaagtgatcgtttcttcaataaatggtgttggaaaaactgaatatccatatgcagaagcatgagcataaaaatttcattcctgtactatatataaaaacatgaaaataattacaccatgtacaaaaatcaactcaaaatagattaaagacttaaagagcgaaaactgtaaaattaccagaagaaaacaaagggaaaagtttcttgacattggttggggcaatgattttttggatatgaccccaaaagcataaggaataaaagcgaaaatagagaaatggtattgcatcaactgaataagcttcggcacagcaaaggaaatgatcaacagagtgaacaataattgacagaataggagaaaatatttgcaaaccatacatttaataaaggcttaatatccaaaatatatttaagaactcaatgatacaaaaacaacccaagtttttaagatgaacaaaggacttgcattgatggtcttcaaaagacaacatacagtgtacatcaggtatgtgaaaaaatgctcaacgtcgttaatcatcagggaaatgcaaataaaaaccacaatgagatgtcacctcacacctgttagatgtcacctcatacctattatccaaaagacgataataagactgtaagtgttggtggggatatagagagaatagaactcttttacactgttgtaaattggtacagccatgtactgaaaaatagtatggagtttcataaaaaaattaaaaagagaactaccatatatgatccatcaatctcatttctttgacttcttggtacgtatctagaggaaatgaaattattatattgtgaaatgtctacgttcccatgttcattgcagcattgtttacaataaccaagatatgaaatcaacctatgtcttcattgatggaagaatacacacagaaaatgtgacgttcagccttcaaatctaggaaatcctgatattggtgacatgatctgatcttggcccactgcaacctctgcctcccaggttcaagcgatcctcccacctcagcctcccaggtaactaggattatagccatgtctggccaatttttctgtatttttggtagaggtgggatttcaccatgttggccaagctggtcttgaactcctgacctcaagtgatccgcccgcctcaggctcttaaattactgggattacaggtgtgagccaccacgcctggcctaataatgtcttttcaattgattaaaacttacaggcacagggctgtttttatttttgatttaggacagacttaagaggtcatctgtagattgttacagacaatgaaactactagtttctcttaaatattgccctctttcacactagttaaccttaattttttgcctttttacgttttgtttttttcagcttttaataaagcagtaatttaagtgattttttccagttaaatttttaaaatatagtcttcacttttagataaattttaggttcatagcaaaattgagttggaagtacagagttcccgtatattcccttttccaccctacaagcgaagtcttccctgccaccaccatcttgcatcagagtaagcacattcattattattgatgaacttgcattaacatattatcacagaaagtgcatagtttacattagggtttttactgttgtaggttcaatggattttgacaaatgtgtaatgacatataactatcactatagtatcatagggaattgctttactgccctgaaaattcctgtgttccacctattcatccctcactcccccaacccctagcaataactgattttttttttttaagtttactttaagttccaggatacatgtgcagaatgtgaaggtttgttacatgggtatacatgtgccatcatggtttgctgcatcgatcaacctgtcgtctaggttttgagccctggctgcattaggtgtttgtcttaatgccctccctccccttgccccgcacctcgcaaaaggccctggtgtgtgttgttcccctccgtgtccatgggttctcattgttcaattcccacttatgagtgagaacatgcaatgtttggttttttgtgcctgtgttagtttgttgaagatgatggcttccagcttcatccatgttcctgcaaaggacatgagctcattctttttttgtgactgcatagtattccatggtatatatgtaccacatttgtttatccaatttgtcattgatggatgggcatttgggttggttccatgtctttgctattgtaaatagtgctgcagtaaacatatgtgtgcatgtgtctttatattagaatgatttatactcctttggctatatacccagtaatgggattgctgggtcaaatggtatttctggttctagatccttgaggaatcgccacactgtcttccccaatggttgaactaatttacattcccaccagcagtttaaacgtgttcctgtttctccacagcctggccagagtctgttgtttccttactttttaataatcaccattctgactggcgtgagatggtgtctcattgtagttttgatttgcatttctctaatgatcagaatcactgatctttttattctctccctggttttatctttgccagaaagtctcatagttggattcatacagtatgtagcctctgcagattggcttctttcatttagaaatgtgcatttaaaattcttttgtgtctttttgtggcttgatagcttatttcattttagcgctgattaatattgtattttatgatgtaccacagtttattcattcacccattgaaagacatcttggttgcctctaagtttgggcaattataaagctgccataaacatctgtgtacaagtttttctgtgaacatagttttcatctcattgggtaataccaaggagcacaattgatggattgtataacttgtgcgtagttacagtaaatctttgagagagagatatatatatacacacacacacacgtgtatatatatatatatattttgataggtttgatgtgtatatatatttaaacctaccatcttatgccacatatttggtggattggggggaatagaaaaggaaatatactttaaaaatggatatctggtgatacctcttctatagtataaaaaggaaaatttttaattatatataattattactttttaatatatttaacctaagtgaagtcatctatcttggtttattttattttctaatttgggttgtctataagcactgatttagtttttgttgaccaaaaatttgttgaaaaattacatttttattctaaataatttgtattcaggaaaagctactgtttgcctctttttaaggaaaaataagtccattgtttttgtgtataatttattaatgtttatattccaatttagtgttcacagtatatactgttaaaatatttacttatattaatattaaatattacaaatttaatttcttttttactaaaagatattgtcctagaatagaaattgaaatatttgaattaattacatgttttattttctgattatacattttttaacatgagagaggcagcttggttagggtggcaggagtatattgactatggaatcagaagacttggtcatctagaatcatctcattcactacctagttatatgataaatgtttatgttagcatcaaaataaaggggtagtatcagctagcttctttgcagcagattctcaagtcactttgaaattaaaagtgcctttgaaattaaagtttaaatgttttgttattttaatatgggtcttaactactataaaacaggaactgataaagatgctaacagtatatttgtgaacaagacagacaaggtcccttatcttatggaaggaagtcttacagagcttacattcttgcagggaaatgggatgtatcataagcaaataaacataaaagagtaaagtaatttcatatactaataaatgttatgaagaaaataaaacaggatagatggtcagagaaggctttatttaaggggtgaagcttgaggtgagtcctaaatattataaagagtcagccatgtgaagactggggaagaacattccaggcagaggaaacacagacaagggcttgaggtaggaaagaaattgatgttttcaaggaacagtaagagcagtgtgactggggaatagtaagccagtgagagattggtaagaggtaaggttgaagagacaggcagggaaaccttttcctaaaatatgttaattttgagatttaatggggcaactctaagatgtcttttctttacctaatatttgaaaaattagccatttctagtcctctgtaacattttgtgctgcatacggcggttagagaatttgagcaggagagtaatatgaactatttggataaaaagtgctttgttcactttttggagaatggatttaaagtatgtgggaatcagcaggccaaggtaggagacaaggtagttcaagagagagacgatgagagcttggagtacggtgaaggcaatgaatgtggagagtagacgatttgtgattcattttgactaaagtccaccatgtttgccaaaggtttggatatgggaaattaaggaaggaggaataggaataactcttaagtttcttaagtttcttgcttaactgaatgttgtcttttactgaaatggagcagtttgggataaagatctgattttggaaggaaatcaagtttgatgcaaatgaggtaggtttttagtgagattgggggggaaatctattgattatctcagttcagtttaaaagacatttattgaggtctctgtatgcagagttttgtgtagactcattaactgctgacttaataaattcatacttgcggtatcacgtgtgggacatctgttaacctgtagtgtgaaagggaacttcagggggaaaatagaatcttttaaccaagaaatacataatgtgactttgtgtcattgctctgttttctataatttttgtttcaaccaaaatattataatttcttttttactaaagtacattgtcctagagtagaaattgaaatatgagacttaattacatgttttattttctgatattacaatgttcattcaacactgaacaaagttcctgttctcgttgaagagttaggaggaaggaagggtataaagacataaggaacaattaagcaaataaaataattttagataatttaaaggtcattgtcatcaaaattggaagatatgacagagttgtaagtgatggaaacttattaaatatatgctttttaattacatgggtcacacaacccaaatatatggctatgtatgggtagcacatgcaccaacatatgtagagaattatagactttgcagagtcacctgtaatagcttcctctggtatctgcatgtgcctaattgcctgaaatgactcctgtggatccaacaggttttttacatttcatgtctttttttttttgagacggagtttcgctcttgtcacccaggctggagtgcaatggcgctcactgcactctgcctggagtggctggagtctcggctcactgcaacctccgcctcccgggttcaagtgattctcctgctcagtctcccaagtagctgggattacaggtgcgcgccagcacacctgggtaattttttttggtattattagtagagactgggtttcaccatgttggccaagctggtctcaaactcctgactacatttcataccttaagaccactctgcttctttggatatagctgcttgcaattctgctgctttgcctaatgtcctgtgatactttgctgctttttaaaaaacctttgtttttcacagcagtgctccttgtcctaaaatatgttgaaattgtggaataaaaagtttaagacttttccagtttgaaaactcttcttacatgttaaaaaatgatagtcttgtataaaatgaatgttttaaatcttacatttatcttgatctgcttgggtttagattgtctgcctctgttaccttatataatcattgtgtttttcatgtttatgagaaataaaagaaaaaataaatgattgggccctaggaaaaatcctttttttttttaaataacaaagtattccgtttaatgttccttttaatatattgccagtgaaatatctcgtaagtagcttcttcttgtaagaaagttagctatatttgtagcctctttaattgaaagaaaaggttctagctgacctgcagaattagacatcagggtaccttttctggtgaacctggagctttgttcagagatcaagaaaacaagctctttattgggcatttgccctaaggcaacattaacttaatagatattttcttcctgtaatttgctgatctttgtatttaagtttggaaatagcaatattcataaatgggtacctttggttgtagtattgttccatgctttcataccatttaaatggttcatcaagataaaatatgttattgtagtcagcaagattggttagaatagtgccctgaatatcagtagctctgtattctagtttcagcaactcagtgactccaatatgtgcttgagtaaatcagctcatttctttacttctcaaagtcttaggactgttgtgattgaaagcttattgctttgttttgccataatttactatctttttagctttttaatgctcgtctgttataccgactctttgacttaacatagttttttacctggtgtgtataatgccgcatgtatatgtttgtggataaatgtaaattctcctgcaggaagaacatcagattcttaatcatgaagataccccccccccagcccacaatttccaactcactcttccagtttcttgatcactcccttttcctctaattatctaagaaactaatggcttattaggttcacttttttctccttaccagcccaaactgtactgtctggtcccttatttttctgccacacttgccctgtgaatcccctcaactttaaattaatttaggaatacaatttagattgccaagtacagttttggagattgatgccacgacaaattaatgatatcaaaatttatcagactcagcaattttatttatctctggtctatgtcctcatacattccttttacttctttcatcaaccccttagcaaactttgcctttcatgttctcaacagattaatttgcttctgtttcaccaaacaaatatgattctgtatgtaactggagatgataatcccacttaactctcttattcctcctcccttcaaacaaacttgtctgtagctgaatccattctcattttttaattgaaaggaaaaaagatccgtcttctctaaggctaagttttctgccagtatgctacatatttttgactactccttccttctaaaatttaaatagatgaactggctgctgctttgacaataccctttcctagtttatgtgtacctctgtttctctttgaggcctttgtcttccatccatttctttctttcttttttttttttttaagacggagtcttgctctgttgccaggctggagtgcagtggtgcgatcttggctcactgcaacctctgtctcccagttcaagcgattcttctgcctcagcctcctgagtagctgggactacaggtgtgcaccaccacgcccagctaatttttgtatttttaatagagacggggtttcaccatgttggccaggatggtctcaatctcctgacctcctgatccgtccgcctcagcctcccaagatgctaggattacaggcgtgagccactgcacttggcccatccatccatttctaaatatttatcttccccagagtaccagtatcatcttctacatgcgttttgtggatagtctcatctgaaacctttgctgttgacaccaaagctgtatctttatttctagcccagacctccctcctttattctaaaatcacattttcaagtgtggactagactagaatctaagtataaatttgttcaaaattttactaattttctttttttttttgttccctgtcttgaataatcatgctgcctccacctgatttaagccggctactcagacattaccctgaatcccttccttctccctactcctgttcatccccaactgctttctgtttctagaattattcctatattttcctagtacctttgtagtttaaaccaattgttctcaagtacatcagacctaatatcccatttatgcaacattctgtaacacttccttactcttaaaatgatagtaacctacattatttttaaaaatctatgtaatttcttaaaggagatatataagaaaaatattgtacattttatatgttatgtaaatgcttaggcacaatgatattagaaaaaaatgaagaatttattatacattttatgtttcagtatttaagtgttcaggcacaataccagaaagcaatgaagagcaaaagtttgtacatatgtcctcatgaatgtgattgttagaagtgcaaactgatatagacgtgttatatttttgactcggataccaagatcagtatgagtatcagtgatcatcagaaataacaaataactcttaaagaatagtgcaaaaatattgcagtttttgtgtaaaatggaattaggtgctcaaaattataaacaggtatttcacctagttatatatctggtaggtatttgaaggttgtacagtatgcaaggatagttctcatctccagacctggcccattaaatgccagtagcatttctctaaacattgagacaacctaaagtgaacctacaaaattccaaaatactgtagctaaaaatagttagattgtacctttatcatgtttggcatggactgttgcagtggcttccaaattcggctctacatagaatcacctggaaaactctttaaacatacagcttactgttccctaccacagatatttattttgttagcattcttggattaggggttaggatttctaagctcgccagatgattcttgctgaaaatgtctggcaatgattgaacattagggaattcttgctgaaaatgtctggcactgattaaacacgaaattattactgctttttaaattttctgccttccttctgaagtcctgactgtttacagtcattctaaacattgtcaggtaaattttgttaaaatatgactgtaatcatagcctcttctccttcaggaatcctttattggctttttatatttactcttggcagcccctaagagtacactgctggaacattagagttgaaagaatcatgatgtctgcatgataaagtccaaattactaaatttgaataaccagcgtttccaaatttggcagcctacattttttacttcttgtgtccaatttgcataaaaatatagttcctgaaaggaatgatttaaaacctgacactgacttatgacagggcttgggaaactatggcctgatggccaaatccagtttgaggtctgtttttggtaaagttttattgaaacacagccactcttactcatttgcatattgtctacttttatgctaaactgacagaattgagtacctgcagcagaaagcaatctgtcttgcaaagcctcaatatttaaaatctggccctttacagaaaaagtttgctcacccttgacttagaagccattagaagcctaaatgaattgtaatcaccaccgtcatatagtcatgatttggatgttttatctctgaaatccaacatgggatgggaaaagaatatatctgggcttttgagtcctgaccaggctgacctggttttgaatttttccttagtcacttagtaggtatctgactttggtgcctcagttttctcatctgtaaattgggactagaggaactattctacttaggaatttgaaattcagagttttcataatttggaatatagttatgttccagagaaaaatggtatcaactcagagctccaccaagtttgtagtttttatttggttttgtttttgaggaatctctctctgtcgcccaggctagagtgcagtggcacaatctcagctcactgcaaccactgcctcttgggttcaagtgactctcctgcttcagcctcccgactagctgggattacaggcgcccgccaccacgcccggctaatttttgtattttttagtagagatggcgtttcaccatgttggtcaggctggtctcgaactcctgaccttaagtgatccgcctgcctcagcctcccaaagtgctaggattacagacgtgaaccaccacgcctggccaaatttgtagtgtttttgtttggggtcactaatggttaagtgtattcaagggagctaacatatcaagtgcttcatatgcggtagttattaggtggaggtgaataaaagagtcctctggggtagtaaagatccctgtataaaaacctccttgccagcctcagcttaattattgttgcaattttatgcttttatcactagatttcaagcattttgagactgggtactgtgtattctattacctaaatgagtgcaagattcaaattttatgcaaatatagccttcccccaaaacatagtggagttgaagtgattaaaaaacaactattaaataaataacttatttccaagaaacatgaaagattactctcaatatgttttcttatctaaaacgtttgacagtgtcacctgattcaggtctgaactagatccagaacttaatttttgactgtcagataatttgttagttctcttggccaaaaatatttttactggatgtgaaaaatttttagttaatagctaggtctggctggttagttaattcccttaagtaaagcatagtaattttgtcaaggtcaaaagctttattctctgactagttatatttcttatgagctattattgaactatatatatcagcaaatctcattaggtacaagtgctacaggatgagtttgggggtcactagttcaaattcatcaccactgcagtaaacccatcagacagttcaagtatcagtctgaatttcagatacagtggctagtattatggattatgggaagtccttttagatttcaatgggaactttattaataacttatattttcattaatacagtttctttcttgacccacccattaccttcaaccttcattgttttttaattatatttgaaaaatataatattaaatatactggtgttcagatcttacatttggtcatatcatgtgtttcccgaacttgataagcttttgttgaggcgtttatttttataaaatacctagaccccctctccctaaaattttgattcagtgatttgtgatggagcctgggaatttgtatttttaaacaaatatctcaggtcacgtattttcttttttcgtttttatcattagaaaagtttactttttatttctttccaagttttcttaccttttaataggggtaatcttgttctatcctctgtacttaatatatgtgattttacaccttatatatttcatttgatccttatataggaggtgtccttctaaatttagggtatacatatcttgctaaatagaaatttgatttccagaaacttgatataatgacatttcttaaatacaaattgataagcaatgcctgtaaccctttagctatgcatatttcccattattcagttgtatggttttagtaaatgtactttcatattggcttatcagcattattttctgaatcagtatctctagagtttttcttagtctctctccatcgcagtgcaaaataatttttttctttttttttgaaagggttgaatagtaatagatagagctctcctggtgtgctagcaaataatgatgtatttgtttaattgtagaatcttatataccagtaaagttcatactgtgcagtttcaaatttacagattattcatcctctaccccagttcctgttatttctgcacatttgaccatttgcttcagcaaagtgacacattttcagtgtcccgtgcaaactaagctccactccctattctaggcaaaactttctttttcatgccacccacctgtaatgctttgccatctctcctttacttgcttgaacacaacccattaatccaggactagttagcctaagtcctgtatgcttttctcaaccattctcactgttacaaattttctcaaaagtgctatagcatatgccacttgcctgaggatttaataatatgctgtcttatcaattacttgttatatgtgagtgttttggctgtctaattaaactacaagcttgtatacagagaggttcacatcctataaaaataaattattagcagaatccttagcacttaacattatcacatccttttggtagtctgacaaaattctaataactgttttaacctcttaagctagtcaggtaagaagttattttatctttaatccctagtaccaaataattaccagttagttaaatagagttaacaatagagtcataaaataagaattactaattttaaatttcaaaatgtttagggaggactgattccttccataaatattttactaatctttttgtcctttgccaatcttttcggcctgtcattttaccagcagactttttctgcttttaagaaccctgtgccattgatctttctttttcagtccctagaatatacacatcattggacattgccctttgtcactggttttcaaaggtgatcctcaggtctacctccatcagaatcatgtagagtgcttattaaagtacagattattaatgcccctttccctgaactgtgctgtttttcatacatatttcactttgttctttttttttcttttgccagactgctctctcttctatcgtcaccaccactgaaatcctttctgttatctaaagctatccgccaattaattgtagctagaactgttttagtgtagtgggttaggaacataggctgtgagcacatactacctaatttggaatattggctccatcatgtttccaagatctcagagttagttacttaaaaatatttctgtgctttagtgtttctttgtataaaatggggataacaatgtatctcatagggctgttgtatgtgttatattaatacatgtgaattcctcagaataatgctagtacatagaaagcacttaataaatattaagcttattgttgtggtttcttccactttttaggtcttataaaattttctagtaaagtaacttacattcatacatcttcctattagattgcaagtttcttgaaggtagagccagccttattaagctgtgtagttttaaatggatttttacctataaaggatgttcataaatatttgagaatgaaatcataggaaaatggcaaactctaataagattgtttttcagagcctatttaatataaattatctaaagtaatttaatactgtctatattatatttcaggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggtaagaggccttggattattattatttgtagtatttgttatgctaaataattttgagtgctttctcatatcaaaaaatgcctgatacttgcctaaaaacagcttatttctaaattacaacttttttatggtttactttattccattttcagcactgttaatagtacatggcttgaaattgtttcatagacttaaaaagtgagttagaaaatagatgtaattagatctttcccacacaaacctaatctttaactttcattggagaataagtaaatttaaagaagaaaagatgtttgcctaattttcaagttgttgctgtgtttaaagtatctgttgatacaattttattagatatatgaaaactacattttctcattctctgacttttccacctttatctgaaagatgtttaaattcacatcactttctacctaatttaccacaaaaggttgacaaatcagagccttacaaaagagcagtgtcataagaaatagaaaaaaaatttttttttgcatcttgaaagtacttacatgtttattaaaaataacacaagaatttagaagggtagaagaaacgtcacctgtagtgaatgcagcactgttaccattttgctaattttcattccagtctttcacataaagctaacttgtactaaaacaaagaaaatgttttttaaaggctggtagtaggagaaaaaaatagggaatataaacgcgtgaacatgtcagtaaaaaattaaaaattagttctggcatttttaattatggaaaaacattctgaaacatttggaatatagtaatccattgacatcagttttgaaaaattgataaaggtattgcctctgtgggccctttttataagatttgtaaaaattgtcataagaagttgattatgaagctttttaaaggatgttttctttttgtattaaaggcaatttattctgagaaaaataaagattatatttttgttgctttcagcattggtcttataatgagtgataaactttctgatttttaggttttgcagcttttcaaagatatgatattctgtgggtgttttaatattttgtttagctttgaaaaaagatgtggtttaaattttaggtatgacttgttacatttaactcttaactagacaatccaaatattaattaaattttggtttaatttaatgtgtttagaaaatttatgataggttttctcaagtaatatactgtagagtatgacttactcacgagatattaaaatattcccaggaatttctgggtgaaaatgttccattccatgtcttcagataggaatgtggttgttgaatgacttgttttagtgtcatatttagtcaaaatttgacctgcatgttatggctcattgtggaatagaattataggcaattggagaaataaatgctgaatttctacatagaaatataaaagttacttcctgtctttgttcttgttgttttgtgtatgtgttacactcagtcctaaaagtctagctttaattcacaagtctctaaggactttttccatagcaatgctatcaaattacctaggaattaagaatatacatatatgttcttgagcatatagatagcatttttactaaaaagtgaatgtatcttttaaaattggcatattttaagtaattatgtggcttatatttgtggctacctaatcttttgacctttattcctaaattgtaattttaaaaacagccattgaatttgttaatgggctccttcccatcattagtgacattactgaagtttgtgtttttgtaattgctgtacttctgtaaaaatggtaatatcataaatgttgcttatttcattctaagcagggcatcagaaagtaaactgcttttaaaagtataatgtttttcataaggaattatgatttataaagtttaacttagatacatggatctggggcaaacatgcagaagtctgggtcatctgtttctttatagggaacaagaaaataaaggttagtaaaaataacatcataataataaggatggctgttgtttgagcccatgaatcataatactatacattgttctgtccgtgtatactttaattatactatcttatatccttacagtaacccaatgaaataggtattttccccatgctactgaagaaggaactgacactgtagaaaaattaggtaatttactgaagatcatgcttctaggttggcagagtcagaatttgaaatgtaagtcttggtcgtttccactgtagtctccccacaatctagaaaaatgggtaccaccccccatagattttgattctctggtaggtccagggtctgtacttttaaagagcagcctgtgttagtttatgtgcaactgcagttgaaagccattgcacaagattgcgggggaggattgggtttaacagtttaattataatataattcacataccatacaatatacacattaaaaataaacaattcagtggtttttagaatattcagatttatgtaaccatcagagataatgttagaacattttcaatacctccaaaagaaactctgaacccttaagcaatcactcctaatttctcctaactcattaaccctaggcaaacactaatctactttctgtctctatagattagtgttttctggatgtttcctataaatagaatcatataatatgtggtctcttatgacaggtttcttttaatttgcataatattttcaagtctcatcaaggttgtagcatgtatcagtacttcattcctttttattgctgaataatatttcattatatgagtataccacattttatttatgcatttatcagttgtcagacatttgggttgtttttgctttctgactgttatgagtatagtttctgtatttgtgtacaagtttttgtgtggacatttgttttcacttctcttgagtatatacctagtagaattgttgagtcatatggtaactctatgtttaacctttttgagggattactagactgttttccaaagggactgcaatattttacattcctaccagcagtgtttgagggttccaatttctctgcatcctcagtaaccttgttattatccgtcttttcttattataaccattctatcgtgtgaattggtatctcattgtagttttgttttgcagttccctgatcactatatatttgtttttaattcttgagagctatcttttattgtaacggaaagacagaaatagttattttctgtgatgtagatcttgctttaatgggtttttaatttaaaagaagttctgagctccttggagaatgtttataaaataagacctgtgctcaatgatcaagtaaaatggaaatttgacattttttaaagtgttaaacacctttaatgtaatttgacttactgcagaaacccataacagggaatttttaattcaaaatatatgctaattataattttgttaaactttcatttatgcatattagagctacattatttataaatatatattaaatttatattatattagatgcttattcttcttgtttgaataaatatatcactttaaatcatgccatccagtttttattcagcagtatatttgaggaatataagtttttagctgggcactgtgactcacacctcaaatctcaactactgggaagactgaggcaggaggatccttgagcccaggagttggctgggcagtcagctatgattgcgccaccggacttcagcctgtgcaacagagctagaccctatctctaaaaaataaaataatttttttaaaattaggagttttcgaaatagagcctactatttagtttaaataatataattggaatttaaccacgacacaaggttgggctatgctgttgccttgataggaaaaaaatattagaacatttatccttttaagcattaatgacatttttattaatgtaatgtgatttgataccagtgatacatattcacatgggtaaagattggcagaaaacaataaaaagatactggaacagactgttcagagccagagatctatcagaaagtagctaagaaaacttttcatttagtaatgttcatttacttttctccttttgtatgttaaggcatagacaaataaagtaagtgtcccttctttttgggttaagtagacaaattgaaaccttagtcattgctttcttttatagatcagtgttccattcttcctgtcattccttctttctccatttctaatcttgaaaaagactcttcactctatacaaagacagtcaagaacccatgttttcagagggaaaacaggaaataagcacttttttacctcctttcccaactgattggttcctttgagtttcttgtaaaagatgtgcttttgtatattctctgtttatgagtggattagagcaggggccaccagatagacagtttgtataacgaatctatttattcaggcaactctagacagtgaagttttaaaggattttatttttctgggaaggaaatcgttgctcattgaaaccaggtataaacttcattttgtattttgctaatattcctgtgatttcttttctctctgaattgtgggtttaggatttcttctctttctttaaagtttcccttatttattcttctttataaaaacagaagttggagtatttttaaaaatgtgttttacctacattgtaggttcaataaaatgctacatatttatgtagtatataatttcatgtgggtctagttgtcaaaataaccttttttgcttaggaaaattatctaatatattaaagtatatgctttttgagaacccatatcattttcttcatttacaaagcaattctcacatcattcatatgtatgagaaataataatgagaaataataattgtacctatttgtggtttacaatgtgatgtttccatacatgtatacaatgtgtgataatgaaatcatggtaattagcacatccgtcacctcaaacatttatcattgcttttcactggacacattcaaaatcctccctactagctatttgaaaatatacaataaattgtttgctaaagtcacccaacagtgttacagaacagtagaatttagaacagatagaattcctcctatctagctgtagttttgtgtccattaaccaacctctccccatcccgctgctccccaacccccgccacccttctcagcctctagtaaccactattctactcgctacttctttgagatcaacttttttagcatgagagaacatgcagtatttatatttctgtgcctggctcatttcacttaacataatgtccttcaggctcattcatgttgctgtgaatgacagaattttattctttttttggccgaatagcatttcattgtgtatatataccacattttctttcttcatctgttgttagaggttgattccatatcttgactattgtgaatagtgttgtaataaataagagagtgaaggtatctctttgatatgctgatttcctttcctttggatatatacccagtagtcagattatttggtcatgtggtaggtttttgtttagtgttttgagtaaccttcatactgttttccatagtggctgtaccaatttatggtacacccaccaacagtgtatgagagttcttctttttctgcattctcaccagtatctatctgtttttgttgttgttgttgtgatgatgttttttttttttttgtcattttgatgatagccattccaatagggttgagataccttctcattgtactttcgattttcattcccctgatgattagtgatgttgagcattttttcgtataccttttggccatttgtatgtcttgagaaatgtatacttagattgtttgcccatttttaaatcacataatgatgattattgttttgctgttgagttcttgtatattaatctattgtcagatgagtagtttgcatatattttctttcattctgcaggttgtctcttcagtctttgtttcctttgctctgcagaagtttttagtttgaaataattccatttgtctatttttgcttgggtttgccctacttttgaggttttacccataaaatctttgcccagaccattgtcctgaagtgtttcccctatgtttcttgtagtagttttatatttttggttcttgacatttaagtcttcaattcattctgagttagttttttgtatatagtgagagataggggtctagtttcattcttctgcatatatatatatccagctttctcagtaccatttcttgaagggtctgtcctttcttcaatgtatattgttggctcctttatcaagtatcagttggctgtaaatatgtggatttatttctgggttctctactctattcaattgatctattgtcttgtttttatgccagtactgtgcattttggttactctaactttgtgtatactttgaggtcaggtagtgtgatgcctccaattttgtcctttttgcccagtattgctttggctatttagagtcttctatggttccacatgaactttaggatttttttttcttttaagaatgtcattggcattttgatagagattgcattgaatctgtagatcactttgggtagtatggatattgtaacaatattaatccttttaattcatgagcatggaatgtctttccattttttggtccctttgaatttctttcattgttttacagttttcatcatagagctttttcacctccttaaatttacatttaagaatcagcattttaaaaattacctatttgactcatcaacatttattgaaagcaaaatcagtttcttactattgtgcaatatggaggtgttatatttgattataagtcaaatgatgtacatataaccgacacatacatgtgtatataattaatatctatatataaaagcatattgaacagagtcagcaactttttcaaaaagttgaccttaagagatttaatttaactcctattatgtaatttttctgtgaattttttagacattaagtggtaggctttcaataaatgtggcttgaaggaaatttaataaagctcagtactattaacctatttttattttatattttagtattatagtattatggtattattactataactttataatatataaaaagtatagtattttcaagattttagtattatatactttattttagtacagcattataatatttcagtaatattttcagtattaactaaaattgtaacttgtgatcactaaaattcttgaaattctctcaggactgccaggagtgatacaattgcttatatggtccaggtaacattatttaataatctcatttgaatgtttgtacaaatgctaagtaacttactttagcaggaatgataaatcagtaaagggaattcatagttgttaataaataacttcttttgactgggaaccagcaagaaacattagaaacctacaaatgaactctttacttattactgttaggaaattgtgattttcactaaacaacaaaaacccagagaagttattattgctaaaggaggcaaaaaaacaacaacacagaatagcactttgggaggccaaggcaggtggattacttgagcccaggagtttgaaaccagcctgggcaacatggcaaaaccccgtctccacaaaaaattagctgggcatgctggcacacacccacagtcccagctactcatgaggttgaggtgggagagtcacctgagtccggtaggttgaggctgcagtgagctgtgatctcgccactgtagtccagcctgggtggcagagaccctgtctcaggagaaaaaaaaatggaacacagaaaaatagtacttgaactgttttagaaggacttgataggatcaaaggagacagtttactttccatgtggctgaggtatgggaaagagagggaggcagacattgtaccgtaaagacagcatgttacaaaatcagaggagcattgtcacttgtccatgtcccttagttgcagaaaacttgcttagaagagcccctgaagtcgtctttgcaatgaaaaggaataattaagcttttaagacaagtataaataatgttctggtataaattctgacctctctaaatctgttcaaacttgtgggacaagtgtttccaactctttttaattatatagttttacgaatgtattttaataagatttgctctgatttttatagagctgaactctgaatatttgaaaaatatccctataaagaacaagagttattttagaatataagaatcctaaatgtgagtcaaataagagtaaaggaaagtttataaccgtgaaacaaacctaaattactcatttaccaatctttgattgcctactaggtacattttcaaagggcctttttatatatttctggatttaatttactaaaattttgttaaggattttttttgtctgtattcatcatagatattgatctgtaattttattttcttttttaaaaattttgatcatggtttggtatcagggtaatactgtcctcatatcatagaatgagttgagacatgtttcttcctcttttatattctagaagggtttgtgcagaattagtattatttcctccttaaatgttcggtagaatttatcagccatacagtctgggactagggttttttttgtgtgtatggacaagttttgaatttcgaattcagtttatttaatagacacatagttattcaggttttctatttgttctctattgaaattttgtagtttgatctgtcagggcgtttgtctattttgtacagtttgttgattttgttggcttaaagttcacatttttattatgcttttaatgttccatatatatatatacactatatatatatatagtggtgttcccctttcattcttgaaattggtaatttgggccttctctctttgcttatcagtttggcttgatgtgtatcaattttactgatcttttaaaaattcttttgtttgtgtgttttctttgtttctggtctttattttcaaattccttattactttgggtttaatacgcttttctttgttttcttaagttggtcaattagattgatttcaggcctttattctttcattatataactatttcatagctagaaatttccctcaaagtacttttttagcagcacacaaattttggcaggttatcttttcattattcaaaatattttctaaatatccctttttatatcttctctgatccatggattattaagaagttaattgttcagtttccaaatatatgagagagattttcagattttttttttgctttgatttataaaatagggcttgtcttgataagtgttctaaatgcagttgaaaagactatattctgttgttttttggaggattgtaaaaatatcagcaaggtcaaggtggttgataatgttttacattcaacagtgtcatacagtgcttgcattgtatacctttttctatctttttaaaatgggttttgtaaacagcatatagttaggtcttgtgtttctatcctgcctgacagccacttgttccttttttcccttcctctcttttcttatggattaagtattttttaaataaaagtttcatttatctcaacttttggcatattagttacacatctttgtggcgttttttttagtgtttcctctagtgtttacaatacattatcagaacttgacacattttactttgaaataatattgtattattttgcatatatcctaagaacttcacaacagaacacctttatttccctccttccattcttcgtacaattattgtcaatacattttacttcttcacattatcataagtcccataataatacattgatactattttgctttaaggtttaaattatgtttttaaacaatttttcaaaattttttattttgaacaaattctagacatacagaaaagtttcaaaaccattttggaagatttccatatacccttcactcagcttcttgatattaattaacatcctatataaccattgtatagtgatcagaaccaagaaattaacagtgatacaatacaataaactaaactacaaattttagttaatttcatcagtttttccactaacgtccattttctgttctagaatcccatgttactttttttttttttttgagatggagtctcgctctgtcgcccaggctggagtgcagtggcgcagtcttggctcactgcaagctccgccttctgggttcacgccattctcctgcctcagtctccccagtagctgggactacaggtgcctgtgaccacgcccggctaattttttgtgtttttagtaaagacggggtttcaccgtgtctcgatctcctgacctcgtgatctgcctgcctcggcctcccaaagtgctgggattacaggcgtgagccactgcgcccggcctatgttacatttttaatagtcatgtgtccatagtatcctctgatctttgacagtctgaaagcaaagactgaaaggctttccttttctttcatggctttgatacttttgcagagtactcttcaaatgttttatagcatatcactcatttttcctttgtttaatttttttttcacgactagtttgagtttggtttttttgtcaaggatgccacagtggtgattgtgttgccttttccagtgaattatatcaattcatattgataagtctcattactggtgattttgacctcgaccagttggttaatgcttctccacagcttctccacagcttctgctgtgcttctccactttaaagttaatatttttttctttttaatttatcttgggagatgtttttagactatgcagataccttgtttttccctaatcttttgctcactaattttagcactcgttgctggatcttctcttcttcttttttttttgtgagatggagttttgctcttgttgccaaggctggagtgcaatggcgcagtcttggctcattgcaacctctgcctcacgggttcaagtgattctcctgcttcagcctcccaagtagctggaattacaggtgtacactaccatacccggctaatttttgtatttttagtagagacggggtttcaccatgttagccaggctggtctcaaattctgtcctcaggtgatccgcctgcctcggcctctcaaagtgttgggattacaggcgtgagctaccacacccagcctcaaatcattttcttttgcccaaagaacgtccgttaacatattgtagtacaggtctgctcaaaatgaattcactcagctttgtttattttaaaatctttattttgcctttttttttttttgaggcaggatctcactctgttacccaggcttgagtgcagtggtgtgattatggctcactgcagcctcgacctcctgggctctagtgatccttcctcctcagcctcccgagtcgctgggactacaggtgtgtgcaccacacccagctagtttttgtatcttttgtagaggcagggtcttaccatattgcccagagtggtctttaaactcctgggctcaagcaatccatccacctcagcctcccagaatgttgggattaagggtatgagccactacaccttgctgccttcgtttttgaaagctgtttttcctaatatagcaatgctagtttgaaagtttccttttttcccccctcagtattttagagacacctctgcattttcttatagcttgcctagtttttgacaagaagtctgctgttattctgatcttggagtttataagcctcttggatctgtgggtttatggttttcatcaaaattagaaaaattttggccattatttcttgtaacttttcccttacttggtcattttttttctattatctgagtctcttattacatgtatattagactttacattttaagtcattgatgctctgtttgtccatgtgtgtccatgtatattttagataattttattgctatttttttgttgttgctgtatatcatttcttcttcagtgtctaaatcttactgttctatacaatgaagttttcataccaggtattttatttctcacctctatacattccattgggtgtcatttttattcaagttttctttaccttgaacatatggagctcattgtttaacagctttttcactgtccttgtcttatagtttcctcttttatttttgtttttgttgctacagaatgatttttctcctggttgtgggtcatattttcctgcttctttgcatgtctggtaatttttttttgagacagagttttgctcttgttgcccaggctggagtgcaatggtgtgatctcggcccaccgcagtctctgccttctgggttcaagcgattctcctgcctcccgagtagctgagattagaagcatgcaccaccacacccggctaattttgtgtttttagtagagatggggtttctccatgttggtcaggctggtctcaaactcccaacctcaggtgatccgcccgcctcagcctcccaaagtgctgggattacaggcgtgagccaccgtacccatcctgcatgtttagtaatttttaattggatgtgagcttcataacattttcacattgttgagtcttggattttgttgtattcttttaatagtgctggactttgttctggcatacagttaaatttttctgtagtcagtttaatcctttcgtggcttgcttttaagctttgttatggtagttttagtagccttttgtctacatctaatttaaccccactactaaggtaataaattttgatgactccctgataaactatatattatgaggtctttttgtggctggtaggaattcacactattcacaaccttgtgtgactgctgggaattgtttgggttgctgctgctaggtctttgcctagcctttggtagtctgtttgtacctaatgcagataagaatttaggcaaacactgcataagactttcttgcagattgcacaaatctatttgctgctctcttctgtctccagttctgcctcccaaattctaaccatcttggctttcctagactaaaatcgtttgccctaacttagtaataactattggcccttgttctatattccttccctgctttttctgtgacctggaacctgcctccaggcagtaacctggggcaatcatgggacttctgttgttttcctgtgatacaagggaatacagtcatatatggctgttgtctgcagtctgcaaaccattttctcaaacattttgttcattttctagttgcatcatggtggtaaatagaagacagtctagtaattcttgattggctagtataaatagctaatactgtaactcctgtggattccattatcctctgaaaagtgttacattttgttctgctaggcggttaaattgctgttgagtcaccttgaccgtagagacttagatttagctcttgtaagggtgatgctatttggttatagccttaaacctagggtaaattccttagttttgagatgtgatctttactctcctatgttatagcccttttggaattttgtttattactctccagcaacttgacaagactgaaaatccaaactcttaaagaccacagttggcaactgttgaaatctctgctcagctcctttagccttctagctgtggttctccccttgggctccttgcagtctcctctcccacatgtattttcggagtcagcaagaatttgaggagtgtgtatttgaagattttagggctctgctctttgtgatttcctcctttacagagtatccaaccttgaattccagtcactcttataaccctgaactctgtcctttggcttcttaggcagtaggactctggccttcgacttgagatttacttttcacctgcagattttttagttacttcatggtaaaagctttataaaaaggcatttatgaaagtaaatctcatgtgattgctgtattagttatctattgttgtgtaacaaattactctaaaagataactcttataacaacaatcatttgttatcttatagtttctttgttttgggtatcaggcacaacttaactggaccttctgatttagtgtctctcacaaggtttttcagttatagtgttagccagggcttgggaagactcatctgggaaaggatacacatcccaactcatgtagtttttgttaggacttagttcctagcaggttgctggagagagggcttcaatttcttgctgttggctggagactgctcttagttccttttcacatgggtcttttcaacatggcagcttgccttatcaaagcgtgtaagctaagacatcaataaagtgctagcaaggtggaagtcagaatcttttgtaactgaatcacaaatgtgacatcccatcacccttgccatattctgttggtaagaagcaagtcactaagtttagcccacactcaaggggaggggtaattatataacgtatacaattattcatgaggcagggccattgggggttatcttagaagtctgcctattacagttctcttcttttaagggtaaattccctctagttttaactttggtctccctgtatgcctttaagtattttatccacagttttaaattatcaacacgacttcaccacccttagccagagctcagtgtttgcagatgttaaatccagctttctcttaggacaaaaatgttctaccatgataacattttcttcatctttttcccccatagttagccactaaatattttacgtagatgtctcactgatatcttaaattcttcatgaccaaactgtaacttcagctcaacttttcttccttgtggattccattcctctctcataattgcatcttatcttctctatcaacccaagctcagtatcttcggatcagagaattttgttgttgttgttctgattctagtcaaggtgtagcctactcactagacaggtactgggccaccaactgtttgttactagtttgcccaaattaagaacagaaattgaaagtaagcatttagaatcttacataacaatttgacattgctgagacatccaagtgtgtgagtttgtgttttaaatattcatctacaaccagttgggaacagcaaaagacaaagaaccaggccttcaccatctgtagtctgaaaagcgttgttctaccccattcctgtcacttttttttttttttttttgagatggtctcactctgtcgcctaggctggagtgcagtggcgcagtctctgctcactgcaagctccgcctcccgggttcatgccattctcctgcctcagcctcccgagtagctgggactacaggcgcccaccaccatgcccggctaattttttgtgtttttagtagagacggggtttcaccgtgttagccaggatggtctcgatctcctgacctcgtgatctgcccacctcggcctcccaaagtgtcctgtcactttttcttctctcttgatagtaggcctgttgttcactcacttacttccactgccattgaggtagtatagaccttcacactatttctcgtgggctaattgcagtagcttcaacctaggctctgtgttttttatttgtctttctcaagtccatccattcaaacctagagaaaacagactttttagaacagtactctgattatcatggtttgcttcaaaactttaaattgtgctttattatctggtcaaaatggtctagattccttaggttgatatttaagaccctagatttctcactttgttcccctcctctccttattgcttattttccctcccaatcccctgggtctcagttcaaatatgcttttttttttcaccccaacttcccccaacagtcagttccaacttcctttccttatgtgttttcttgttgttgtttacagcagttatcacattctgacactttatttccttattttatgattccccactccatgcacactacagtgtaagtttcatgtggatggaaacttgctttgtttcctgcactgctgaatctttcatgtagatggaaacttgtttcatttcctgcactgttgaatctctagtaggtgcacagtaagtttttctttcatgaatgagtcagtgaaatgggtcaccaccttaaagataaagaactttgtgaatggccatgaagatccaaaagaatggctctttaatggtgaaattttataagcaagcagtgaaggacctatttggagcagagactctctagcctccctcaaatcacattatagtctttttacgaattgtaagtttcatgaatacaaacatttagtatattgtagtctgtttcttcagtgcccagtattgtgtctggaaaaagagaatgtacatatcaataattttttgtctgaatgaatgaattaatgcagtaagtgttcctaccaagctcccagctgtggcttctactcctggtgactctgcatcacatttctctccagttctggggcagaggtttgtccttagatctcaaaaggatgtaagaaaagttgataatcttcactttgttcagcctttttcttgtgaggacaggaacgatgacttcaaaattttttatgtgttagattggaaactggaagtcggctgtaagtttttatagaagatttttactaaattgaggtaattccccactgtttctaaattggtgacagtttttaacatgaatgcattttgaatttgttaaaagttttccttgtatgaatcatcaaatgatcttacttctttagactgttgatatggtaaataacattgattgattttcaaatattaaacccaccttgcatatctggaattaatcctaatcattctcggtcatgatgtataatcccttttatattgttgaattcagttttcttatttatttatttatttatttatttatttttttaagttttagggtacatgtgcacattgtgcaggttagttacatatgtatacatgtgccatgctggtgcgctgcacccactaacttgtcatctagcattaggtatatctcccgatgctatccctcccccctccccccaccccacaacagtccccagagtgtgatgttccccttcctgtgtccatgtgatctcattgttcagttcccacctatgagtgagaatatgcggtgtttggttttttgttcttgagatagtttactgagaatgatgatttccaatttcatccatgtccctacaaaggacatgaactcatcattttttatggctgcatagtattccatggtgtatatgtgccacattttcttaatccagtctatcattgttggacatttggattggttccaagtctttgctattgtgaataatgccgcaataaacatacgcgtgcatgtgtctttatagcagcatgatttatagtcctttgggtatatacccagtaacgggatggctgggtcaaatggtatttccagttctagatccctgaggaatcgccacactgacttccacaatggttgaactagtttacagtcccaccaacagtgtaaaagtgttcttatttttccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaattttctaatattttgttgagaatttttgtgtcttaagttcctgacatagaaatctcatgagagacattgatttatagttttcttttttgtactgtctttgattttaatatcaaggtaatacctcataaaatgagtttgaaattgtttcctctattttttggaagacattgcataaaatcggtgttaattcatttctaagcatttggtaaaagtctgcagtgaagccatctggacctagaatttcttttttgaaaaacttcttagttacaaatatttatttaatggcagtagtactattcaggttttctgtttcatcttgattgagttttggtagtttgtggctttgaaataattaggttatatcttataagtttttgaatttatgattttaattacaaagatttttgtaatatgtcctttttatctttttaaacaccataggatcagtattccttttttttattgctaatatttgaaatatgtgccttctcccttttttatctttgtaagtcatggcagagggctataaacattgatttttttccaccaaaaaactatcttatatttacattattctcttccttttttcatttttattgatttatactcttatttttattaccttccttttgcttgcttggacttatttttatctttttctgttttcttgagatggagacttagattactgatttgagatcctgcctcttttgtaaggtaaaaatttagtgctataaacttccctcttagcactagcttagctatgtcccataagtttttttattataaaatatgcataacatataatttatcattttagccatttttacttgtagagttcactggcattaagcacattgacattgctgtgcaacgattaccattattcatctccagaacattttcgtcatctgagactgaaactctgtacctgctgaacaataagtcctcattcccctctctcctcagcacctactaaccacggttctgctttctgtctctatgaatttgactattccaggtacctcatataagagggatcataaaattgtttttttgtgtgtggcttatttcacttggtttataatgttttccaggtttatccatgtttagcacctatcagaaatgtattcaagtctgtataatactccgttatataaacataccacattttggttattcattcgttaatagacacttgggttgtttccacattttgattattgtaaataatgctgccatgaacattggtgtacaattacctgtttgtgtccctgctttcagttcttttcgatatataccttgaagttgaattgctggattatatggtaattttatgtttaattttttgaagaaccactgtacagtttttcacagcaactgtaccatttcccaacagcaatgcacaaaggttccgatttctccacatcctcactagtacttgttattttctattttttgataatagccatcccagtgggtatgaagtggtatcttgttgtgatttgcatttccctagtgattactgatgttgagcgtcttttcatgtgtttattgcccacttgtatatcgttagagaaatatctattgaagtccattgcccattttaaaattggcttctttgaggttttttgtggtggtcttgttttattgtagttctttatatatttttggatattaatccattatgagatatatgatttgcatatattttctcccactatataggttgccttttcactcttcatagtatcctctgatgcactaaagttttaaattttgataaaatctaacatcgatttttctttttttattatgtatagcttaaaaatgtgttccacacccattcttcagagttctgtagtttgtgcttttctgtatctccaacctctgccttaaaaaataataataaatagaaaaatcttgacaagaccaattaaaaatgaaaaggttttttaaagctcagtaacactgcaagtaatttaaattgccaatacagagctttcaaccagaatggaaagggagaaatataccttattttctgttcttttagagtcctagtaaattgagaagcagtttttatttgtaaatgtcaatttatgcatttatataacatcagaacacatgcatatttgaaagcatatatgagatttcatatttgaaagctggatgtagctcacaatcaacttgaacaccttccaaaggagactgaaaacagtacacagataaccaactttggcaacacagtgaactgctagacctcctagatactataggcatgagaggaaaaagaagatactgatagctattaatagctaactggatattaagaagattatcttgatccattttggtagtgaaaattcaagattaaaattcacaattatcaaagttgtaaaacttttaagataatattttaaaatcacttttccatttccatttatttccatgtcttgaggtagattatgaccctcaaactgaactcaaggtgtatctgatattattgtgctgaatttggttaacaaaatcagtacttcaaattttggaatatatgtaaacatttgtggctgaattggttacttaaagaggttggaaaagtaatcattcagaaacaacattttaattttatcagatgtcatcttgaagtagtggtttcagatttgtggttgacttagtttttgagaaaatacaattgtgatacagaaaaaagaagtttttattttctggcaatgcaagtatgttcactaaatgatttaaaattttaaaataaaagttgcctatctaataaggttatgtttcccgttgtttgtgttcagaaattatagatttattttcttgcttagaagtattatctagtatgttctttaataatgcttattgaatttttatgttggtcaatttacaggtgaattatgtaacctcattacgctggatgtagctcacaatcaacttgaacaccttccaaaggagattggaaactgtacacagataaccaaccttgacttgcagcacaatgaactgctagacctcccagatactataggtatgagaggagaaaggagatattgatagctgttaatagctaactggatattaataggactatttttgatccatttggtaatgaaaattcaggagtaaaattcacaattaccaaagttgtaaaacttttaagataatattttaaaatcatttttcatttccttttcttggcaaagaaaataggttttaggaaatgagcccaatgggattataaaagagagagaatattgagttacatgtatatatattctgtcatagtttgaattgcaaaatgggtggctttttctatttctgcttatttctgagttgcatgttattatactgggtgtggtcctttctttgctaaagtattccatactgaaaaataaaaccattgctatttagttttttaaacatggccaatatactttaaagtttgtttatctgtaatactaaggggataagcaaggagatgacttgaagttcaaaatatgttttatagacttagccaaattgcaaaaaattgaattgagctgtgatatgttttgtgtttatgtagtcttatttttccgattgcccataaatttataccagtaaagtgaattttaaaaattctgatgcctttttagttattaatgtggtataaggatactataatgtttatttagaaaaattacatctctacttaatttacataatttcagtcatgaatatttagtattttaattttttaatttttattttttttgagacagagtttcactctgcctctcaggctggagtgcagtggcgtgatctttgctcactgcagcctccgcctcctgggttcatgcgattctcctgcttcagcctcctgagtagctgggactacaggcgtccaccaccacgcctggctaatttttttctatttttaatagagatgaggtttcactatgttggccaggctggtcttgaactcctgacctcaggtgatctgcctgcctctgcctcccaaattgctgggattacaggccttagccaccgtgcttggtccagtcatgaatattttagaggcatgattactaaatcatttgaggcctgtgatgatgttatctttctccagaagagtttttgtctgcctctgttgggtacctagtagagaggggatcacttcaatcaattcgtgttcaaggcttgagatgtgtgtggtcccccaagtgattaaaagttttgctgcaggctaactggatgactattttatttccagttcacccttactggtagggtgcagctctagagggtcccagttgaggttgatgactagagtccccacccttggcaggccctagattttgactcttgctggaaaaataacttagccttttagctgcatcttccagttagggctgtgttcttaggacagaattatctccattgttttgcttgtatctgggttcccagcttgtttctgttctggtgcttagtcattacgttgttaactctctgattttggttttggaagatgtttttatttatttatttttttattgggagaatttatttgaattacctaccattacttgaaacaaagcagttgttagggaatttcttagcagggttgagtagattgtcttaggttatacaggacaattatttacagaaaagcaagctgagacatggatgtaataaatagccgttagaatctatgtttccctgatttttggcccatgacactatcgtattactatttgtagtggaaagagattacatattctagttaactggtttatggtttagatgtccctctgaaaggcaagattgtctccaacacataatgaattattctattaatatccaaaataaatattctactaaatgtcctgtataaaataagagaatcagatttctggttcaagataataaggaccaagcacaattatttcatgcttttttttctctttaaaatctattgaaatggccaagatgaacaaggagatgtgaccttaggagaaaaaaaacataggatatttaaactgcatgtttaaaacatgatgaggctgatacaaaaagggaacaaagaataaaatacaattcttagagatatgtttgccaaatcaaatttaatggaaaattccatataaccaaatgaacacagccagagaccaaagtgatgatctctaggataaattaaaagtcccctagaatctagatcaaaaagaaatgtatacaaaagaagtgaaaagttaaaaagtcatggcagataggactagacgttccagaaggccaaatagtggtgatagttataaaatataattttataatgtttccctgaacttgataaaaacccggataataagaccaaaattgcttaccaagaagaaataaattaaaaagttacattctggtggtagttttaaatattagatgtatttgttttgaataaataataaattcacatgtaatgttatacaacctatctttacctggtttttggtttcagggtaatgctggctacgtatgttcaatttttggaatagtttgtatgaaattgcattatttcttcctttaatatttgataaaattcaccagtgaagccatccaggacaggacttttctttatgggaatttgttttaaagcaatttcaattactttaataaatatagggctattcaggttatcactttcttcttcagcaaacttggtcatatgggtctttcaaggaatatatttgttttatttcaattatcacatttaaaagcattaagttgttcataacattcttattattttaatatctgtagaatctatagtaatgccacctctctaattcctgatatcaagaatttgtatgttttctctttttcttaatcattctggttagaagtatatcaattgtgttgatcctctcttagttttattgattttccctattgtttctctggtttttatttcattgatttccattttgaactttatttcaccagcttactttgagttttatttgttctttttctagtttcttatggtggcagcttgaggtcattaatttgagacctttctattattctcataaagacagttagcactgtaaatttccccttaagtactgcttcagcagcatcccacaaattctgatatgttgtattttccttttaaaagttttttctaatttacccttttgtttcttctgtgatctatggctttattaggttggtacaaaagcaatcgcggtttttgctattacttttaaaggcaaaaactgagactacttttgcaccaacctgatagaagaatgttattttgttcccaaaagcttgacaattttccatgatatattattgacttctaatttacctccattgtggtcaagaacattcctgataggacttgaattctttcatcatggtaaaagtattccatgtgcagtttaatgtgtattctacttttgttgggtggagtgatccataaatatgaatcatggtacagatgaggcaatcaatgagtttattctactttctgccgtttctggaggagtctctttttcttcttatttttgttaactgcattgtcagcataggtaacataccttgttgtactaattcccatttttgttttagtcttaatgtttatcagcagtcctgttgccatagttgcctcagtcatttcttggttggctgaagtcaatctggttggtagtcatttgctcaaaaatggttcatgggagcagtattctcctatagttcttgcatgtgtgtagcttttataatttaagaacaatttagatagatacaaaataattggatcaaactgcctttccttgaggatctcagtagaacttgttaacaggtagttctaccttcttctggaattgaatgtacaaaaataagaggccagtccattttcttttttccccatgataagtgacttagtcattttgcttggccagccaaagtattatttctagatttctgaaattttaagaactatattttatttatcagtgtttatttttcaggatcatattttcctagtatactctgggccaattcaacatataggtttaagttttatttcagtacagtgttcttcagtatattcagtatatattcagggtatatatgctttctgtttgccatatatattcagtgtatattcagtatagtgttcagtatagtaaatatgtcacacagtgacatatttagtttgtgttgtatgtttttacattaaaatatgtatctgtaagtttggttagtatgaacaacaaactaattggaatggtaaagaagaaaagaaagaataatgcataatctcatcataatcactttcagtggaatgtcacataaaagcactttcaaaaaatgactttataagatccaaattcttagtcttagaaaaacaaaatgttcaagggctgaggaaggcgagcgcatggcgcgggactggcaggcagctccacctgcagccctggtgcgggatccactaggtgaagccagctgggctcctgagtctggtggggacgtggagagtctttatgtctagctcagggattgtaaatacaccaatcagcaccctgtgtttagctcaaggtttgtgagtgcaccaatggacactctgtatctaggtgctctggtggggacgtggagaacctttatgtctagctcagggattgtaaatacaccaatcagcaccctgtgtttagctcaaggtttgtgagtgcaccaatcaacactctgtatctagctgctctggtggggccttggagaacctgtgtgtcgaaactctgtatctaactaatctgatggggacgtggagaacctttgtatctagctcagggattgtaaacgcaccaatcagcgccctgacaaaacaggccactcggctctaccaatcagcaggacgtgggtggggccagataagagaataaaagcaggctgccggagccagcattggcaacccactcgggtccccttccacactgtggaagctttgttctttcgctctttgcaataaatcttgctactgctcaaaaaaaacaaaaacaaaaaacaaaaaaaaacacaacaaaatgttgctttactctactgcaaatcagacaggagaaccaaaatttaagatacttgaaatgttatgaagtgattttcttatccctctcattgatgtttagtcactatgtatatcttaggatattaaacatgctagacattttattgtttcttgaacatatcaggtaaattctagccttgagatctttgtgcttcccatctctctgtttagaactcttttctcctaaatatctgtgtaactttgcctgctccttcaactgatcagatagatatatatagcatgattttcattcggccttcttctctgtctcaaatagtctaacaatattttattatttaatatttttatatatgtgtctgtatctcaaacttgttaaataacagtcaaaggggcatgcgattaaagtactgaaatgaataatcctggtaaacagagaaagcataggtggtgatatatgatacagtcttctagtaagtaggattagtgtcctattggaggtaattcttctgtgttttaagtgtgtttactaatatgaaaacatttgattttattattaatctcttgtagtttagatgttatcctagaataacacatatgcctcacctctagcttattctatagggccagattacagtattacaaattggaaatcaatgagaactgaaacattaacaacaagaaaattttaaataacattgcatttacttttatatgctttgatggttgtcaccaagtatagtacagctgttactctgagtaaatggcaaagtaaattagtaatatttattgaaactttttatgatattgtagtcatttatcgattaccatgtttattaaaataattactttatctttctccatcctttccagtcctagtattttgatgatgtagcagaagattgaggtttggtgggaaactttgacgtttgggtcttggtctgttaaaaatttcaacagttttaattgacctttgagattttcactctcatttattgaagatgaagaatttaccctaagtagtggaaacttaattgaattatggttctcctgatacttctccttttttaaatcctactctagttctgagaaagtataacttaaaatgaaaaacaaacagaaagcccaacacctgttctgcagagttgatgctagtctggaagcagctgcccactctcttttccttggactaaagaatcttgccctaaacttgtaactgaaaatcaaatcttgtattgtcttaaaatcacttcccagaaatcactgtatttacttgccttttcctttttttcttttttcttataagtagaccagaatgttttttacttttttctttatttaacatgaacattcctggagtaactatcactcccctgtgataattactgccatttacttccaggctgagaagctagtatcgctgacaactcataggatgtgaggaagagacagaaggaaatgggttggggattaccaagttgcagttaagtaagagagtgcttaaatacatatttatagtttctctgatttaactgttagtctgccttgttgaataaaaaaagtattattttatatgaatattttctcattcagaaattagctatgaacagaagaaaatattaagctttattccaacagttattttgttttaaagtatgaacctgatgttttttaaagccttctggtacctctggtagttttatgtaatccagggaagaaacagtccgaagtaggaaaaaatactttactttgtatttcttctcaaaatgagattaggagagaactgtgccacaaaaccttgccttcaaggctggagtgcagaacaattcacagaagcctttttgttgcactgggctctgaagaaatgttacattaattatggttatatcaacaagtagcattttagtcattttagtaattgggttttaggtaattacagtgcagcgtatgtataacaactttactagttttctttttaatggtggtgttctttgggtttttaacattcaggaatttctgtgttgcttacttttcagtttgctttcagtttaatgtttctgaaaaaataatggtacctttgacatttcatccttccaaccctgagtctttcctactattttttttgctactttgttaaaataagattatgatcatttaaattagtcttactcgaaagttatactaaattaaactaaagttgctggttatatttgctgaaattgaaagaatctaattttaattcatagccatttgatttcaccatattttaaaaatctgacagcgtaagagaaagcaagctgtcaaagtggagcacagaacaatttgtagacaaagttaagcacttgaaagctaaatgccagtgattggcagtgatcagcctacgtttatatacaggagctcagcaacaatgattttatttcttagtcaagatggctcaacattaaagcaagcttgtgttgatttctaggttgcagtttagtttgtggttaaaaccactcattgagaggggttagagctgaaaccactgcagagggtgaatcacaataaatgccagacttctgatgttttcttctggcgtaaaagagttttgatatttcatccttaatttttttaaccttttttatttagctgagagtaatggactttggcaaaatgtggatgactctttgaatttgccagtggtctcaagtgatagggcctttgcaaatgtgagatttcttcatcagaacagcctattctcatagattacattgttagaaattcaaccccttccgccccagcaaaaagcaaaaaatttagatccaagaaaggtggaggtaccttttaatttaaattactactggttttggtactagataatgtcatgtagcaatttggctacattatttttattttgtaatttttaaattctaggaacctactctggttttaaaagtgagaaacttaagagttatttggttttggatgagaaatttcaagaatctggttctatttactaggcttttgagttgacaaacatttagaatttggttcccctactaacctttgttaccacagaaagttttttagttttcagtgagaataaaaaacatttaaaatattgtatttatctaccatgatactgtaaagggttattgaatgaggcatgtcagttgatggagtaagatcatggagacttttctctgttaataaattctcccctcttatggcagacttcaaagaccccttggtgaaagattcagccattttgttacaatggatcaactttcttccatagggaaagcagtgatgtaaaggagaaaaagggatggtcttgtttacttccatttttttttttaaaggttagctgcctcattttatctgcagctgcatacaggaaattaaaattttatcagaaggttttgaagttctttgtaatcagacatgatcactacttggaggaaaatgttcacttctgctggccttgctgtagcagtggccataggaatggaataggcaagggataaaatgttgataccatccctccccattttacaaggatgtgagtaaatgggggctattcttcactcttagtggaaataaaaatgatatagccttttgttatttattaaaattttaaatatctatatcatctgacacataaatattttcacatgtgcacaaagatacatgtctaggggtattcattacataattcttttttaaaaaattaaatgccatcagttgagcaatgattggagagataatggtacacatgacatgaaacactttacaatggttaaatagaatgaggtatatctgtgtttactcagcataaaaatatttctatcatctgttatatgggggaggggagaagcatatagaatgatctcatttatatgaaagcaaacacataaacataagaaatccctgtatttttatacatataaataagtgcttagagacaggtctcaataggtatgtatcagactataaaccatggttatctaaggaaaataggaagatacatttatatattttataactaaaagtgatgtggtggggtgggaggaatgcagaaagttggaattgttagtagttccttcccggctgatacctaagcatggactgctcagaagttgggtatcccagaaaaattcctgcaaatatttgtagaatgattaatttgtattcagatagaccagatgaacatatatatttttcaattatgtccaataaagtctgtgtttcatagacatgctattttataaaataagaatgggttgaagaaaatagatttttatgggcctttcatataattttttgtatcttgttcctaatggaaaggaggataaataatgaaatgttttagtttctgtaattattaagaaagtatgaattaatgcctattgtatgcttagcactgaaaccaattctgtggagagaagtatagcaaagctcctcacttactgggttttcagtctggtgagggagataactaatccatgaaacagttaacataagaccaaatataattaattgccaacttacggtgaaaacagtgtgctggtatatccagtttacagagaggtcggtaagagcttgataaaatgactaagaatggctcaatgaacaaatgcattggactcagtatggaagaaaaatgcagtccatgagcacaacagtgaggacagtcaaacagcatgaaggtgagaatgagcacagcatggttctgtgacaaggaaacaagctaagtggagcaaagtcaatgaagatcttgaaggcagatttgttgatagggagccaaccaagttggattcaccaactagctggtgactgtgacaagttacttcacaaatgttatggtaaagtccctgctgattaccctcagatggctcttactgctgcttcctaggtatctttttcatttctttttatcaaatgtcacaggatggctatctaaaacttaaaaccaccatactcatttttttcacaatttagcttatgtgttctctttatggagaagatgacccttacagtgtaaagtgcccagacttcttacttctacatttattttccctctttgcttatcttttgttcattctctcctgttcctagagacagagatgttccttctttctaagattaactttttcactttctttataaagccagctttgatcctttgtgttggaagttgtctcccccatctctaaacattcagagattttgttcatacttcttttagggtattatcatagtcaactaagtattatagttatttgtgaaaatataccactgtactgtaagcctcttgagagaagagactatgtcttgtgtggcactatgcaattatacagcagttaaacaataagtagctagcttgatgggtggaggtatattacgggaacccctagaagctagcaaagaatgtttacatttgatacaataggaaataggttgtttttagtataaatgtttttggccaggtgcagtggctcacgcctgtaatcccagcattttgggaggctgaggtgagtggatcactttagcatagagatcgagaccagcctgggcaacatggcgaaactctatctctacaaaaatacaaaaattagctgggtgtggtggtgcatgcctgtagtccgtgctactccagaggctaaggtgggaggatcaccttaggccggggagtttgaggctgcagagagccatgattgcgccactgcattccagcatgggcgacagagtcagactctgtctcttaaaaaaaaaaagaaatgatgagggtgggattggagaagggacaaacatgagaaatatattttgagaatacaaatagaattttgtgactgacttggaagggatgaaactgatactagaaaacatttttaactagataaatatgtacttattcccttctataaaatacagttttatagaatacaacctacctttttaatgtttctcaatttttgctttattataataaactttcagtaaacatcaaatacatattaccagtgtctggctctgcactagagttctgacagtggataactcactaagtgtaaaaatggacacagacatgaaataaacatttataatatggtgtaatcatgatgatagaggtattggcacagtgctgtgggtgctcctgtgcacttgtcgagaggtgggtagagctttatcacagagcatagagttaagtgagttaagtatcaggaaactaggaattctaaaatgaattttgggcatttttattttgttctttatttggcaaatggtgtatactgtttattggcattttccccttggtctttgcattgctaagatattacattttgaactttaaaacaagttgacttagaagccagaattaagtgaaataacctgcaatatatagtctaatatactattaaaaacatgtacaggcatataatgcaaattggtcacattatataaaatatctctgtaatgtaaaatattcatccaaaagaaaaaggatagtggaaggatgtcacaattttttaaaaaattaaaatgactttagaactatagctctattcttatcaaaatgtttttaaattttaaaatatagaaaattaggaaaaatgtagacaaaatgaaacaaatttttaattgttcttccataattctgccatgcagagataacaattagttttgatacattttctttccctttttttgcatgcctgtttcttacgttgttgaaatcatacaaaatgcacaattttatcatgcttttccccccccaacttaacatcatacctgaaagtctttcacatcttaaaactttttataacataactttagtatgtacagaatattgcagaatatagacatactacagaatgaaaattatatattgaacatctattatgtatctgttagtcatggtgctaagtatcttacgcacgttatatctaacccctagagctaccctgtcaggtatgtggcattatttccactttatggataaggaacagacacagagaggttaagtaacttgcccatggacatataaatgatataaaatactttggtttttctattacattgtgatgcttccaatttaaataattattcttctgttattgaatatttagattgtccctatttttgccattatatatgacttaattaacatattttgtcataaagcaaattattttctgccaacccagcttttaagtaacatttttattatagtctttttttttttttttaatgagacaaagccttgctgtgtcacccaggctggagtgcaatggcacaatctgagctcacggcaaacctccacgtcctgggttcaagccattctccttcctgagcctcccaagtagctgggactataggcacacaccaccatgcccggataattttgtatttttagtagagatggggtttcaccatgttgaccagactggtctcgaactcctgacctcaggtgatccgcttgcctcgacctcccaaagtgctgggattacaggtgtgagccaccatgcctggcctaacgcagtgatagcaatagtgaatattctcgttcgtatttctaacctctaaattttctggggctttggaaagtcactcaatttttttttttctcctgaggaattgacacgtctcaccagagtgtcatcagaaagacactgatgaagtcactaagtgaagcatccttagttaatttacaaagctttttaaagactaaattaacttgtctttgctaagtggtagttttttattgttgcttttgtactccactttgtgccggttggaatctcacttaattagacccagtaaactcttggcccagtttccaaacactattgtacaaaagtgatgtattagtaaatgagtatagcatacctatggaatagttctaattggaagaattgaagtggtggttacatttttctgcgttatagttgacaacttatggcatagaattatgagtatttttttattatcaatgactgattcttatcttgaaaatgtaaaggctaaaaattagctccaattactcattatgtgtaacttcactcacttgatactttcagcaagaaggaaagatgcagatgattgatgaccaaataaggatcatgaggcataaggagtgccctcttaaggtgtcaaggcttaacttatgctatagactaatgtatgttttctgtaagtattgtagtaatattgcatctaagaaagtaagttgatcatatgacagctttttgaacaatgattaaagcaaaaggagagaaatggacatcaagaggttgtgaaggctgaaaggactcaaaatacttatctccaaaaagttaagtgttgacacaggcttccacttctgtaatttctaacactggaaataactgtttaatttaaaagtaaaggctacatttgacattttaacctggcccatccaagtatctcatagcaacagttgtgatttgaagtcaaaaaagaaattaatcagccacaacaaaatagtatattggatgaaattcttgtcttgttagctttttttgtatcaaaattaacttatttttaacgtatattgtttgcagaattgaatttgagttgaaccatatatgatagcagatgtcattatattcatcattcattatatatagttggccatgtagtcttggcaagaaaagtagaaaataaaatgctcagctgggcgcagtggctcacgtctgtaatcccagcactttgggaggccaaggcagcagatcacttaaggtcaggagttcaagaccagcctggccaacatggtgaaaccccgtctgtactaaaaatacaaaaattagctgggtatggtggtgggcacctgtaatcccagctacttgggaggctgaggcaggagaattgcttgaacctgggaggtggaggttgcagtgagtcaagattatgccactgcactccagcctgggtgatagagtgagactcagtctcaaaaaaaaaaaaaaaaaaaaaaaagaaagaaaagaaaagaaagtgctcttctgtttatttattcgataatgactattttgtgctcaagctggatatgcttagataaaagagactataactttcactttggtttgtaagttttggggagggggttgagaaattttttaccatcaggccaagttttcagtatggaacctttctgatctcagaaaataatttatattttaaacaataccattttagaaatttggaaatttcttctccaaaattacgtgtacatacttatatataaccacttgttctaaattggatcatcataacatagaacaaatggaataagtattgtaagtttaaaatatacactgctttgatgcagttaaattaggccttatctaaagattaacttgttaaagtatgccaatactttatctaatcgttcatttaaaaattaacttaacagctgtgtatttcattatttctccgagacaagtgagcataaaagtgatttcaatttcatcctaattgatagtgtagtgtgagttccttgtgctagaagttaaggaacttgctgaaacagtactttgaagtaatttgtaaatagttagtagatagcctgtgacagtgagaggctcatcagattttgtaaaaaataaatttctttttttgtgtgtgtttacaggaaacctgtccagtttaagtcgtcttggtctgagatataacagactgtcagcaatacccagatcattagcaaaatgcagtgcacttgaagaattaaatttagagaacaataacatttctactttaccagaggtaagaagtggattagagaaaacaagatttgaaatgagtctgcaagataattcaaggaaagctagtaaatctttatagcagggtaaataatttggtgattgagattgtttaaataatgagtatgctgtgaatgtaccaccaccgctgaagtaactccaaacaagaaagaatgggtatatgaacctattaagttttatgattattatttttttaatgtaaagaaaaagggaaaaactaggaggaaagtaagtgtgctgtattctactttagcaccatgtaaatctttctcatttcattttgggaactgacagtaaaggtattaaggaaaaactatatggctggttttaaaattcagctaccccacccagttcagttataaaaagaaagatgataagtgatacagaatgcactatcatcaaaattaatattagcagcaattctcctgtgactcaaattattaccttgtttatgcaataatattaaggcctatttagtatagaacaatcgccagaatctttttttttttttaacacatttttaggttttgttgattctattagaaaaatattttcacttattttgcttagggattaattgggtaagatataatactttttttttttttttttgaggcagagtttagctcttgttgcccaggctggagtgcaatggcgcgatcttggctcggctgcaacctctgcctcctgggttcaagcgattctcctgcctcaccctcccaagtagctgggataaaaggcactaccacgcccggttaattttgtatttttagtagagatgggggtttcaccatgttggccaggctggtctcgagctcctgacctccagtggtccaccctcctcggcctcccaaagtgctgaaattacaggcgtgagccaccacagccagccaatataatactcttcttttaaagttgtctttatcaacattattagtcttttactattgactttcttttcccacctattttagcatgtcgacaatggatgtttgcttatagttgttcaagcatgtctttctgtagtaatgtaacaaaagaattggggacttatggattgattgagctttgcagagtctttttttgtaacaaaaatgtcttacgtaagtgctgctactatgttttgacttggtagtttttctgagtatgtgtgtgtgtaatcaaattaagaacaagggttctttaataaggtcaggcgctgtagctcatgcttgtaatcccagcactttgggaggccgaggcaggcgggcggatcacttgaggttaggagcttgagaccagcctggccaacatggcaaaaccctgtctccactaaaaatacaaaaaattagctgggtgaggtggtgggcacctgtaatcccagctactcagaaggctgaggtaggggaatggcttgtggcttgaacccgggaggcagagattgcagtgagccgaggtgacgccactgcagtccagcctgggcaacaaagggagactttgtctcaaaaaaaaaaaaataagtgaaaaaatttaaatggatatatatccagtcttattgtcagtgaagtgaaactaataattcctgggtacctattaggaaatacggattttcctgggagcttgttagaaatgtggactcttgagcctcactcccagtcccactgaatatgggaaagtatgaagtcataatttaaaagtaatcagtgtgctttggaagcagcatagtcccaatgcaaatgtgaaattatccgcatttatagtaaggaaaacaataaaatccattagacagcacttatgagatactcaagctgggttaggcaagaaatcatgaaagtggttttcaataagggcatattaaatagctgaaatcagagctgctaaaatgactattttgtcatttgaagactgtctgaaaatggacttattttaatgtaggtgtatacatatagaaaaggaactaataatttgaaccacatattcccaaggcttgagtctagttgctctacatgtattgtctcatttaatctttatcataaacctactagttattggagtatcctcatcaaacagatagcgaaataaggcttaagagaggttatatttttggccaaatttgttactttaaatatttttctggaagtatggtaagaggtatattgattatctaattaatccaccaaagttgacaaaacttagtagaaggtgtaaaatagaagcctagatgtgtctcattctaacaaaaaaaaaaaatgataagcaacccctgcttcacaatgtgactaagaaatgagagcttgaagagctggcttcttgttgccccttctcaaatatactcagtattaacattttatcataagagtcaattcaataaagtaagtcagttgtaagaataaaaagaatcacattttttgccatgaggctcagtaaaactcctttattttcaatcgtgtagcctgtagagatttttcctgaattgactgccatgcagttttcttgccactgttttacctctgttgttccttttgtttctgtacaacaatacacaaattttaagggtagcttcttaaggtacagtataaagaacaagtttcagttctctgtatagttatatcctcaattatatagttacttcattccttcagatggctttgccaattatactgtcacctcaagtactaagttttcaatttgctgatggtggacaactgaagtttgaacattattttaaaaacatacatacctcatacagtgcttgcttctccctgcttgtgcttttactttgaatctagagtgtttcttctatttctctgagtattttaaaatgttttcatccttcaagatctagctcactgtcagctttcatcctatttttccagttattccagttttccttgctttgaatttaaatagagaaaggacttaaaatttaagcacttacttcctactaggtattgttaacttatttatgtattttatcgcttttagtcttcactatggcccataaaatatcattatttaaaaaatgatacactaggttcggaaaaataacttgccaaagtcacaagctatttaaagatagagtcaggattcaaaacagtttatagcctgtacaggatttctcagatgttaatgagcatgcagatcacctgggaatcttgttaaaatgcatattatgattcagtgggagtggggcccaagagtctgcatttctcacgagctcccaggggatgctgatattgctcttccttggcccagactttgaatagcaagagcctattatatataattgattattgattatatacggtcgtatattattttctaattatttcttacctatgtacttctataaatagagcttaatcttctttaccgcagagattctttggtaatacctgaatattttaatactttggttaaatggtgagaggctaaagtagggcaagatggggttatgtgctaagtaaatacttgtttaatgggtacatatatgccctcagaaattttaccatatagaaaagcggtgtattatacagtatcaggaagcataatcatctactgaatttaatagttcctaaaaggaatctttatgttaatcttaataatttagagagaggtatatgactaagactaggtaggattggtcacacagccagtggcagagacagggctcagacctgggactgtctgacactaaagtttctgcaatgtagaagtttcaaattagtcacccatgaggcacctctcacacacagacatgttttccttactccatacagtgttttaaataaattgaagccaaagaataaaaattgggaaaattttctgtttcctcctataaaatctggaagtctacattggttccacatttctgcaaggcaccaaactgctagaactgtgtagtgactgtccctgtagagaagtgtcacagactgccccaaccagtctctgtcatttgtcaccccccaaagccctttgaggcatttgtgttgggactgctgttctataaaaaatgagtctcatcacagttctaattcttatgtttatttcattttttttacagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggtaagcatatatttgtttactagggaaaggaattgctttaattggtacttccactaatatttatgttttctctaattgtgtggggagtgggtacttgtaccttgctgatgggtctaaactgatcataagacatgtcagggtactttgtatcagataacaaatatcttagaactgagcatacccttaggattttgtcctaaagaaatcattgtccagctcagtggctgatgcacctgtaatcccagtgctttggaaggctaaggtgggaggatccctggaggctaggagttcaggaccagcttgggcaatatagtgagaccttgtctcgcaaaaattttttaaaaattagctggcctgtggtaccagctacatggaaggctagggcaggaggatggcttgagcctgggagttcaaggctgcagtgagttatgatggcaccactgcactccagcctaggcaagagagcaagaccctgttccccatccccccaaaaaaggaaatatgaatgtctataaaagtatagttgtagggatatgtattgcagagctatctatttcataggtaccaacttattaatagagatttaattttgttaagtagtttatctttagtggaatactgtggagccattaaaaatcatattttggtctaaaagaacactacgtactagttgaaatattctcattttatcaagtggaagaaagttaaagcatgtaaaaaatctcttcccacccagaatttttgaaagctgtttttaatatgcttaattgtatattaaatatctttatatttatacgtatagctggtttttgccaaaatgtttagagatcagaattatttatgggtgaacgttagtttccttttgcttacccactctacagtgatcgagtttcacctttgtaatgaaattcattgcaaaaggagaaaacaaatggaaaattatcaagttcagtgatttaatttgtactggacaaactttaggcccaaggaaggtaactgaattggccacatagctgatagtattcttcctgtcatgatgaaccatttgaacatagttgtggttctttaaactataatcttaaatgtacaatttttaaatttcatccacacttgctcataaatatggtatgtatcttttatgatgattctttggaagtatatgataagtaaactaatggaaattcaagatactcatacagttttaacaattgtaaaatttcttgttaatcagtctggttatatgagatttaacagtggtaatggtgttgattctgaacattcattttgtagtaataggcttaaaacacaatggttcaggtgttcattagtttatgcatttgcatgtaagtaacagtagtaaatttttaaaaatgaaaatactttataaatcatactataagtgtcagtagtttaggcatagataggtactaagcttaaatattacatagataacaagtttaaatattacaataaaagaaaaagtgggttttcaaatggatgcttgctacttgggatttcttttatgggtcattttgtgtgaaatgagacaatccatgtgcaatgcagcaaatttttttttgttgttgttgtttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccacgcccggccgcaaattttaaagatacagattaacataaaggatataaaataatactgccactgagaggtagcatcactgttaacatactgacatacattgttggtattgagctggatggggtgttgattatcctctcccaataccaatacccctaacacataacattgtggtacgagttgttattgatgaaagtatactttataagtgaataaaagtggcatactttttttctgtggacagcattgtctaatttttaaaccaaattaagaccatatttactgtttcctctgttttggtgatgaatatattttaccatttttttcttatggatttttaaagtgaaatggtaaatacctgattagtgttttaatgatttaatttgctgtctttttaagactgtttttcctcccctactttactgctcagcaccttaagaattcctgagctcattctggtttccttatgggctgtcattagatgcgtcttcttctattgttttcatatctttatttgagcatttatattttattcagtgatttctgcatattgtgaaattgtaaaaacatcatatttatcataggatctttgaaatctccagtgtttctctgtatactgtgtttttctatttccattataatcacataaggaacaaacttccagtttaactcccaaataaaagcctcattactgtataaaaaactttggaggcttagagttttctgttgctgattttttttctttctatatttaaatatcaaaaaggggaataagattttgtttaattaagaattctctttccgaagtgacaggtatatatagaactttgtttttgtgattctaccttggatgcttctttttgtctttgccaggacaatcagttaacatcacttcccttggattttggaacttggaccagtatggtagaattgaatttagccactaatcagctcacaaagatccctgaggatgtgtctggtctcgtttctcttgaggttagtataaatgagcaattagagaacttcagaaccttccatacgtatctcatttaaaaatttcaaatttaaataagcaatttctatttgggtgaatgtcataattagaaatgttagaactcacttaaacatacaaccctaataggataatgaagtgttgacttaggtagtctagattcagtgcttttgaatttctcttgcctactacaagttggtgtctttgagtgccataaagtattaatatctctaaaagaaaagttctgtaaaagcatcttttagaacaatttttttctttattctgtttaaaaactacaccattgtctaccaaaataattatcgattctcagactgtcatttagaatgctttatcatactttttcatcctaattaccgacctgctattttatttactcattgattattgtctttgttgtaaatctggtatgcctatttctagccctctaattttagtcctattgttttctgtatctagaatgccctcttctcatccccttagtttttttcttttagtatgtttttccataattaaagatccatcttattttcacctcttcagttaaggatgatttctcctgcttctgagttcctagagttttcatccctttgatgaaaatgcttactaatagtaaatatattgctttttaaaatttccttcatatccatgttttttaaaggtctaatttttaaattatttaataaggtgaaatagtatggtttaatggctaaaaacatgggctttgaagtcaaacaaagctgagtgtaattatctctgtatatttatgtacttaacttgcccaagcttcagtttcttaagctgtgaaatggggataataagagtatctaccttgtagagttgtagttaggattaaatgcaataatgcacataatgcattcagtacagtgccttgcaaatagtaaaatcaagtggtgactgctgtaattattttctccatcttactgtatatatttattatgggtggtgtaacattagggaaaataaatgaacataaaaacttacccagaaccttacgtatctgttttacctattgctctttctcccaacccagtattgtctccttacctttctgctagtttgtaactttatcggaacaaaggctatcttctctgccattttaacccccttcagtatcttccaggatgctttcagtgtaataagaacaccacagataataaatagagtggattgatatagcaagtttagaaggtagcttttaccttccttaagtaatggtttgtaagggattttgaataaatagtttcctattagataaacatttgtaactattgagcatttttttgaaatttcattaaaattaaattgcttcttttgttttcattagttttgatataatcaaataaaatctcttttctaataactatggtgtttttttagaaaagtaagttaaatattttatatgttatataattgaacatcacccttaatattcactgtttggaaaattagcattgcttaatagattttaagccacacaatgacagtatataatttcatttcatgatttcctaaacattatcaataatttctcattaggttcttatcttatcaaacaatcttctaaagaagcttccccatggtcttggaaaccttaggaagttaagagagttggatctagaagagaacaaattggaatccttgccaaatgaaattgcatatcttaaggatttacaggtaaacattatgctgattttgtagttttataaagtttttggaatctgttccaaattccacatttctcttaagattttgatgtaattcttggatcagatagactttcctattctagtattagggctgagttttatgttcatataacctggctttgttttcctaacaaatggtattttgtgaaagaaaaatatgtaatgtaagtgattctcattctatccaatctggtttccctgttaatttattttattgtttagacatattattttcagtttacattaaatgtaggaaatatatttgtaactctcttttattttgtaaatcttttagaaattagtcttgacaaacaaccagttgaccactcttcccagaggcattggtcaccttactaatctcacacatctgggccttggagagaacctacttactcaccttcctgaagaaattggtatgaaccctgtgaatgcttgactctgtactaataatttgctcttgtgcattcaagcaatatttcagataaatatgacaaatctattgttttttaaactgaggttatatcaggcttaagatttttttttttaatagagcaccgatggttgattgttgattggttttggttaggtttcctaaaggctgttaggattggttttaaaattagtactgtatttgagaatgttttggaatacttacatttccaataggttttatgtataacctcattttagaagttattttatattccttctaaatttaaaattacacaggcttgaattagtaatgttttatgccaaaagaacatttatgagattttagaattaatattaatatttaaccaatattaacatttgggaatacttaacattttccaggtgttttcatttccattattttatgtaatatacatgaccacctggaattttagacagtgcaagttgtaatcttgctttataaagagaattacttgattaaggtaattaaatgttagcttttaaattagtaattctatgcattaatgttttcccatctatagtgcactgtcccacaggaactataggttagtaaacaccgcatgttctcctcataggtgggaattgaacaatgagaacacttggatacagggtggggaacatcacacaccggggcctgtcgtggggtagcgggaggggggaaggatagcattaggagatatacctaatgtaaatgactagttaacgggtgcagcacaccaccatggcacatgtatacatatgtaacaaacctgcacgttgtgtacatgtaccctagaacttaaagtataataaaaaaaatggttttggagataattgacaattcaaaatctagccctgctgcttattggctttgtgactttaggtaaggtatgtaaactccctaagcctcaagtttcttacctgtaaaataaagatgataataggaagttctcacaaggttgttctgaagcttaaataatatcttacatgtaaacaaattgattacatactagctattatttctgttattttctaataaatgccactgtgaaatattctgaattttgaaatttaaaaattggaaacacatgaggcaaatttacacctatatttctagtatatttattcacctgatctcatttaattgcttgagacattttcctagagaatacaagtatcctaagaaaaaatttttaaaggtctacataagtcagtttttggcttactgccatacatgtgataactcttagtgaaaggttcatattaagtaacaaatattttgcacataagaaatttattaatttgagaaaatgttacatctacaacagaaaagtggttatagacattgaatatataataagctcacctttggagttttaaaatatatataagtaaatgttatatatgtgccaaactatcccaaacagaatctctggagatggggcatatgtattttcaaaaacctctccaagcttgaagacctaccataaaggaggaggttctaatttagtttgtatgaagtgtgacctggacatataggagtttaaaaagtcttccaagttgatttgaatatgcagcaaaatttgagatccatggttgtagagttttaaagctaagaaaggagaataaaaggaaatgtgtgttcagtatatgtaatgaccagaacagcatcatgcccagttgaacttttaaaatagcaactaatttttaaaaaaaaattgattttttttttaaacaggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacctagagcttgtgtgtttgtgtggttttttaaatctcgtatccaggtgtgtttatatattaagatgttgggacttgaactttaaaggtagtaactaaatgtcttttcttaaaaaaaatggttattgtttcttaaaatgaaaatatggtttttaaagcatttttgttccacctttatgttaatctgtaacagtaatgtaaaacgatcagtcttacatgtagaagtcatgctgtgtgtaaacaatataatgacaagttataaaaaattttaaagaagtataaaatgtatatcctctgtaggctgtcaccttgtgagagcccacaaatttcattatttcccaagaaactaaaatggactctgattaagatatccctgtgaaatcaagatatttaatatttaaatagtttgaatataataagggatattgttgaagactacatatgagctaatactttttcctgaaactgcaatgggactaattggcatatccaaaaattttcctttcctttaaagaaattatatttagtctctccatgagactcagcaaataaaataagaatgtccgaggatgttacattataaaaacattgctctaaactttgctttttgttaatatgtagcagaaaaatggcaatggtaatgccaagctgtccttttctgagtttaatactttctaaatcccacatgattattttatacagaaaggaggaagtgctaaataatttatgaactttatagatacaagtgaaaacagtagatgatacaggaagggaaaatacacataaaacatttatttgtacttaaaatgtaggtattgcaatgggaatgatctctaaaaaatgtaattgcaaatttctaatttatctaattgtgtagcttgaatcatttaaaatagataagttattatacattaaaatttatctagattttctgtaaatttttgttataaccttttgcttttcatctgttacttcctttttttttttccttttttttttttgaaacagagtctcgttctgtcacccaggctggagtgcagtggcgtgatctcagctcactgcaacttccgcctcccgggttcaagcgattctcctgcctcagcctccaaagtagctgggactataggtgcctgccaccacggccagctaatttttcgtatttttagtagagatgaggttttaccttgttaaccaggatggtcttaatctcctgacctcgtggtccgcccacctcagcctctgaaagtgctgggattacaggtgtgagccaccacgcccagcctcatctgttattgctaagccatgtgtattgaatccaaatttcaccttgcagaatttataattgtttattaataggaatgtatagtaactaagtatataaaagtagacacttctgaaatgaaaagggggcactaccaatagttatatagggccaacagcacaacagtggtctcaggaaatcagaatatatgatcactcttgcatgattaaaattagataaaagtggatagcataattcaaaataaactggagaagtatacattcctgaaatctataaactttaaaatgaattacttgtgaggaaagatctccttctgccttgatcagaggataagatagtgtatcagatgtcttagctaaaacttatctcttgccttattcttttgagtagtttagtctttaggagtcattgggaaacgcatggcaatctttagttgattatgtaatcttggagaatttgaatgtgccagagttgtgacattgtcttggtatctaagggggtatcttgaacattgttacattaggcaaatatgagaatgttttataaaatagttatcagtactttgttattgaatagaaggcctttctgagaaaaatttctgggtttattttttcactttgaaaaatgactttaaaaataagggatttttttaatttttaaaaactggagttagttctcattacccttaaaaaatactttcttttgtatacacttattaaatatc

SEQ ID NO: 16624 - DNA, 5400 bp, Human
ttttgagctttgggtaaaaaactggataacatgtaaatagaaccagtcataaaaatattgagtgtttgaagtgtatctgagtgaaaacacaaacataagaaaaaagcacatagtaaaacaatagttcccccttttactctaaaatgcaccaatttgggtagtaatttatatggcaccctattcatggaacactttctgttgccaggtaccatactattaatgttttatttaacctttacaacaaccctgtgaagtatataaatatctttatcatcctcaatttacagatgaaaagctagctttaaaacccaagcagcgtagttctagcatagcctcaagattgcagtgaacattgattacttattatattccacatattcttcaaaggactttataaatattaactcatttaatcctcataaaaatggagggaaatgcttgctattattcctcttttgtcactgaggaaactgaggcatgtgtgaagtcttcatttcttccaaatgtcagtcaccagtttttaccaatcttcgaagtatttctgaaatctatctgttcaagcgtatctaatgcagctgttcacagcatctctcccagtctgttgccatagcttcctgactggtttcccagttaacagttttgcctccttcaaatctgttctccacccagccatcaaaatgatatctttaaaatcaaaattgcccttgtcagtcacctgcaggataaagtcaaagttcccaagtctagcttcatcttccatgtcattcttcccctcaggctatagcaatgccagcctttttcctgaatgcaccatattgtttcacacctccatacatttgctcatgattttctggtgttagcctgtcacctactcattcttttaatgtgtcatttcctccatgaagccttagctgaaacattcctctatactgttaatctgggtataagcctctccctggtgctttaatagcacctgcagcacaactctcatttcatacattagattaaaattacctgtttatatgtctgtctcctcatgctagaccagaaaatgctgtatttgttcacttttgtatccccagcatctagcacagtactcagtatacaaaggtattccataaatattttttgaacagaaagaaaccagagctcagattcctaatacttgatcattactctctatttttcaaattagagtcagagttaaagtttctaagttcttagctattaaacaataccttctttctttgggagaaaaaaaatctgacaaaggctgactaatcgaagtggaagttgggatggttgatcccagtttgaattttcttctgactatgtggtgagaatgagaaatgcagaatgtccacctgttttgagcaggaacactatgctgcagattttttttttttttttttttttttttttttgagacggagtcttgctctgtcgcccaggctggagtgcagtggcgcaatctcggctcactgcaagctccgcctcctgggttcacaccattgtcctgcctcagcctcccgagtagctgggactacaggcacccgccaccacgcccggctaattttttgtatttttagtagagacggggtttcaccatgttagccaggatggtcttgatctcctgacctcgtgatccgccggcctcggcctcccaaagtgctgggattacaggcgtgagccaccgcgcccggcctatgctgcagattttttaaaacattatttagaattaatgtactaaaatgtaaactagtatctcactagaatgtaacttcatgagggcagggactttcaaggttttgtttattactgtaacctcagtgccaagaacagtacctggtgcataattggtgctcaagaatttattatttgttaactaataaattcagggtctatagcagtgcccattccttctttaagaaaaatgttttaccaaatatgagaattgaccttttattattctgtcaacatttacatcttggtttgtttttaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataatttatttttctctgactttaacaattatgaatgtatggttaattaagaggaaaggttttctgcttctaccaccaagtactgtactcttaacaagaacagtttggtagggtttttataagactatatagatataagatgatagagaagagagtcatgaatgatgtcagagcactactgaagcctttggagtgattccatagccttctggatggcagctgaatacctatatgtagtatcactgcccaaagacctagactagaaagtgcaaagtagcttagcagctgcagtcattcactcccagcctccaaaattctctttctttcacctcaaatctatttcttgtacttacctactcacagcgacttctgtttgctttcgatcttcacctgactagattcccactttaaaacacttccaggcaattcagggtcctatgggtgaagataagctaagcaataggtattattcttaaatattacttagagatggggacttgctatgctgcccaggctggagtgcagtggctgttcacaggtgtgatcatagtgcactgaggcctcaaactcctggcttcaagcagtcctgcctcagcctcccgaaaaggtggaactacaggcacatgccactgtgccttagccaataggtattagaggtagtcaagtaggtatagcataaccaattacaaactttaaaatcaaatgatactgaatgctttttcataaaatccttcttaacatcactttcataactgaagcgtttggaaaaattctggagttcatatttgttcacaagaatgggtgggtgtatttagaatctgccagtctatcagctttactgaggggagatactaaaaatatttaacaagtagtataatatagagaccgagtcaaaatggatactagctggaaacaactggttcaactgttgcctcctgactaaatgtcagcccagggtatagtaaccatgacacagtactatccttggtgaagagttgggaataggattaattgcggaaaaaatatatataaatgccataggacacttttagcacaaaagtagttgtttacctcccattctcctcctttaatctcagtgcttttactatttggtttcttttttggcattttacaaaagggaagaaatggaaaacataccccttcttggtcattgggtaacagcaccatttcggtaacagtcatacttgatgacaagtatgatgatattttaaggacatgaacatgggtgaaatcaatgtgtagatggtacaaattaaccgaattctttttaaagcatttcctgtggatcccaggatcatgaggacataacagaagaataaggtctgaatcttgttcaccagtttgctctcagcctaattgggaagtaaggttaagcacctgaaaattatgtcatacaaaaaaaaagagaattaacgtcatacaatttagcatttgactgtaaatgcagttagtcaatgttgggagaacaacaaaatcagggtggatcagagtatttaaagtgagacattaatttgaactaatcctttggaggggcagaaaggacaaacggtccaagtgaaatgaacagagtagaaagagaaagttaaaagtgggtttaatagtcactgttcttgcagttttaatgttttttgttttgttttgttttgttttgttttgttttgttttttttgagacagagtctcgctctgtggcccaggcgggagtgcagtggcgcgatctcggctcactgcaagctctgcctcctgggttcacgccattctcctgcctcagcctcccaagtagctgggactacaggcgcccgccaccacgcccggctaattttttgtatttttagtagagacggggtttcattcaccgtgttagccaggatggtctcgatctcctgacctcgtgatccgcccacctcggcctcccaaagtgctgggattacatgcgtgagccaccgcgcccagctgcagttttaatgtttttaacataagaatt

SEQ ID NO: 16625 - DNA, 39299 bp, Human
ggcatagcgggagaagagtaagcagcagagtttgtatgggattgtgaaggaaagttctggggataaggctagaaaagtcttggcagtcagattaaggagagttctgagtgtcagggtgggataataggagggcaaaaacattttttaaaaatgaagtctaatttagctacaaatccatttggttttctcaggaataattaatgtgctattcaagtcctgattatttattcactagatggaatagcaatacctctttctgccatcactgctacctgcaggtcatttaccaatgatttctaatttcttttagaatgtatcccttcatcatgtattgagtatctgtgctagagatcctagaatgaaaaggcatggtcccaacttccaaggagcccatgaattgagcagataaagagataaattgcagtaagtatgatgcaagtttttgggtaaaggtggtacaaaggagaggaaaattctcctactacccagagttcagggctagatttagcacagttggtgacatttaaactgggctttgaaagatgagtaggagtttgccaggcaaagaagagagctgggaaggccttgtaaacacaggaaaacaatctggacaaagacacacatgtcttcttaattctcacaccttcaatcctacaagcactgtggagtatacatttttaagttttattttcaggcttttaggggaagcttggtgataatgagtgaattctttcagttgctacaaaacaagagtttgcatctaagtatttgacccccataaacatgcattttacctaaaaagaagcctggattttagcaagccaaattggctataccctttacccccagttattcctctgggaggttttactgatttttacttttctggaaaagcaaggaaagaactcttaaatctgttttttcagagactagtaaatccattagtcatcagtgcaggactttcatctcttcaatttttcactggaagatgggagaagtcataattcactgtcatgtggctcccaattttgacatttgcaggaaattggtcccctctgaacttcatgaatgttcataaaagttatttcggctgggcacggtggctcactcctgtaatcccagcactttgaggggaggccgaggaggccgaatcacctgaggtcaggagttcgagaccatcagcctggccaacatggtgaaaccccatctctactaaaaatacaaaaattagcagggcgtggtggcaggcttctgtaatcccagctactcaggaggctgaggcaggagaattgcttgaacccaggaggcagaggttgcaatgagctgagatcgtgtcactgcattccagcctgggcaacaagagtgaaactccgtctcaaaaaaaaaaaaaaaaaagttatttcaggcccagatcagatggatctccaaagattatcctgtctcaaaaatttgttaatgataatttcagctcaagataaacactaacatattaatacagcctatgggattacaaaaaagtgagcaaggaattcattcaagactggaaagaattatcctctcatctgacactcccatttaacaagggtgtggaaatcaaggcccagtgacacaggattttttctccatcactttgtaagccaggaacctctggctggtgacaccctgcccaggcctcagtgggccacactacctgctgcaggagatggcctgcccactcggcctgggtggggagttttattgagtgatgaaaacagctttcagtggagaggggatgcaggggtggttcccctacccaaaggcaggaaagtccccccagtgcgggtgagtctggggcttttatgggctcagaataggggaggggcaggacataggtagtactggaaaaggcaacattcaattggttaaaaggcattagtcagaaataattaattgggaaagagcagacaaacaggaacagaagttctcactctaggtcacgggtttcatttgggaccagtagcctagtctttcagccttcaggctgtttttggcttgaaggtggggtttcaccagggacctgcccctatctgcctaggcatttggctgcctcctgtcattatcaccagggaggtgcctctacctgccaaggttaccctggctctagaagcagaactttggccagaagctgccacagaacaggggtgggagagagaagaggagctgggtgacagagcagaagcattttggggaactgatccttcaggcagcagctgatgtacttcctctctcctccacactccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggtgagtggaggtgcctctttccgggcctcctctgtgcatttgttattatgattctcaaccccattgcatttcggaaacctaacctctggggagattgaaaagaacaaaagttgcccaagctccacccctagacagcctgatttaactggtctgggaggggccccaggcagccagttttaaaagctctccaggtggagagcaggtgaggggcagccagggttgcctctttctccatcttctaaattaaaatcattctacaagtgtctttaacacctttgtgaaggctgtcctagtcgtactttcttctacacagaactccttctgggcacagaatctctatctatcccagcgctttacacctgattattgattctaaggcacctcttttggctttccaagactttcatgtgtgtcgactttgcctgctcaagagatttaagggaggcacttacaaaaaatagcttttatcccaagtgacaattctgatcaattataaaggagactcttttaaagatgctgaggctggcaagaggaaattgtactgtgattgactagtgatgtctgctgggggcatggtgtgggatgtctcgcatctttttcgttatgttttctcactcaaataccatagtatggagttaagcattctcgataattatttttttgattggttgtggtaaggtggaaagggtatggagtttggaaggagaagatctaggatcgaatcctagcctctgtctctctctggacttttagtcttaagcaagctatgtagcctatgtagacatctggctttcagcttcctgagtttctaaatatcatgaaaattaagtgagatgccaaactattaatgtctcgtggaacttcacaccactgtataagagttagttattatttttaccgattactgccagtctttgcaaggtgtggcagtggttgactccccaggtcccttaaagaatcagtcccttccacactccaacagtaggtaaacaagcctcagccacaccctcctgacaggaagacagagaagtgactgaaatgttctcacatagcttgacaagtcaatctcaggctctaaggcagagcatggcaggaccccccacctctggctggaggaaggacatggccccacctcctctcaggggcctgctgaggggctgagtgaacagcaccacacattctgagggctgatggacacaaagtgcacattgtccaggagaagagattggcagctagtctgggcacagctatgccagcagggactgtagcctcctgccttggcctggatatgggatccttggcaaggttgtgtgggccaccactcacttctcagctcccaggccttcaggcccacatgtctctgtttctcctggcattcctctgcttctagccttctcattccttctgcctttctttgttttcctgcttgagcccttcctactagcatttatatgcattcttattcattatcattttaattgtatactattcatgtataagtttgtatagtaaacaaatataacaatttatataatattttaattattttcatttgcaataaattttattatttatttaaactgaatgttcaatacattcataggaatacaagaaatgcaacaagggttaaaatttcattattacattagatatcattttttctttctttttttttttttttgagatggagtctcactctgtcacccaggctggagtgcagtggtgcaatctcggctcactgcaacctctgcctcctgggttcaagtgattctcctgcctcagcctcccaagtagctgggattacaggcatgcaccaccaagcccgtctaatgatgtttcatttttcaaagaagcttctcctatttccctatcttttttatcttccacagagcaataaatagtaattactactctcctggacaaggtgctctgttgtgttggataggaattgtatctttaagtttgacatcattatcacctccaaaaactctaccttcacttcatagcacagtctcgctgcattgtttcacagtaaaattgtactctactcaaactaggagaactcaaagaaattagagcaaacagcagttaaattcatatgaatgaaagacagaagaccaaagattttaaagtactgatttagtaacatagtgtctactggctcaaagcttctatctaatcatattaaatcatattattaaaacagcgataatagaaatgaaagctacactaatgaaaaaggaacttgggaatgaggtcattaaatataactaactatattttaaatatagatatgtattttttattagtatcaggtaaatgtctaaattatctattctgaattctagtctcagagaaggtcagagacagttacaaagaaggcgcttcatattgtcaagtccatttttaaaatgatgagctcctttgggaaaatgctttagtgtttcttttcttctaagatttctgttggtgataatccattagtgtctgcacccttatagtccactttgtctttatttgtatcattggatttttttttttttttttttttttttttttgagacagggtgccttactttgttgcccaggctggagtgcagtggtgccgtcacagctcacggcagtctccacctcctgggcttgagcgattgacctacctcagtcccccaagtagctgggaccacaggcatgtgccaccacatctgactaatttttaaatttttcgtagagatggagtctcactattttgcccaggttggtcttgaactcctgggctcaagtgatccacctgccttggcctcccaaagtgctgggattacaggtgtgagcaaccgcacctgggaattattggattcttgtgtagcttttctaggccatatatgactaacaaaagcagaaatcagatggtatatgtatggctccaggaatgttttgtagatccacagcagaactggaatgacaatacaaggaatgcacaccattgtcccagacttcagcttctaaatgtgagagcgaagtggggtgcaccgtgagagcacagggtgggcctcgaggtgccgacgagggcagacagcagagctgggcaccacagggagctagggctctgtgagccgtggctcatctcacacctcctcactgccttgcatcatggccatgtctggacccttctctcctcaggcctttaccagaagcattaaccgagacaagcacttggcagtggcttacttccaacgagggatgctctactaccagacagagaagtaagtggttcaatgttgcaccaactggaggatttcagagagaaacccaaggggtctcagtgttgcgggcttggtgtttgagcagtaccttcccaacctctgttgggaaatgtgactggcccttctggggacagttatgcaataaatcagcaggtgaggcagaagctctcactggggaggcaaggcaggtctgccaccagattataaatcagctgtgtcataggcacaatgagcctaggtaaccaccatgggcctgatactcagctggtgtggcaccccaccagtgtccctgatggggtcacccatgtaggtctcctatgaggtactgagctgtcacagaatggggatgatcatgaaactgcatcaaaacctggcttcatcccagcaaaatgcatttccaaaacctggtttaatccatttgaggaaatatacttcagctgcaaaaatgataatacaaattaacattatatgtataagaataaattactacagataagtaagtagcgtatgcacttatacagaaaaagtttgcagtagatgttaattttttttctttttccgagacagagtttcactcttgttgcccaggctggagtgcaagggctcgatctcagctcaccgcaacctccgcctcccaggctcaagcgattctcctggcttaccctcccgagtagctgggactacaggcatgcgccaccacacccagctaattttgtatttttagtagagatggggtttctccatgttggtcaggctggtcttgaactcccgacctcaggtgatctgcccacctcagccccccaaagtgctgggattacaggcatgtgccaccacgcccagccagatgttaaatttaaaaacagatttcaaaacagttcatatagcatagtcccatttctgtatcacagaataaagtctggaaggccatagatcaaaatgttatcaataattctctctggatggtgggattataggaaaatccattttcttctatcaccctgtctgcatttttaggtttgtttatagtcaacatggaataattagtacaaagattaataaattcaaaatgaaagttaatctcaattcctcctccctctcatcctgcacaaatacctcataacaaataacaaaggaaaaaaattctaagtgataatttcaaatgttttggggcatgggaaactgaccctttgtagaaactgttccaccagtgtgcatcagttctagggaagaggaatttggctcaggctaatgaagaattttttttttttttgagacggagtttcgccctgtcacccaggctggagtgcagtggcgcgatctcggctcactgcaacctctgccttccacgttcaaacaattctcttgcctcagcctcccaagtagctgggattacaggtgcccgccactacgtccagctaatttgtgtatttttcagtagagacagggtttcaccatgttggccacgctggtctcgaactcctgaccttgtgatccacccgcctcggcctcccaaagtactgggattacaggcatgagtcactgagcccagcctaataaagaactttctgacagtgaaaatgatctgtgcatggtgtgggtggggtgagggtgaggccgggcgtggatggagcagcagggaggttgtagacaatgtccagacatcagagagagggctgggctctgatcctgtgccaccctgaaaggctttgatcctatggtttggtcagaaacagagcctgtaaaacccatgtatgcagctgttgctaagggcaaccacaagatgctcaaaggaccttaaagatgtagatgcagttagttacctgaagaagtgaaagtagaagtgaagtcttttctaaaagaaaaaccacagacacaatggcaatctggggagaaagagagcctgggattgggagaagatatccaggcatttagctctctcttccccccatatttagtgtgacatatttattgtgactttataaattctttttttaattttaattttttattttaatgtttgtgggtatgcagtaggtgtatatatttatgggacacatgagatattttggtacagcaggtgtttatcttgaccgacgtcttgcctctaactgcctgtccccgctcttaacatccttctctttctcactcccccttaccccgtctccagactatagaatatgcagggaggcctaacaacaaatccttcagccgatcttaaatctcaaaacgcaaactctaaggtcattccttagtgacctctaatagtctataaagaagagatacaactggcaaaagagtgaaggctcccagaaagaatttcctccaaaaaatgcccgtgagtcccaggatctggaaggccacggttttgagtgattagaaagatcttggaaacttctaaaagtaagacccaggattcaattaatctgtgattggtaatattaatagttacacctgagagaaaaatctaccaagttttatctgtaattcaacaatgaggaaattatacaaatgaggcactaatctcaacctcaagcaggccctcttgcgcaattccctaggtgttggtattccctttgaagttctgttcttgacccttttcccttttacaactgcagcagtggttgttaaatggcaaaatgtgtttccagaaatacactttcaagcacacacattcgtttatgtacaattcaggggctatagatatgaagtccgtatgtgaaccttgaggatccattcctgggcaaggccaccctctcccatatggctggcctccatttctcacagaatctgtacctgagatccatccagggaatgtctctttccctaaacctcatcaggttgacctcttaaatatttcttaaatccacctatttctctccatccccactagcactgccttggttgagaccctcatttttcaccaggactactgcagtcacttccaaactgattttccagccactgctcttgtcccctccattcatattccagagtgatcttgtaaaataaaaaaaaatttaaaaaaagcaatctctgtgagaacttccagtggcttccatgactgcaagataaaggccaaattcccttgcctgttcctatgtggtccagctgctgccacccactcatgcatcctccgtgcctttgccccagccatgcccaaccactaaggcagcgtctgctccctcttttgagcctccttttgtaatatgtctggcccgtgacagatatttgcttcctgtatatatttgtcttctccactactctacgaatttcgtaagaaatctttacttactcatgcttgtatttcagtatctagcatagtagttactcaataaatgagtgttggattaaataaaagtgagcaaaatatagtctccgtttcaaggaacttataaattaaaaaggggaaacaagtcaagaacaccagtaactgtaatgcaaggcagaagtgggtaactgctgtaagaggtagttttaagtaagcgggatgggggctagagaaattacttcttaatgtgtgggacagaaattccctcagattggctgggcacagtggctcacacctgtaatcccagcactttaggaggccaaggtaggcggatcacctgaggtcaagagtttgaaaccagcctggccaacatggcgaaaccttgtctctactaaaaatacaaaaaattagcagcacatggtggtgggtgcctgtaatcccagctacttgggacgctgaggcaggagaatagcttggacctgggaggcagatgttgcagtgaaccgagataacaccactgcactccaacctgggcaacagagcaagattctgtctgaataaaaaaaaaaggaattccctcagattacaaaagggaattgtttaaggctgataatgttatggatggaggtttttccccctctatttccctctattttccccactttcgtatgtttttgtgttgctcttccgtcattataaagttccaacagaacaaagttagagcacatttctgaaaaggcaagcagagtctcagggataacagccaagctgtctcgcctctctagccccagcgttgtcatctgaaaggcacaggggctcgaagctgtctttcagatcctgtgccttatgaatcttagggcatgacaataagggtgagacccattccatggagctggcttaaagaggctccatagcaaagccttcttcctgctgacttggaaacaggaaagggagtgggcccaaacctctgtcacagcagccactgcagcatcccaaagatgcctgaagttttgacttctttcagcttgctgagattccattgtcctgggtgcaggtgtatgagctgtggactctggacgcatggggcactggcagcatgggaacaagcaggttactaagaaacctcccaggagtattacagaaatggggattataaactctctcaagcctggagcttgtgaaaagctatggcaaggttgctgcttcagctggtggatcccctgcctgggaggggaggggctttgggtccagtgcagccaaggcgccccaaggggtgtcactgaagtgtgggtgtgaagaaagcacccatgcccagcccagcagagccctgcaggaagctgccagcaccttggctgcctcctgggggatgcttccaaatggccacgaagagaaccgctgaagaagggctagagggaggcgggggctgccgcagcacggcccactggcacacagcgctgaatgctattttgggattctcatactgagattattgcgaacctgtgtaatgggaaaagagctgtgtgtcaaagcggaacccccttcagggctgcagctctgggtaaacaagtggagaggccgaaaagaggcctgcagcagggaacgagggggctgggaagcaggccggtgctttcagagacatgtttaaaaacgacacttagttggcgaggcgaggtggctcacgcctgtaatcccagcactttgggaggccgaggcgggcggatcacgaggtaaggagatcgagaccatcctggctaacacggtgaaaccctggctctactaaaaacacaaaaaattagccgggcgcggtggcggacgcctgtagtcccagctactcgggaggctgaggcaggagaatggcgtgaaccgggaggcggagcttccagtgagccgagatcgcgccactgcactccagccagggcaacagagcgagactctgtctcaaaaaaaaaaaacacttagcaaggatgccccttccccgttttaaaaattaattaattaggccctgtgcagtggctcacagttgcagtctttgtactttgggaggctgaggtgggaggattgcttgaacccaggagttcgagaccagcctgagcaacatagtgagacccccgtctctataacaaaattaataaataaaataagtaatctttttttttttagagaaggggtctcactatattgtccaggctggcctcaaactcctgggctcaagtgatcctcctgccccagcctctggcggagtagctggaactgcaggctcaaacctcagcccctggccccaccctgtttttttggttgttggactttcttttctttctttctttctttcttttttttttttttttgagtcaggatttcattctgtcgtccaggctggagtggagtggtgcaatcatgtctcactgcagtcttgacttcctgggctcaggtgattctccaacctcagcttcccgggtagctgggactacaggcacgtaccactatgcctggctaattttttgtacttttagtagaggtggggtttctccatattgcctaggcgggtccaccctgtctttaaaacaaagcaaaccctctgaataatttgtcagttctttctctctctctcctaccaggcccaaatctgtagacaccttttttttttttttgagttggagtctcgctctgtcaaccaggctggagtgcagtggcatggttttggctcatttcaacctccacctcctgggttcaagtgattctcctgcctcaccctcctgagtagctggaactataggcacgcaccaccacgcccggctaatttttaaatatttttagtagagacggggtttcaccatgttggccaggctggtctcgaacccctgacctcaagtgatccgcctgccttggcctcccaaaatgctgggattaccggcacgagccactgcaccgggcctctgtagacatcttgatgggctagggaattattaggaggattttgctgggctcatgcaatgccagatagaccaaggtggtgtcacttcccagctgaaatccatctgcttagccaactcagcagggaggaaggcacgttggtaggttgatgctgacggcagttaaagtgtgtgccctctgagaccttcagcgagctcccaaacaggcaatagaacacagtggaaattgcagctgccaggaaacaggaaacctctgcttctgcctgtcctcttcgcgatggaagaggctcagtgaattgaagctagttaccccaccttctggcttagaaagcggaacctgatttctggcgtacttctgggtaccttcttcctctttccaggaacccagaaagatgcgtggaaaagacatgaaaggccccattgctacttaaagaatggcctgcatgcatttagtaggttttacaaccatctttattaacagggatactagagaaagccatcctcctatttcaaacccaagctctcttcttttatttcccgcatagccactgctaccatgtgtgacttacctcaaccctaatggtgatggcttctcccccagccacactggcacccgttccttatgactctcttggccaaccagcccttgtgctcagctctaaacttccatgagatcagagttccagcttctatgccatgtatttttaaaatatcctgataatagcttatatggcacggagctttaagtaaacacgtaataagtggctgatgtatggattaattggtagagtgttagagctaaagaaaataaaacaacaaaaacaatagtaaaaaaattatggtgtgtgccaggcactgtctgaagtacccaaatgcttcatctcctttagttctcacaatgaacctgtgaggtatatgctgttattattctctttttttttttttttttttttttttttgagacagagtctcactctgtcacccaggctggagtgcagtggtgtgatctctgctcactgcaagctctgcctcctgggttcatgccattctcctgcctcagcctcctgagtagctgggactacaggcgcccaccaccatgcccagctaatttttatttttttatttttttatttttagtagagatggggtttcaccattttagccaggatggtctcgatctcctgacctcgtgatccacccgcctcggtctcccaaagtgctgggatttcaggcgtgagccactgcgcccggccttattattctcttattctaaagatggggaaacagacttagggaagctaggtaacttgccgtttctcaccagatagtaagtgacggagccaagactcaaaccaggtggttttgactccagaagtgggatccatatgctggcaagctccctatatgatacattctttgcatataatatgtccctgtatacaatatgctgccataatattggtgtggaacttcaggccaggaaagtgacttgctagggtcccccagttagtggcagagctgttggatctggactctggctcctggcccctttactacatcacactgcctcttgaggattcctgccagcctgtgtccacattccaggcttatctccaagagaagccgggttggtagctctgggtcagatggtggcctagggacttacagacttacagtccagttgcccaggtgtgagccacaaccaggcagccaaatttgttcctgccaggtcaggggactgagtggagtgaggctggcgtagcttatgcctgctgctcccaccccctatagcccagcaatggctccctcccaccagggcctctgtggagcccatggtcaaggcctgggccagcatcctcagaagtgtgtgtccaggtcccacctacatgcctgtgggccctattgatgtggtcagctcccattctctgctacaagtcccaggacagcagccctggtatacatcgagccagtcagctccacgccaatccagcagcacaaggcagtgggagcagcattagaaaaactatctggggctgggcatggtggctcatgcctgtaattccagaacttttgggaggccaaggcgggcagatcagtcgaggtcaggagtttgagaccagcctggccaacatggtgaaacctggtctctacttaaaatataaaaaattagccgggcgtggtggcgctcgcccgtagtcccagctcagtcccactcaggtggctgaggcaggagaatcacttgaacctgggaggtggagcttgcagcgagctgaaatcccaccactgcactccagcctgggcaatacagtgagaccctgtctcaaaaaaaaagaaaaaaaaaaggaggaaatactatatagcataagtggttgtttttttttcttttccaaagtgtagggaggaggcagaagtggcgggcggtgaggaaacaaagaagaccacaaaaccaagctctaagttgaactcaaaagaagccatgggcgaaggcagtgggcaggagggtgatggtggcagctataagaaggggcccctccaagctgtgccaggctggcctggcctgatggtgggagccaggagtgagcagtattccaaatcagctctgaacactctgcagggacacaggcagggggcaggtgctggctctgcttggagctctcaagagagaatgagagctgcatcggaaagcgacaagtcaggttgtcagaaaggtgacagttgtatgcagtcaatagagaagaaactccctgtgactgtccaagacgaggcactcagggttgctttgaggcacagccctggggggaacaccattcccaaggagttgtatagaatacttggactcagggttgctgaaaactagaacaggtcaaaaggaactgaaaggcttcttgtcccagtgaaatagatggggaagggagaagcagactcacattttatgctgcatttatttctccatccactagactgctgtattttctccctctgtcctgcagatatgatttggctatcaaagaccttaaagaagccttgattcagcttcgagggaaccagctgatagactataagatcctggggctccagttcaagctgtttgcctgtgaggtaaggagaacagggcctggcctgggcaggaggggatcatggctggatggatggctgacagttcagatgcacagtgatctgttgacacctccaggagcttggaaaagccattttgcctcctctgccttgagactcagattttccttgaagaaaagactgagatggattatttcaggctcatcaaggcattgtcatcagttacctgggggcatacattttattaatgtgaagcgcaaaggaccatgcaaaaatgagccccctgggctctctgaagggaggctggacacgagtgtgttggcttgtggaaatattcatgataatttgcatgttttgattggcacttcagattgacaagctatttgttcagcattttgctagcaaatccaaaatcatgagttcattgtccgtgcaggacctgccagaagcttgctcagttcccaagtttatagaccacactctttactatccatggttcttaccccatgtacttgattgatacctaaagagagactgaggataatttggcataaatctgtcccctcttgctcaaagaacagctcaaggcacatatttaggtaaaggtttctgcaaaacaacttcttttctctattatcaaaagggagagacatgactggctttgactttgcaggttcatttactttttccggttggtccttcccacccctcccacttccaaatatatactagcagttttgaaaaccaaaattcctgtaaatgtcaaagacctttctttagaaaaatcactgacaaaagtccccttgctttagtttctcaggcacaagaagtcaagtgttcccagggtcgctcagggctaataatagagtctgtagccgccctcggcccctggggacatatggccccatcccaaccctgcagcaggctagcaactaacttcacgtctcacagtctgagaagatggggctttgcagttggaattggctgccattcgaccaacttctcgagtaaggtttctcagctgtagctctgttaatatgttggaccagacaatcttgtattgtagcagaggcgagagaggggttgtggtgcatcctgcgcatcgtgggaactttgacggcatctctagcttttagatgctactagcactgccaccaccactccccacccaatgtgacaacctaaaatccctccagacattgctaataagccaatgacagccacttatacagattagaaagttgggggacaagtggctctagaaaaaggattatgtcacagcagcatcaaagtacagttccatgggaggaatgtttcccctggagttggggttaaaatggccctgagaggacagaaaatactggctgagtggccctctctgcaagtaaagctgaacttttcagggtctaaggccctctttgtcacatgggaccttccagtcatttccctacttataatccttctcttcctgatgtggtatgaccctggcttctgagaatcacatcattatttttgaagagtgtcaaggtttttctcatcattagttcataaaaactgattgtagagaaatgtcttaagagaaggtggctgagaaccaaataggaaattttaaacgatctgagttctttctttctgcacacaaggtcaggagtgggctggagaagccaacgaattcagaaggcagtagctcattgaatctcagaaataggactgaaaggagtccagatttccacttccggggttgatcctggcccccaccattcagcaccagccactaatgccacagaaacatcaatccttccacctgtctgagtttggcaagttcacgtcattgttggcaggaggcctcagttcttcgctacatgaacttctctctagggctgcctaagtcttgtcatgacatggcagctggcgtctctgagagcaagtgacccaagagcaagacagtgtcaatgtcttttataatctagcctcaaatgtcacaccccctaatttccataatatcctatttaaaaaatttatttcagtcgggccattttttagatcttggtaatgcatccaaacgattatttgattctgtgtgtaaattgtgaagcacaatagtaaaatagacactcaagaaccacagcccaactcaagacctggaaaagtatgacactgttgcatttaccattccccccccacctgaggtgaaggtgcccctggcttctgtgctaacctctgtcttctgggttcaagcaattctcctgcttcagcctccaagtagctgagattacaggtgcctgccaccatgcccagctaatttttgtatttttagtagagacagggtttctccatgttggccaggctgatctcaaactcctgacctcaagtgattcacccgccttggcctcccaaagtgctgggattacaggcatgagccactgcgcctggcctgtgttgctacattagtcttgttactcacatggtctgggccaggttctgctggtgctggtacaggaggttgcatcttgatccatcttccggctctgtacctgtccagtgtttcagcctaggtacagtggcaggaggtggactggaagaccacacacctgtattttattcccaaccctgtgtctgcctctagaaggggccttgagcaagtcactcttttactaaagcaactcatactaaaacaacacaacaattcttcttcttttttttaacctggtttgaacacactgtatacaataattcttgtcccttcctgacctatttcgttgttggaagagtacaaatgatgttgcatttacgcattccatggtgttttcttaacaccatgtttgtgtttgacataactcaatagcaagactaattgcactatattttagatattcccaggagagctgagaaagggagaaaggctaccaggcaacattctcagagtatacgtgtgagcctttccctggcaccttgatttggagtagtctcaagttttatgttgcggtctgtacttttctaggtgttatataacattgctttcatgtatgccaagaaggaggaatggaaaaaagctgaagaacagttagcattggccacgagcatgaagtctgagcccagacattccaaaatcgacaaggcgatggagtgtgtctgggtaagcgtattggtgatgcaggtgttgagaggatgtcactggattctcatttgtctcagaggacatgccattgagaagccataaaagtggtgcttttactttctgtgagtctgggtaacactgatcttagggtatagttccacttaagatcttgaatctgtgctgagaagctgaggcctagagtatgggatggcagagccctggcatcacaccacccttggagtggggctccttggcaatgcaggagaacaggatattggatgctggagcagtgctgcacagactctaagcactgagagggcagagtccatgtctgcttgatcaccactgagtcctcacagcctggcacagtgctaggcacataacagctctcagcaaaaatgttttgttttgttttgagatggagtctcgctctgttgcccagcctggagtgcagtggtgtgatctcagctcactgcagcctctgcctcctgggttcaagcaattctgctgcctcagccgcccaagtagctgggattacaggtgcatgccaccatgcctggctaatttttgtatttttaatagagacggggttttgccatgttggccaggcaggtctcgaactgctgacctcaggtgatctgccctccttggcctcccaaagtgcagggattacaggcatgagccaccgcacctgcctaaaatatgttttgattttgtgaatgagtgataaaaactatttatcgttcaagcatatttgtgaataaggctagctttaaatctgatttttaaaacacagagaagaggactcaagccagtctttatatgtctatcctcatcagcaaacacccatccaagggagcactgtcatgagccttgcttgatcccgggccagccttgtcgtggtggtgccctctacaccatgagagaaccccacggacagcacacagagtgggagaggagcagttcctctgggaaaagagggtgctgaatagcaacaaatagcagcaatgtccatgtggcctcgcagcagaaggtggtattgaaaccaagggttcctaccttaacaccctagaggaatgacaacactcatttggaaaagggcttctatgtggttatctcaatgaattcttgcatctattcactgagggaggcaggacaagcatcgtcacccccattttcacataagggaatgctacgttttctgtgttacagaagcagaagctatatgagccagtggtgatccctgtgggcaagctgtttcgaccaaatgagagacaagtggctcagctggccaagaaggattacctaggcaaggcgacggtaggtgggattgctcagcttcccctgagtctcctgtggcccgggccatgtggagcaaggtgggagggactcttgagaagagggtagcctccttgtggctctgtccctgggatggcaatgagagacttgtttataggacagaggtttggctgaaagataggcaaccatgtctagtttattttctccaagctgctcccatttctcccttccagctcgaccctgggtgagagccacagggttactcacaggatgctgagtcttagggactgagccaatggagggaaaacacagccatgaggagctcactaaatgtgaagagagggccaggcagggtagctcatgcctgtaatcccagtgctttggaaggctgaagtgggaggatcacttgaggccaggagtttgagaccagcctagctagtggagaggctgaggtgagaggatcacttgagcccaggagttcaaggctacagtgagctatgattgcaccactgtactctagcttgggcaacagattgagactctgtttctaaaaaataaaaataaatatgaagagaacatgttagggaaagagatcagcatgggatcctcttggattaatgctccttgtagttcacgttttagtgggctgaggagtctttccccacttccacagccctatgtttagactatgtcttaaattggacttcttctaaatccaggtcttggctgtgcatggtgactcatgcctgtaatcccagcactttgggaggctgaggcaggtggatcacgaggtcaggagttcaagaccaggctggccaacatggtgaaaccccatctctactaaaaatacaaaattagctgggtgctgcggtgcatgcctgtaatcccagctacctgggaggctgaggcaggagaatcgcttgaatccgggtggtggaggttgcagtgagctgagatcatgccattgcactccagcctgggcaacaagaatgaaactccatctcaaaatagtaataataataataaatccaagtcttaaattctttcagacatggtctgaagtgagtcagcagtgcccttccaaaaccacatttgacttgacacattcatagggctaaagttgcccagtggtcgggtagctgggtctagcatagcagcagaggtcaagaaagcctgggtgagtggaagccctccaaatatctatcaactgatgagtgagtaatcaaaatgtgatatatccatacaacagaatactacgtagccataaaaaggaatggagtatgattcatgatacaacatggatggaccttgaaaacattatgctatgtgaaggaagccagatacgaaaggccacatgttgtacaattccgtttataggaaatatctggtgcagcctctaagcactgagagagcagagaccatgtctgcttgatctccactgagtcctcacagcctggcacagtgctagacacataacagctctcagcaaaaatgttttgattatatgaatgaatgatgaaaattatctatagtttaagcatatttgtgaataaagctagctttacatctgatttttaaaactcagagaagagggctcaagtcagtcacagaaagcaaaccggttgttgccagtttaggggaaaggggagtgtggacacactgcttaatgggtacagcattttcttctgaggtgatgaaaatattttggaattagagagaggcagtagttgcacagcattgtgaatgtgataaatgccactgaatcattcactttaaaatgattaatttgggctgggcgtggtggctcatgcctataatcccagcactttgggaggctggatgggtagatcacctgaggtcagaagtttgagaccagcctggccaacatggtgaaaacctgtctctactgaaaatacaaaaattagccgggcacagtggcgggtgcctgtaatatcagctactcgggaggctgaggcaggagaatcacttgaacctggaaggcagaggttgcagtgagctgagatcacgccactgcactccagtctgggtaacagagcgtgactccgtctcaaaaaaaaaaaaaaaaaaaaaagataatttgatgttatacaaattgcacctcaataaaaacatttcttttttaagagagaagaaagcaagcctgtgttagcaggggtggggtgaatgctcgtttcttcagttgctgaaatcctaatccagaggctcaggaatctaatccttagttactgtccacgtctgaaaccaggctcacgtaagaacaggtctagggcatgagcaaagagggagacccagaagaatggaaacagtgctggcagagcctcacaccctcctgtccttgattttaggtcgtggcatctgtggtggatcaagacagtttctctgggtttgcccctctgcaaccacaggtaaggcagtcctgaccttctccatggacctaggtctcgagagctttctgtgaagcattcaattcgagagactatgtgtgctgagttgcctgattgtaagggctccttcaagtggccctcagtgcagctgagggatctgcctgccctctctcagtcctggtttccatggctggtgaggaaataaggcagtgtcaggcttcaccccaagtcctctgaagctaactctcctgcttccccacaaatgccggtcttcacatctctaaagagatctgctgatcctctctctgaagcctcaactattctctcaggaagctgaaacacaagctatggaaggcttattaacaaagcctcttcttgagtacaggggcaagtggggaaccctgtggggcctgggcctgaggtttgggctctcctggctctacccatctgctcatgtgcaggggtttccttcgggaacacaggcagagcactgagagtgaaccctttttctgcccaagctgggcttggagaggtgagctcagatgaactggatgatagtggatctagaaatgcacacagagcttccttgtgaaggaaagaggggaaaacacattaaggaaaatacgaactctgtggcaatgaacctgtgatgggcaagagtgttggtcagcactagcagagggcggttttctgagcaggggcaggtatgttccagatctagattccttgatctctttcttcacaataaagctgatgaaagccttgctgaagtcccttgagcttcagttcagccagaggccatgaggggaacgcagcccaggtaactggattccatggtattcagtgtagaacaggggaggagattcttgcccagtcagtggatcctgtgtcaattttaaatactcagaagtggccaggcacagtggctcacgcctataatcccaccattttgggaggctgaggtgagcagatcacttgaggccaggagttccagaccagcctggccaacatggtgaaacccctgtccctactaaaaatacaaaaattagcagggtgtggtggcacatgcctgtaattctagcaacatgggaggctgaggcaggagaatcacctcaatgagggaggcagaggttgcagtgagccaagatcgcgccactgcactccagcctgggcgacagagtgaaactccatctcaaaaaaaatttttttttaattaatttaaaaatactcagaagtgtcatgtgacatagtagacattaattacagaacagagcttttggaaactgtcctgggaaaaggacagagctcaaggtcaaagcattcttgtgacaccatgttgctgtgtgactgctaacctccagaaactagctctggctcaaaatgaattgctgtgctagtgaaacctgtacctggggagctggtgggaggtgttatttcccagtgtttagtcagggtgactgtgccctcttcctagacagtgttctcatcagtcagaaatgcgttatttgattttctggtctggaagaatgctcaaattaccattagccgtttgttgtctctcccctgctttccctcattgccttttccgttttcacttctcctgaatgttcaataggcagctgagcctccacccagaccgaaaaccccagagatcttcaggtaagttagattcaaatccataaatagaatatccaagcgccaagcctgagctgatggcaagaaagggagggaagaagatgaaggtggggtcagggtctaaatcttgttgaattttctggaatgtcaggcttcttctagaatgtcaggctagaaaggaatgcctagaagaatgtcttctagaatgtcaggctagaaaggaatgatatgatggggatgggagtcttgactgtggtggggctggccatcagggcctggctgcagctacgtggtgtcccattggccctctgtccacgtgcacagccacccacatggcaaggggttgttgctgaggggcagtggtgtcctgtggaacatagctaccctggggaccaggatgctgacctcaggttggagatcggtttcgcactggctgcagtcgcctctgacgggggcaggccagagctctctggagtcaggaatctagaatgacgtcctttttcctgtgtggatgttttccactccctatcggcacatgctttctgaagaagtaaagaggaaggactgaagaaaaggaagtccttcttctgtaagatgaaaaacaaagggtgacataacctacagctttcttaagaattctctcaaagtgatgaagcaagcctggtcctcccacccaaaaaggaggttttaaaaagtgattggccaggtgtgtggctcatgcctgaaatcacagcactttgggagactgaggtgggcggatcacttgagatcaggagttcgagaccagccgggccaacgtggcaaaaccccatgtctactaaacatgaaaaaattagctgagtgtggtgactgacatgtgcctgtaataccagctacttgggaggctgaggcaggaggctcacttgcactcaggaggtggaggttgcagtgaaccaagatcatgtcactgcactccagcctgggcaacagaccaagattccgtctcaaaaaaaaaaaagtgacaaaagtaccaaagcaactacaaaaatgagggggctggatgagctcattcctaagctccctgtcagctggaagggcctgtattccctacaggagtaggcacgatgtctggaaacaaggatgggccgaggggaaagtaacagagtggggagtaaagggagggaagcctgaaacctgaacaccagcctctcagtcacacgttccaaagtgatgccaatcagagcctcaaagcctaaaagcatgaagtcagacttaagggaaccgacactgcaccacggcagctgggcagcctcagagccctctatgtgcatccctcacgctccctgtcacctaccctgctcacggtctctctatcctggcccaacactggttctaggtggtttctccttcctcctctcccaccaatctttctggcccagctggctctcacctgacttctgctttgtgctgttcccctgaccacagtcacctgatccaccccaccccagcccagccttgggtgctggccaagatgacacagccagggaccttcctcctcagagcagaagggagggcaaggattgtaagtcctcactatctagtgttgtggggtttttgctttattcttgcccctctgcatatatggttatgagcaggtgtacaccagtttcttgctgagacctcttgggagcccaggcaggctcagtgtcatctcggcagttgcagttagatgtggagttagagccaggctggagccaagtccctggctccaagttcagtgtatttgcgccatggcatcatgtgaggggatgggggctggatcttgtgtctatcctctgcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcaggtatgcagaggatcaggggctggtgcgatgggcatgggatcctggcagcaaatgcagtctctgtggagcagtatctgctgccttctttgcagaccagccaagttcttttgtctgttcgtcatcccttccccaggactctgggctgttctgtggtgtgggtactgatgagcacatctttattttttcctttctgattctgtggtgctgcactgcagaaggggcttgttccctgcaactaccttgaaccagttgagctgcggatccaccctcagcagcagccccaggtaatgtgatgccaaggcctgacccatttcctctcaccctttagggatctctccctggaggggagaaaagcagtgtaaaagaggtgttgtcaggacccctggagaaagattcactagtcttgagcccgccttgagatggcaccagctacccagagctgaacctgggaatgaggggaaaaaagcccagatgtgctaagttggaggcatctgtaggtcccattgggcccacccacctctgtgactcttcctggtcagaagtcacttgggaagcaaagcctacagtatatgagtgggttaggtcttcccaagtgtgtctgcttcacgtggaagagtagtcaatgtgttggctggtacaatgccattagaaagaaaatgaggccagctgcagttgctcatggctgtaatcctagcactttggaaggctgaggtgagaggatcacttgaactcaggagttcgagaccagcctgggcaaaatagagagatgccacctctatacaaataaaaataataaaatgagatctgccttagagctttgaatcagagtgggccttgccagccactgcttctaaactgctgctactccctccctcacacttcaaaagtctgtccttctgccaggcctagagagctgtctttgtcagatctgagcatccctgtaagtgactcaatggcagtggagactgtctgtctctagactgtgcaaccagttgtatatgagctcagccctccctggtcagtcaccatatccaaatgctttgaaaagcttcaaatgccttgcaaatgagaagtggaatttttcctttctcaatgccctctgcagtggagacaagagctcagtcctgccccacggccagtggatttccaatatggctgaaagagttgctaaagcggcaagggcgttttagcgggttaggattcttctttctactgtgattttcattttcatcaggccaactccacctcctcttttggccaacatttccttcgtcttccccaaatgtcactaccattccaacttttaggacgttatctgcatgtggctcctttacatggggtctctgtaggggtgtttccccacatccacccctgcctgggaactttgaatgaaggttctgaccgtcgctccctgttgccttcaggaggaaagctctccgcagtccgacatcccagctcctcctagttccaaagcccctggaagaccccagctgtcaccaggtgagtggtcctggagccacagcctaggtctgggtgcagcagcatgccaggctgcttcctgagttcctctccctgccttccaggaaattctggtttcttcttctcccaacatgtcactcagctaatgaccacgcagccccagaatccccctttcctgcaccacccaccccaaacatgaaatcagtgccctctctccctgccttctgcagaacactcacggggcttgggtgaatgcagctggttcctgagtgactcacgtagtcaccaaaccccttgatcattaggtagggaaaccatgtctcaggaagaaaagttgaagtaactatacctgcttatctctgaggggcatggagtggctgttttcaaatgtctgaggcactgtatctggaaaagaaattgctctgtggagccctgaggatgaacaaagaaccaatgggcagatgtgaaatggaaatgttctctctgaaaggctgtttcctagtgtggagagggctgtcttgggaagtgcacttgaagcagattctggataagcgcttggtagagacgcagagtgagtggttggccagattctagatcaatgattgccacacgcgcctgatcatcagaatcactcgggatgtcccttcccccatttttattttgaaaaatgtccaacctacagaaaagctgacagtagaatacaataaacatcagaatatctttcacttaaactcaccaattgttaacattttgcaccatgaactcgccctgctccattctatttttctcccccgagccagttgaaaagttacagactcgtgacacttcaccctacacagctgcaaaaacgcagtctcctgcataatcacaatagaatcatggtatctaggacactaaacattcatatgatagtattatataatgtatattccatattcaaatttctcccattgctcctgctcaatgtccttgacaggttttttgttgttatcttttgtctagaggctcatcaaggatcacatataaacctaggatgattttgtgaatacagagtcctaggctactggctctgatattttaggactggaatggggctcgggaatttgtattttagaaaaaaacttcccatgtgattctaatgatcagctaggtttgagatcagtggccttctctgatcatgtaccccctatagtaaatatctttatgcatgctactcttacataaattagattaatattagattgcttgattaatagattagattaaattaataaactttaggaaacatacacaaaaataaagaataaggtgaggatcagtggttctaatacttcttcctgtggcctctggctcaccttgcactccgattttcattgctttggatcccgtgggcttaattgacctttgggatccctgctaaccttgtgggttggtgaggatatgctggtcctttggtaattacctataggctccctagaagcagagactgagtttgttcatgtgttcatgaccttcatgcttccccagggcgagattttccccacagtttactaaggttaataattgccccacaaattaaagggtaagaggttgggggccctatttgaagaggtttcatctgtgtgtggcaggggctggccaaggatgttcattcaccatcttcttttgttttactccctactttttccattcaggccagaaacaaaaagaagagcctaaggtaacatttttccctcatactgtttcaagtggtagaagatgggatagcttgggctatcaaccacagacatgtctgtctggattataggaagagccccaaagggagggtcgaaccagttgctaccttacagagtccatgagctagggaccttcttaatagcctcctccactatcatgcacacacttcctactacccaagctagtgggccagatcttactcagtaggaattcctgtccaagcaagggttgggctaaaggacctctgaaggccttttaggctactgtgaaaccagttacttactggcctctcccctgctgtattgggtaccccctgtgccaaatcacgaaactgcggtgatccaggatgttgagagaaagcctcagacactcaggagttccctttgtttcctccccactcaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgaggtgagctccatgcaggcagctgtgaggggtacagtgggaaccttgtgctggcctggaggagggaagaggaggatggtttttgtgatgatgttctttgactggattcttactcattatccccacccagctatcggcctcgggacagcaatgagctggtgcccctttcagaagacagcatgaaggatgcctggggccaggtgaaaaactactgcctgactctgtggtgtgagaacacagtggtgagtgcaatgaggggcatctaaagttacatttccactgagccacttcctcaacaatttgaaatttatcaagcaccttctgtgtactaggcactatatgtggtgttggggatatggtgtgtaataagtcacagctctgcctcccttttacctgcatcctcaccccatttgcagcagggagagagtttcccacaagagaacagcaggcccagcagggcaggagctcacagaaagcctcctgcccctccatcagctccctgcctgactgtgtcaaacatcccatccattactgtcaagcaaggttggaatgaagtcatatcatagcttaaggctcagctcatagccattcttcaccttttttttttttttttgagatggagtctcactctgtcgcccaagctgggtgtgatcttggctcactgaaacctctgccgcccaggttcaagaaattctcctgcctcagcctcctgagtagctgggattacaggcacctgccactgcacccagctaatttttgtatttttagtagagacggggtttcaccatcttggccaggctggttttgaactcctgaccttgtgatccacctgcctcggcctcccaaagtgctgggattacagacatgagctgggagaagaagagtgaaagagaatgagcctagaaaagggcagtgtataaagctgtttaaggtatcttccccgttcagaaaattgccttcaggaaatacagccactggggatgagactccctggtgtctctggctgagacaaaaggccccaggatcctgggggtaagagtgagtgtgagtgtaaggggtctcttggaagtctgaaaagtcactctaggttttccagctgtctgtctttggactaaccccttcagcatcttttttaaaagattcttcctagaaggagttctgctctaaatgtgaactacttcacttaaacttttttttaattaaaattttttcctttgacagcagcttcaatctatttggtggctgcacatagccaaccctcttacaactccccacaatcttttgcaatttaatccaggctcaggagtcactgttgaatgttctttatcactatccattacttttggaggcaacaaagcaggctttcacttactaggagaaagaaaaccaggcgcagtggctcatgcctgtaattccaacactttgggaggctgaggcaacatggtgaaaccccatctctactgaaaatacaaaaattagctgggtgtggtggtgtgcacctgtagtcccagctacttgggaggctgaggcagaattgcttgaacccaggaggcggaggttacagtgagctgatatcataccactgcactccagtctgggtgacagagagattctgcctcaaaaaaaaaaaaaaaaaaaaaagaggcctggtatggtttatgcctgaaatcctagcactttgggaggccgagatgggccagatcacctgaggtcaggagtttaagaccagcctggccaacatggtgaaaccccatactgtactaaaaatacaaaaaaaaaagaaaagaaaagaaagaaaaataaaatgaactaacatttattaagcatctactctatgcaggaacacttaccattaaccaagtctaaatatttatacatatttagaagagtactgccacagagtaagtgttcaataaatgtcaactactattattgtatgtcatctcattgaattcttctagcctcaatttcaggtgaggtaactgaggttctgagaagttacactgcttgcttagggacacagagctggtaagcagtggaggtgggatacaaacctttctctgtggactctctagggccatttccacctcattgtattgcctctcaataaaaatataccaacgttcaacaaacaacattaagaagctagaacttataatgctcggtacatacaagcctagcagcatttctaatgttgatttgttaaattctatgattcacatctgtagaaaccgcatccttctccttcatttgtgaagcaaaagtgacaataatgtggaagaagtctaagatcataagtctaagatgtataagaaatgttgttacagataaaacaagtatggcattgtgcagtggtttttgaactttagcaagtatcagaattccctagaggacttaaaatacagattgcaggattcaccttcagggagtttctgatttagtagttttgggatggagttgaaagtctgcatttctaacaaggtccctagtgttgctgttagagttgatgctaagaaagccagttttgacttagggctctgtccccatctgtaaagaaataataatgcccattctacctgtctcaagattattgtaaggtttcagtaagatattttaagactgtatatgattttgcagaccttttggtttcatttatcccaggggtccccaacctccaggccacgggccagcacagggctgcacagcaggtgagctgcaggtatactggcctgagctctgcctcctgtcagatcagcagcagcattagattctcataggagtgtgaaccctattgtgaactgtgcatgcaagggatctaggtcgcatgctctttatgagaatctaatgcctgacgatctgaggtggaacaattttatcctgaaaccaccccccaacccaccacccaccaccattcatctaaaaactgtcttccatgaaactggtccctcgtgccaaaaaggttggggactgatttacccaaccatccagtattcataaagagcatataagctctacacaaggcactgatcacaaactttatgagtttatatcccaggttctactttgacatttcgctgtttcctttagtgatgttcagtgttcacttggcaggaaattgggaaaattaacaggccctttattatttcagggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaagggtaagtgctactccaagactatagaaacaaatttacatgttagcagaaacaaggtcaagggcagagagaagaaaatatcaataatctacaaacaaaactttagccagtgttttcaacccccttcctagcatctagctggagggagcaaagttgagcactcagactttccctgtctattgctctagtagccaggaaagcaacaagaagctgagttgttttgtttttgtttttgtttttgagacagagtccccctctgttgcccaggctggagtgcagtggcacaatctcggctcactgcaacctccccctcctgggttcaagcaattctcctgcctcagcctcctgagtagctaggattacaggcgcccaccaccatgcctagctaatttttgtgtatttagtagagatggggttttgccatgttgaccaggctggtctcaaactcctggcctcaagtgatccaactgcctcggcctcctaaagtactgagattacaggcatgagccaccgcacctggccggcgataaacatcttgattattaaagaggagtatgctttggaaaccatggattctcattcccagaggtaacaaattgggctggaatcactttgcctttgcatcaagctgtatgaccttctgcaaaccatagttctttgaattaatgtacttttcaaagagaaaagtaggtaaattttgccttaaaaaccagctattcagaactatcctgtgtctctggtgactttcttgattctgtttgtaatgaacagactaaaaattgaaacagcatgcctgtaatcctagccactagggaggctgaggtaggaggatcacttgaggccaggagttcaaggctgttgcctgggcaacacagcaagacccacctcttaaaagtggagagttctaagaatccctggaagagtttgttaaatcaattcctgggcccaccctccagagattctgattcaggtctggggtggggcccaccaacttgcatttctaccaagtttccaggtgatgctggtctactgcctacactcttaagaagcaccattccaactcgtggtttgccagcctaattctctacctcgacacaaaaaagtcccatcataaaagccctgctcatacgctgagtctgtgcactaccaatgcaaagcagtgaaaaactaccatcaattataacagaaaatccaacagacaaagagagggggaaattttaaagttaatgagggtaggctgggcgtggtggctcacacctgtaatcccagcactttgggaggctgaggtggtggatcacttgaggccaggagttgaagaccaacctggccaacatggtgaaaccccatctctactaaaaatgtaaaaattagctgggcgtggtgatgcacatctgtagtcccagctgctagggaggctgaggcaagagaatcgcttgaacccgggagtggaggttgcagtgagccgagattgcaccactgccctccagcctgggtgacagagcgagactctgtcttaaaaaaaataaaaataggccgggtgcagtggattatgcctgtaatcccagcaccttgggaggtcaatgtgggctgactgcttgaggtcaggagttcaagaccagcctggccaacatggtgaaactctgtctctgctacaaatacaaaaattagccgggtatagtggtaggtgcttgtaatcccagctattcaggaggctgaggcaggacaatctcttgaacccaggaggaggaggttgcagtgagctgagattgtgccactgcactccagcctgggttacagagtgagactcagtctcaaaaaaaaaacaaaaacaaaaacaaaaaaattaaaattaaaaaaaaagttaatgggggtagagagagtatacaacaagtgtgtagcaattaattaaaaatatgagtagtataggctgggcgtggtggctcatgctggtaaccccagcactttgggaggccaaggtgagtggatcacttggggtcaggatttgagaccagcctggccaacatggtgaaaccccatctctactaaaaataaaaaaattagccaggcgtggtggcgtgcacttgtagttccagctccttgggaggctgaggcaggagaatcacttgaactagggacatggagcttgcagtgagtcaagattgcacctttgcaccccagtctgggcaacagagtgagattctgtctcaaaaaaaaaaatatgagtagtagtaatatagaagcagagtgttccaacaagagagaatggtaactcagtgggaagaactgggttgaacacctccaagtgccactttaaaggtgcctaaatcaaccaaccagctcaattgtctggagtttgggagagggagcaggaatacaatgaaagaacacactaaaacaaccttttgggtagatatggagagaagccagtatgcgtcttactatgacctatctgtacaagtctaagttgaggaaatacccatattgtagcacttcaacagaaaacagaatttagcggtcagggtaggacagaggggagttcaattgcattcaagttatgagatggtctcatctacaaagtgtttctcaaactttaatgtgcatgtgaatcacctgcgaatcttcctaaatggattctgactctggtttggatctgggatttttcatttctaatatgcttccagtccacgacctaccctgtaagaagaatcaagacagtgatttgcagttagaattacctaagggaacttttgaaaaaactgctgcccagtcacaccacacattaaagcaaaatttctgggggcaggatccaggcaccagtgccttaatgtctgatctagatgtacaaagacaaacttctgaactggctgtgtggtcaggtaggtgggctttggagattatacctaagttgtctgatttttactggcagaatggctctgaacaaactattcatctctctgggtctccttttccttagtaaaatatggatacctacaagttattatgaagtctgaatatattttttaagtacaatgcctgcactctattaaaggctctgagtaggagctattaaaatatttatatttaacaaacatgtactaacccatcactagctccagctcacctgtttaatggagttcagtgaaaagaagaaagtttactaaagaactttcatttttaatatatttaaccaatggcatgtcccttttctgtagtcaaaacaaagattcccaacaaagcgcaggtaaaattctctcctctcttaaaaaattgggccaggcacggtggctcacccctatcaccacagcactttgggaggctgagttgggtggatcacttgagcccaggagtttgagaccagcctgagcaacatggcgagatcctgtctctaataaatacaaaaattaaccaagcgtggtggcacagcctgtagttgcagttacttgggagtctgaggtgggaggattacttgagcccaggaggcagaggttgcagtaagcccagattgtgccactgcactccagcctgggtgacagtgagaccctgtcaaggttgggggtggggaaaggacagaaattctatttaaggattcgttgttcaatttctttgacccttcttctctatctggtaactttttgaaaaacataatttatccttcttcattttgctcattatcatgtttaagacagatcaataagatggttaaaccctgtgttcactctcaaaccactttgcaatactgtcttttccctgttgatcacaattaggggtggggaagggtgaccgataacaaattctgtgtggaatagccagacagggtaatcttcctacagtggttttagaaatccatgtgtacttttccttttatcagtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttcattatgtcttgttgcttaaacagaacctagactgagttaggttctcatggactacaacactcaattccacagagaattaatagaattacatacctttgtacattctcagagaggaacatgtgttaagaactcaatactgaatatatatcaatcgccaacatttaagtgatgaaaagcagcggtgttcatgaagctagttcgtaagtagtatcttgttagctgacacttcgtaatacagttatgcactgcttcacaatggagacatgatctgagaaacgtgttgtgcaaactcatctagagtgcacttacacaagactagatggtatagcctactacacagctaggttaccaggtatagcctactactcctaggctacaaacctgtacagcatgttactatgttgaattctgcaggcaactataccacaatggtaagtaagtatcatcagtgtaaacaaacatagagaaggtcagcaaaaatgtattataatcttatgggagcatcattgtatatgcagtccattgttgaccaaaacattgttatatggtaaatgactgcatatactatgctatactaatatacataacagaatgctatggatttggctaacccaattgtccaatttttcaggattaacttgggtgaaggattctgtaactaactaaactattagaccttaaggcctggccttagttcctctccctacccacttcttgttgtagcgtatgtggagctttgctaacaatttttcaagtgtgcaggcgcctgtgaaaagcagaataaggaagtgaactgcagactgaatcaacatgcaggtgaaaggatagccggtcagggtgagcacacaggcattaaggttagctataccactggcttccagcacacagttggaagacccagcaagctaccaatcactggaaactttggacacaactcaaagaaaagaaaccccaaagctaagaagaagaattaattaatgttgctgctaatcagattcagtgaatttttacaggccaaaaggataaactctctgaactgcctcagtaacagctacaataggaataaaaataaaaatgatgggctcttaattccttaacataaggcattcttttattaaataaaagaattttgataatcgatttcttactactcatgcctttccattacaattaattataatttccgtaattcatcattggtttggaatgctactaaaagcaaaattaaccctgaaaaatattcaagttctgaccatttatgcctttccctggatgacctgtgagtagttgaaattcttgccttttaagttggattttcttcaatacttcttttatatcttttaggatagaaaagaaagaatcgatacacagatctggttggagagaacatggtttaattaaaggcaaagctgattttcagcagctgcaggtcttgcacagacaaaaacaaaaaacaaaacccagaaaacaaaacaaaaaaccacaaaagaaagtttactacacaaaaccagtttctgataaagattctcctccccctcattactccacagtgaggatgataaggcgaggaatcccgccccaagagtcagaaaacattccaaacaccaaattctcatgcagaatggggctttagataggagctgggtattactgggagtgagatggtaaacctggttagcttgtctagggcgcaagaatcagtgacagttcaaacactggaatgttgcagctgcctgaatgcagagctcaaacacacaaactgggtaaaggtagtaggaaaaaggcttgggaagaggagagaaaggtggacacagggaaggggctgaagagaagcacaaaaggtttcatattgccattgggtagggggcttcaccttttcagacctttcaaaaaaacaaaacccaaacaccatgtcaaactaaaagagcaataatgtaagcatacggggggggggggggggctccaaccactctctctgaagagcaatgagcgttatctca

SEQ ID NO: 16626 - DNA, 35967 bp, Human
  misc_feature (1)...(35967): n = A,T,C or G
gcccaggttcttgacattttgaacaaagaattggacaaaacgtacaaagcaaggaaacaatgaagcaacaaaagcacagatttattgtacatcaaagaacactccttccggtaggaagggcccaagcaagcagcaattacagaattttctggggtttaaataccttctagaggtttcccattggttacctggtgtacaccctatgtaaatgaagtagtggccagcgatcagtctgattggttgcaggaggggaccaatcagaggctgaagtaaagttatgaagttataccccatgcaactaaagacttggcctgccaccagcctgactgattgcccgcggggaccagtcagaggtactttcaattttttatctgccacccagaagagggattagcttctggtccttttgttacttgggctagaaagttggggttttccttttgatttagttctaggaagtcagcctaaatcggccttaggttccctgtctccagaccctattttcctgcctcgtagcttttaggagattaatgcctgcctgcagacaacttcctcatttaactttcacaacacccctgaggcagcaagatcctggcgaggcagagagcctctcaagcttttttggatgaatattttccaagtctgagtttacataggtaaagaaatgtaagcagtttttttttgttttttttttttgttttgttttgttttgttttaacagaagtggctgctggagtggagatgggaatgggtaggactttagccgctccagtagccattaacgccccaccctggttatccttaaaaaattcgattaaaaaaaaagttcttaatatataaacatgacctcagccatcctatatatacatcaacataagaaaaaggtcccgtgctttttatgggaacagcttcaagacaggtatcccagcccccggcccctccccagcccccttgcaatcagatccttgtcttctaaaacctgccacacctaagagcgctgcctgaaggccggtttggcctgttgactcctggttttgactgttggtgatttaagcgattggaactggaagcaccatttgacaacattttgtaaatcattacttctgaggttgttatgacgacggggtgtggcagtccggcttcacctgtggcagcagcttaggtccctgccctcctgcagagcacacttcaccgacagcaggactcaggttttatacaagtctctactcgccattgcttacgtccaagaacccaacctaccaggtttaaacaatttccagtcacatacctgagccaccaccaccttatcctgaagggatttttgggtataatgcaaatcgattgaccgaacatttatttacttattcaagacacaaactaagagatggggtgtaactgattatctaatttgttaatttagtcaataatatgccagcattgtgcaggggaattacagggaataggaaaaagttaaatttgtgtaaatcatcagattgagtcattttcctactttaaaacttccattttcttccgatattaaaataaaaaccagacaacaagcacctgggggggggaaatcccctcttaaaattacaatttctatttttaattttgtcttcagttataaaatttattttaaagttatacaaaaatgaagtggttggattgtggaattacgtcttttaaaatgttatttgtccaatgaacaaaaaccactcgcaccgcaactccttttactatcaaattctgcaccgttgcaaaacttccttcactcaacgcttctttacaaacatcgcgatagcggagcggtctcttgggcgcaccccgtcgcatgttcaaccccacccacttcctgtctgacgatctccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggtaagggccggaaagcggctgccaagccttggcctccgccacgcaggcgacagaggctgggaaaggagctgggcccggaatggcctgcgtctgatgcggccggcctctttttctgggctgcgaggagagcctttcccctcgcaaagtgcactgtgtatctttgcctccttgtttttaggatatcgggcctcagtacccgcccacaggaacatatttgttggggcataaaagccacgcagttagtggataggacaagaattgtattagctgtttgtaatagatcgaaattgaagcgacaagcgggtgcagtttatttgttctcctagatagggttgccatatttagcagaaattaaaaataatatccagttaaaatagaatttaagataacgaataatttttagtgtgtgtccaatgcaatatttgggacatccttacagcaaaacaacaacgaaatcactcattgaaagttcaaatttaactgtgtcctgtattttatctggcaaccctattcgaagagagttcctaaatttcagtcgttcaaataccacattcacaatttttgccctgtgcctgtgctagttgcataataatttcttaaggcttttcttagaagaacctcactttttaaacttaaaaacatgtattaaattaaaaattattttgttaaaagagtgagatccagtatcttgaataaaaagtagtcagaaagcaaaatgaaggcaaagcatttcgatttaatattaataaattctgacttgatacttttatctaccaagtcactgagcccctaaaaggggcttagcaagtgttgagtactgaagacgtagcagcaaactgagaatttctttttttattcattcaacaaatcaccttttgagccacttccatatgccagcactgttcttggcctggagaatacagctgtgaatagaacaaataaaaatctctgctctcatggaactcaagtagggagagatggacaataaacaacataaattaagcaaggtgaacaatatgttagagagtaataagtatgatggagaaaaattagggatgaagaattgagggaagtttttattttattttatttgagatggagttttgctcttgttacccaggctggagtgcaatgacacgatctcgactcactgcaacctctgcctccctggttcaagcgattctcctgcctcagcctcccgaatagctgggattaggggcacccgccaccacacccagttaatttttgttttgttagtagagacagggtttcaccatgttggccaggctggtctcaaactcctaacctcaggtgatccgcctgcctcggcctcccaaagtgctgggattataggcgttagccactgcacctggccgaagttgtcattttaaataaaataagcaaggcctcactgagaaggtgacatctgagcaaaaaactgaagatgagggagcaaatcacgtggatacctgggagaagaatcttctaggcagagtgaagagcaattggaaaggccctgaggtggaaagtgtgttcggggaataggagggaaatcgttgtgactgaagtcgagtgagcaaggatgggagggaaattagggcaaaagcccaaggggtggccagattttataggccttatcatgggtttttaatcttaccgagatgggtagccattggaaggtttgaggagtcaagtgacagttttacttagattataaaaagatcactgtggctgataacattgaaagtgaagagtgttaagtggtattgcaataattatagtattgtgaaaagtgaaagtggtgagacgtgattggattctagttatacgttaacaaaaattgagttacattttaagtaaaatttaacagtggaagtggtgagaaatgattgggttctagttatattttaagatagggccaattggatttggtgacaggttgaatgcagagtgtaaggtaaagagaggggccaatgatgactccaattattttgacttgagtacttgaaagatagactcctgattttcttttatttcctcctttccttcttcctcccctcccctcgcttcccctcctttggtgtggtcttgccctgttgccaggctagaatacagtgatgcaattgcatctcactgcagcctgcctcccaggctcaagccatcctcccaccttagcctcttgagtagctggatccacaggtgtttgccactatgcgtggctaattttgtatattttttgtagagacagggtctcactatattttccaggctggtcttgatctcctgggctcaattgatcctcctgccttggcttcccaaagtgctgggattacagaagtgagccttggttttaagcatgttaggtttttacatgcctattaatatccaagtagaggtgttgaataggtaattggatatgtaagttcagaattagggtctccccggactggagctgtaaatgtaggtggtatttaatgccagagactatgtgttgatggaaaggactgagccctgagcatgcaaatattatgaaactggggagatgggaaggaataagcagagactgagaaggaatgcctactgaggtaggagaaaaaaacaaaagagaatgatatcctggaagccaagtgaagaaggtattcagtgggagggaatgatcagctgtgttatactgtttaagtaaatgaaggtctttggtgaacttgaaaagaacagttttaggagtgttaggagtgaaagcctaattggtataggttcaaggagaatgggaggtgaggagagtgggttaagataactggaagtttttagaaagggaagtcatggggtggtagctgaaattagaagagggtgtgagtgtttaacatttttaattttctttttgtgaaaagaattagagcatgtttttaagttgacagaagtggtctagtggaaaggaggaaaattggtaaatcgggacagaggatagaattgctggagtgatttttaagcaagaaagaatggaatctattgcccagtgggaaataatttagtcttagctaggagcacaattcatccctagtaacaggcgtgatggcaaaatatatgagcaccaacttcagagggtgtggtgggaacttgggaaggtcttttggttgtgtctgttttcagagtgaagtaggaagaaaggtcatcagctaagagtgaatgtagagacagaagacatgaaatactctagtgaataagcaagagaaatgttgaattactgggtaccatttaggacccacttggagttagtggtcatgaatttaaagtgagaccagtcaccatggctgtgtgtttttctccagccaaatccgaaacattgaaaggaatgggaagggagagtcctgctatttgcctgatgatgttattatttaaatatgatgttttgtattgtactttgagaaacacacccctaaaggaagctctgtcctcaaatcccagagagagaacagggtatgtcacaaagtaagtacttaggacaggtcatcagataaggtttgaactccctctattttcctgacttttgcttcttaaccttgtcaaatttctctgcttcttccttgctttcttgtgcaacagaggcttactgagtgaggactaagagtccactctcatgctgagcacagcagtgaatgggatacagctcctgtccttcaaggagctcacaactcacaactaagtaggagaaaacagattcgacataattttcttttttttttttttttttttttttttgagacagagtcttgctctggcacccaggctacagtgcagtggtgtgatcttggctcactgcagcctccgcctcccaggttcacgccattctcctgcctcaggcctccaagtagctgggactacaggcgcccgccaccatgcccagctaatttcttgtattttttagtagagacggggtttcaccatgttagccaggatggtctcaatctcctgacctcgtgatccgccagcttcggcctcccaaagtgctgggattataggcgttagccactgtgcctggccgactcgacataattttcatactgtgtggtgagatttgtgattgggcatggaaagccagaatctctggggtaggaattcccaagaggaagaagagggaaaagtgtttcagccatagaaagcaacatgtgccaaggtggtgaagcctgaagaaacacatgcagttttttgggggtttttttgtttgtttgtttgtttttttgatggagtctcattctgtcacccaggctggagtgcagtggtgtgatctcatctcactgcaacctccgcttcccaggttcaagtgattctcctgtctcagcctcccaagtagctgagactacaggcatgtgccaccacgcctagctaacacatgcagttttaatgaaagagaagtagttggatgtgcctggagttgaagggacctgtgaaagggtggcagaacaagaggttggaagggtgggatttgccatatgtcgaagagccttgtggaccatgctagtttatcctgttggcagtgggaggctgttgaacacttgaagccagtgtgtgccatgaccagattaatttaaaaaaggaaattgtgtaggatgagaaagaaagctccataaaacaggcactttctttgtatattttgtttgctgcagtacccatagtgccttgcatccagtttgttggatgaatgaatagatgaattggaacagagttgagtctgtgcactagttttgtggctattggagtaattggagggaggaaagatgcaggcctgaatagaagaactgaaatgacagagaagtgacggtttcagagagattttggaagcgggattgacaggatgtggtggccacttggaggtgaggtaggaggaggagtagaggagggtgacactgaggttcatgaggatgggaataaaggaagaggcggtctggggaggttagagtgatatgttttgtatgaggtgcctgtgagacatagaggtgttctgagacagattggaatatgtgcctgaggtcaagagagtccggagatgggtgctgagatttcagatgtggaagttgttgactggtgggtagaggggtagttggtgaagccttggaagtaaatgcaattgcccaagaaaagggtgatgcgaagtggaatgggaggacctaatctgactctttttactttcatctcccactactcttcatcaccccacacaccctgatgactctccctagacagaattagtcactgcctcctctgtgggctgacataacattttgtacccacaactgctgcagcacttgagttctgctgagcttgtttgcacattcaccaccttccttgggctctgaccactcagtgtgctgttcatctttgtattgctgacacctaacccccgccttgacccagtgtactcagtactgaccagattcttgaatcctgtgctatgatatccatgtggaagttaggcattggtacccacacagggaatgtattaaactgctttttaaatcaagagtgatcatcttctctaatcacaggtaacatcctcaagcaaatcagaatgagagcacccattcaggaaacctgaacagggaaggtgaacccctgtcctgaccaaaattgggtatgtttagagggcttttcttgtattccttctgctctaagtcctattattctgatcctgaaggtgcagacagcggcatgtaaggaaaattgatcagtgaagtagcaactaatggcatctagcatgacttacgaagccatataagatgtgtgattgaaagtcaaaagcttggtacctagaacccctgaaaatctaaaaaataaaacacctagcctgtcttttaagactgttcatccctacagtgtattatcatcttcttgtgattatcttacgattacaagcgtaaattgaagaaaagattgctgtatgaaatctcactgtcagtgagtcatctcagcatttttaccttattttcaaagacccaaccagaaaagaggaaactcttttgcacttttcaatcaagaaacttaaacataaagcagtagagggcttccctaataacatgtttcctccagcattcaaaattagtgacttcacatcactaatatgtgtcttacttattttgagtataaatgattgggcaaagaatccttgggaaaaaatagcctatttatttcaaatactgtatagtggattctctgtgcctgtgactcacctccttccctccatcactgttctcatactcaggatgcaaaggttcagtctctgtcttcaaaagtgagctcccagtctagctggagggagtgatgagtgaacaaataattacagcgtaatcctttggtaaaccagagcaggcagtaattaactctgcctagagatgaagtggcgctggagagagttcaaggaggcttcacagagaaggtggcagtggaaagctgaatcacctggtaggcaaggcgggaggaggggatgtcagatcagtgagggtcttttgtgctgagcagatgagtttggatcataggaaggtgtgagaaaattttttgccttttttttttcgtaaacagtttttcatgaaaaaaggtcatcaaagtaaaatgtattaagttttttttaagcctgctgactgatttttattaactttgcctagaatgcctttaagcttggagcctgtatgatcctgggtactcagtcttggggttagaatataacttgagggcaagctctcagcctagatcatcatttcagttatagtacttacctctgagtagctactccataaacatttgttgattgaatgagtgagtgaatgaatgcagcatcaaatacagtatctgaaataaagacttcaattttttttggaaggactttttaaaaaagacattagacagttttatatgttctgactttgttggattttggtaaaagatttcagaattggattttttttctcatgtttttcatcttgttcaggagatgaaaatgcctagaggtgataaatataggctcctatgaaatacagctgtattagacgtaaaataatgggatctgttattttgggtattacatcatatgctatcttgctgctagattttagcattacatagctatggtaggcattgtcagtttatagaaaattttgtggggagaaaaaaacatgccttagaaaaagatgagtggtaacaacagaactctttgtcccagcttgtggaatgagaatagtggagctaatgaaaatcaacatgttgaagtaatatactcttaagaaagtaccttccacctttttttaaggttgtggcaatataacaacagagaacactggtggccagggtcctaagggaaggtttgatgctgcttgtaagttctgataccttccaaaattcataatactgagagtatattgaaagacaggccgggcgatgtggctaacccctgtcatcccagcactttgggaggctgaggcgggcagatcacctgaggtcaggagttcaagaccagcctggccaacatggcgaaaccctgtctctactaaaaatacaaaaattagtcaggtgtggtggcacgtgcttatagtcccagttactcgggaggctgagaggctggagaatcagttgaacccgggagttggaagttgcagtgagccgagatcaccccactgcactccagcctgggcaatagagcaagactctgtctcaaaaaaaaaaaaaaaaggaaagaaagataacagcagtggcccggcgcagtggctcacgcctgtaatcccaacactttgggagaccaaggcaggtggatcgcttgaactcaggagtttgagaccaacctgggcaacatggtgaaaccctgtatctgccaaaaatacaaaaattagccgggcgtggtggcacacacctgtagtggtcccagctactcaagaggctgaggcaggagaatcgcttgaacccaggaaacagaggttgcagtgagccgagattgtgccactgcactccagcctgggcaacagctagactctgtctcaaaaataaataaataaacaaacaaacaatatattggacaggtcaaacatactggacagctactcaggaggctgaggtgagaagatcacctgagcccaggaggcagaggttgctgtgagccaagatcacaccactgcactccagcctgggtgacagagagagacccccatctcaaaaggaaagatagcagctaagctgggatctaactaaattgcagtaagtctgagatagtgatatcataagagattggctgaagaagtatggctttctgtagacaggggtgttctggtcactaggaggaggcttctgaagcaatggagagcaaaacaccaccactcttaggaaccccctgtgaacatcttgaaacatttgtcaaaacaaacaaacaaacaacaccccagcaagaagggaaaaaaaaaatctatgatgatcaggtatcacagcactgagaaagttatactgtgtctggctttaataaaaccatgtaactttgaattattttttaaagtaattattccacatctgtgggtggtacctggcacagctcagttccagtggaattagtttaagaaatactgccctgtagtgaattacccaggctctccaaggctgagaaacatggatggcacagctctcaggacatttcaccaccatttactgtcattgtatgctgaagctgccttgtgattactaaactagctttccagaagccttggaatggggcatgggttacagagtaccctgagtattaggtgttattgttccagtcattggaactgtatatttcctgttacatctaatttgttggcattctagaattaatgtgtttaaattgcatgagtcaatttcttggagtcctgactgctcttagatgaactaatagtgtctgacctcagagcccttcctttccatctgcaacagttttttaaggtaattgtttttaacttttaaaaaatataagtaattctaacaattgttcaatcccagccatctaacaaatcagctacgtttatcttttcatttaattaaaatagctttttagctattaaatagcagggaccatattttagacttgttaaacaacctacaatctaaatattgaccatctgggccaaatattttaagcgagggcttactcagggcagacaggtatctgataatatacacattcaaccacttcgcacctgaccagtgtggtaggaattcagagctagagaagtcctgaagaagtggcaccttaggcttgctgggggaaaggatttagacacaggcctggaagagcaggggagggcatttattcattggagtgtgggaagagcagggatcgaacagatgtgaagaagcacacacaagttaggtggaggtggggactgagagatgagcgtgactgtacaaatccacagattcatgctgtttgttcttatcctgcctattcagagaggagttggggtggcatgtagtaaatgtcatctattaaatgtgtgggttcttatgctgagacatcagcaccccaatcagtaaccataagtggaaggatgccccccttctttcccttgagaaagattacttctgatagaggagattgaggtccagatacagtcttaagatttattttttatttttcacaaatgtaggtttcagagggaactgaaattagtaatatattgtgtattttattcattcagctaggtcattaggttgtaatttgttttctaccctggaggagccccatcctctagctggagaaacacaatgacaattgcagtgatggagtctcacccagaataccaaccatgcagaaaggaggactagctaatccagcttagaggtgtcaggatctggaaaggcttcacacaggaggttcatctaaacagaaccttgaggattgagtaagagttggtcaggtgaggagaggaggcgcttcaggaaatgggaaagcatatgcaaagtcatatttgcaagagaacatggcatgattggagtttggtcctgcaggagggtaggctacctaaaggaaagccaaggccagagaggcatacacagggatcagatcttcttgtgtcttgcagaccatgttaaagagtttggagtttgtcatgaagcttgttcaggtcttagctcagatgtcactaacttcccattgcacttagaatagaattcagacctcttaccatggccacaaggccctatgtgatctggccccggactgcccatgtggccacacccatcttgagccactcctccattgcttgcccttgctatagccagttagccgatagagagctgtcaaaagattgtaagcagtgttatttcatattcagtctggccacagtatggagcatggattgaagagagcaaggccagcatcagaaaggcaagagatgataagaggctggtcttgagcatggaggtgggaatggagagaaaaggacaaatatgaaaaatgtagaagcaaatgcagaaggatttggtggccactgaggtttggcagaggagggacttctgtcagtgagtggatggtgtgttcataccctgaggtctgggatacaggaggaagctcaatttggtgggaaagatgattagttcatttaggaaatatgttgactttgaggtgtttgtggaatgtcccaagtggagatgtctggagagttcttgaatagtctctggagctcatggaggtatgggccaaacattggtataaatgggaaaagataacttgaatgttgtggtactaggttgatttcatctccaaaatatttctcgaaacaaccactacttttcactcctctgccatcacctcggggcaagctgctatatcttttaactagtctgcctgcttctgcttcagcccattcttacacagctagtggagtgatcttctaaaaatgagaaggagtcttataattttcctacttaaaaccaatcttcactaacttcccattgcccttagaatagaattcagtcttcttaccataactacaaagccctgtatgacctggccctggactccctgtctggccacacccatgttgagccacttctccatcacttgctcatgctgtagccatactgtatggcttcttctagggcctcaaacttctgtattgttgtgtgtcaagttctttctctctttcaggtctttgcatatgctactccctttgcatgaattgtcatcttttaggtcttacctcagatgtcattttttcaagggagtctcctctgacctcctgggctatattagtgccatcctgcattttttcctagcacctaacacaatatgttagtagttaattgtgcgtttgtatcacccatacaagctctgtgacgacaaaatccattctgtgttttgtttaccattgtacccacagttcctgacagtcctgagctcatagtcagcactccatgaatattttttagatttgttgaatgaatgagattataatcatttttattttttgtcttgaaaaacttagaaattttacactgtcacagtacaaatagaatggtgactcaagtgatagaacttatggagctgatttcatctacttttacattttcaactgttattaaatgctctgcctctggaaggttgagacatggaaattgcaaattaaatcttaaaaggaatttttcctccctattggctgtattcattatggtagttctggttagcatgaattgatctgttatcagtctgacaatggtacggctgctgagtttgaaattcagaaaactaatacttgttcccttgagtttgggcgtttgtggcagagtttagtagcagccttctccttcagccctgatttgggaagcatcccaatacatgctatttgcattgcagctgtgggaaagtccacgtttgtgaagttactcacgaaaacttacccagaatggcacgtagctacagaacctgtagcaacatggcagaatatccaggctgctggcacccaaaaagtaagtttttagttgtggtgggtagttggcaggcatgggtgaataatctaattgtcataatttaatttactctcagtgagtaaagtagcccagtttgagtatcctttttaaaatagcttcattccagaaagcagaccacatacaccagagaggatatgacttgtttgaatatgtgcagttttgatttttgtggtttttatatgtctatctaagtgactgcctctgttgtttgtggtttcccaaagcatgtccaaccatcatggatggctttgaagatgaattttgtcattcctacacttaagtatttatattattacttaagctaaccactaggattaatagctaattatagtgattttaactttttaaataaagtcttagaaattagaagggatattagagaggttccagtcacactttgagtcaatgggagaggttacagctaacatttatgagcatgtactatgtgccaggcactgtactatgccaagcacagtacatttcacttacacctcatggcttaggccctggtgtcaagactatggctttggcagaggccatagagttggtttccagccacatcagtctgagtaaggaaagacttgtttcgacatgacccttagagggagcagaagcaccatgcctcctcaggcaccatgaactgctcctgccgccacctgggatattcactgagtggcacattctggttcttaactctaattactaaacagttctgccttttaatgagccatgttgcacccctgtgactctgactcattggttcaagttctacctcttaagtcttttaacttttcgccgtaacaaccctatatatagttgaaggtaatgattttcctgttctttctccccctcaagtctctctccttttttttttttttttgacagtctcattctgtcacccaggctggggtgcaatggtgtgatctcggcccactgtaacctccaactcctgggttcaagtgattctcatgcctcagcctcctgagtagctgggactatgggtgcatgccaccatgctgggatactttttgtatctttagtagagacagggtttcgccatgttggccaggctggtctcaaactcctgggctcaagtgatccacccaccttggcctccaaagtgctgggattataggcatgagccaccatgcctggtcaagtcttctctctttgaagccaaacacctccagttttcctccaggctattctttactctgaagtaactttacctaagtgatgagtcctagtttgttcactttccactttgaatttactaagagtgctacttggaggtgaacaggacattctggatgtagtctaagtgggacagagtatcatggaacttgttctgggtgccatttttttttattccaacccagaattgtgttaccttttgtggctggcatatcatgcctattgaggatttttgctgcttaagttgtctctttatatgtctgtatgtgtgcctgtgtgtgtatttgtgaaattaactttcctatgcaggaataaattacatatctttttctgagtatgccacaggtcacctgtgtgtatttcaaaatacagtcatgggctgcataatgatgtttctgtcaatgatagaccttgtatacaatggtggccccataagattataacaacatatttttactgtaccttttctatgtttagatacacaaatacttaccattgtgttacagttgcctacagtattcaatacagtagcatgcgatacagctttgtagcctaggagcaatagggtgtgtcatatagcataggtgtgtagcaggctatcccatctaggtttgtgtgagtacattttctgatggtcacacagtgacaaaattgtctaatgacacatttctcagaacatattcctgttgttaagtggtacatgattgcatgtccacaattgtttgatattcctcccttctagaagtagagcgtaattcttgccttgaatgcagctggactttgtgatttgtttctagtaaatagaaagtagcaaaaataagaaatacctttctagggtaggacataagagacactgtagcttccatcttgttctgggggaagccagctgccatgtcaggaagcagccttttcaagggggccacacggaaggaactgaggcctcctgtgaacaggtacgtgagtctttttggaattggatctttcagccacagtccagccttcatacaactgtagcctcagccaacatcttgactgaaacttcatgagaaaccctgaggcccagccacccagctaagctccttcccaaattccttccccatagaaactgagataatgaatgtttttgtttaagccactgaattctggcataatttgttaggcagcaatagataactaatcatcctgtaatcccattattcagaagtaaaatggacatttttctacagagaaaatgtatagatttacatatacttacataaatgtataaaatatatatacatttgctttttgaaacaaaaattttgattgccacctgtatgtcacttaatagacaagatctccctttcacagtgatatcattttaatggttgtagtgtactgcataatatgaatattatcatttagttatccagtcctctattttgaatgtttagttttctaatttcttcctattataagcagtgttgcaatgatgaatatcattgtagctatactgcttgttttttaatataaagccatgttttgtgtatctttttgttctttagtgaattgcctgtccaaaccccttgccttgtttttttctattgagatcttcatctttgtgtaatggcttcataaaaactcattgtatgttaagtatattaactctgtcatatgtttgtttgtcattttcttttctttttttttttgaaacggggtctcgccttgtcgcccaggctggagtccagtggtgtgatcttggctcagtgcaacctctgccttccgagttcaagcagttctccctgcctcagcctcctgagtagctgggattacaggtgcctgccaccacacccagctaattattgaatatttagtagagatggggtttcaccatgttggccaggctggtctggaactcctgacctcaggtaatccacctgaattggcctcccaaagtgctgagattacaggcgtgagccactgcgcccgaccatgtcatttttcttttatcttggtatataatatatttttacaatataatacatttcagtttttatgtagtctaacctgtccttctttttcctcatagttagcacctttgatgttaaaattgtagcccaggagtataaaaataatctatttctttttgttgcttttatggttttatgttttatgtggctttacaagttataagactttagttttttcacaaatggttatctacttatccagtagtattcttgtttattcctgagcagaatatatattttgtttttattgtgactgagatcttttttccacatcatcttctgaaactggttattgctgttttaatggaaaacagttgattgttatatttatcttatatgatttaatttctcatttttttatttgcttgaagttttggaaaataatagttgtctctaaatagtaatcatttgaaagagttttctaatatctgtgccacatttctattttcttgttttctttcattgggtagaacttccagagcaatataaactaatagcagtgagggtagtttccttatcttgttctgtcattaatgaaactgcctctaatatatcagtgttaagtttaatgtttattattcatttcagtagaccgtgtggtacacgtacccttttgttactagaatagtaactgtttttatcatgatcaaatgttgaatttccatcaaaaaccactttagcatctagtgagataaacaaggggtttttctttttaatctcttagtattagtcatagatttaataatggtaccatcctcacatttctagaatgaacttttttttggtcatgatgtactattccattaatttggtaatgtgttgtttggaattttgcatgtatatttatttatacagttggttggtattattatttgtgtgtatggtgatttttgtttgttttgacttgtgggttctttttaggcagggtcttcctctgtcacccaggctggagtgtagtggcatgatcatagctcactgcagccttgaagtcctggactcaggtatcttcccacctcagtctcttggtgagttgggactataggtgcataccactgtccccatctacttaaaaaaaatttttttttttttttgtagagatagggtctcactttgctgcccaggctggtctcgaactcctgggctcaagcgacccttccacctcggactcccaaggtgttgggaccacagatgtgagctgtgatgcctggcccatgtgtagtttgtgacaggttttaccatcaatgttatgaaaataaatggagaaattttgcatcttttctagcatagaaatgatctattccttgaaggtatgatagaaatcatctttaagattatatggattcagtactgtttgaggggaatcattattggacaactgttttctgcctcagttattcaggtttttttttttttttaagatggagttttgctcctgttgcccaggccagagtgcaatggcacgatctcagctcattgtaacctccgcctcccaggttcaagcgattctcctgcctcagcctcccaagtagttgggattacaggcataccaccatgcccggctaattttgtatttttagtagagacaggctttcaccatgttggccagactggtctcgaattcctaacctcaggcgattcacccactttggcctcccaaagtgccgggattacaggcatgagccaccatgtccagcccctagggagaatttcttaagctgatactcttttctttttctttaaagagtctcactctgtcacccaggctggaatgcagtggccctattatagctcactgcagcattgcttctcagccttttggctaagatcaagtgtatagctcactgtagcactgaactcctgggttcaagcaaatcctcccacctcagccaccagagtagctgggactacaggcatgcaccactatgcccaggtaacttttaaatttttttgtggagacagagtctcactatgttgcccaagttagtcttgaactcttggcctcaagcaatcctcctgccttggcctcccaaagtgcttgggttataggtgtgagcccccatacctagcccttaaactgatactctgtaaggatcttctaattcactaattaggtttactgcattatacagtctgctagctaccatcttcattatcttcattgggtgttttacttgggcaattgcatttttcacctctaagaaagttattttcttattgttccttttttatgatagcttattcttgttttatcagcaaggccgtatcttttgttttctcctgtttctgacaacagccctgtctgagcacagagactagtcctctccttttgaattgctaagtaattttgtgtccaattattgttcatctgtttgcttatatttttggaaggatgtttgcatttgttctgtagctgagatgggttctttcagaaattgtgttggtttcttttacatttttggttccagaagagtctctctttgatagcccaaagcccactggtgcaatagaacccaccagtcaacctattgcatctgccagcacagcactccgctccacatacagtgtgtgaattgtgcaacaggcccagggctgctcccaaccatctctagtgacaccacagagactacaggagacacaaatttgtcctcctacttctacctccagctcttagtcaggggccacgtgtgaggctggtatgtgtgggcttgcggggtcagaaggagggaaatcccgaaaatacctctgagttaaatgtttttctggtccactctgctctatatgtgttgtttctgctgaagcctttcaaagggctaagacccttctttggaatctaatagtgctattttgccaaattggacttcttactgttgttgaatcttttttctccttctgtcctgttgtctctacctgaagtacaatcttcttaatctccatttccatctgtgagaattctactcatcagttacttcccagcttaatgccactttctttcagaaactccctgagattccttccaccatcagtaatcgtcccttcatcacatgttctgccttacattccagcttcgtacatcctcatcaccctcttcctttttgcactgtgagctctttgagttcaggaactgtcttgttcacctttagatggagggtgttggaatgatgaggttagaggaagccaggtttgagtcccttcaacatttactcgccatgaaaccttgcacaagtaagttacttaacctctgagtggattttcccctctggaaaatgggcattacaacagtacctacctcatgaagctgttttgaagattaattgaggtaacataccacagtaaaggttgaaataaatgttaattcctttttctatacccttacggtaccctgcccatgtagcgcctcatccacacaggccttcagtgattggtgattgaataaaaaatacagatccaaagtgcttttgtacaaaattcacttttgcattgttgagtcaatggcagatccagaaaagaatctgaggctgggcgtggtggctcacgcctgtaattccagcactttgggaggacaggagttcgagaccagcctggccaacatggtgaaaccctgtctctactaaaaatacaaaaattagcttgtcgtggtggcgggtgcctgtgatcccagccactcaggaggctgaggcaggagaatcacttgaactcggctggggtggggaggagggcggaggttgcagtgagccgggaggttgcagtgagctgagatcgtgccactgcactccagcctgggtggcagagtgagactctgtctcaaaaaaaaaaaaaaaaaagaatccggggctgctgaacatcccacacttgtgcccacttgcacatgccgagtaagtggaacgttttaattatgtttcataaagtctctagaattaagtagggttttgttttaacaaacaaattgtactccttatatgaaagataaaattctatttggtggttgattggttggattttcaaataagcagttgctttctggtttgccttgacattttataaacataactacagatggaagctcaaaagagaggcaacatagtgttatagtggaaagatttgattcagagttaaattttagatggttgttgactgttaactcctccccagacagacttcacaaatccctcaatcagtgatcgtgttaattctatatatggttcttcctctgcttttgttatattgaagtggcatgtcatctccctttagagagtcttatttaataggtaggaaaatctcatccctgattatgaaattttgactaagctggggatctgattctacctttttggtggaaggaaacttttgtaatttcttctttcattgattattaaacctgtttggggaggtaggggtgtgtgtggaggggtgtaccccatggagtaaatatgctttctaggaaattttcttctttttttcatctccctctaggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtaaaatgccaagccctccaccagtcacaagccccatgctcagtgctgcctgtttgatcttgcacagatcctgcactgctatggtcactgatgattataatttgaaaaattatcttcttttttaaagacaacactatacagatttgtccagagttgtacttctaccagattgtcatctatgtcaagaaaggaaattgggtttttcatcaactgaatgctttgaatttcttacattgctactgattaccttatgtttccttattttctggcatggagcaagctggtagccacctaatgtaaccatcacatgctaaaaggcacataatagacacttaagtagcagtgtatattctaagaaatcagatgattcagtggttgattatcccctttaagaaaaaagcagacgaaattaaaatttgtgttcctgaaaatgatataagagatattttcagccttttttttttattcttcaagaaaggatgcttaggcagaaatagcacatctgagaaactggcttctgtctcagatttagccctttttgaccccttcttctgtgagagggctttttgctggccagagtctagtggacatcagtgcctgtgtcagatcagggatgggcatcatcctgaccacctgagggagtgagatgtgaagtcactttgaatgcaagctagcagcaccctgggaagtgagcccatctgctccagaagagctaggccgtgcaggctccggaatgcctggctctgctgcagagaccaggctgtgacttgaggttaagccgcctagagacaaagtcaggatggcttgatctggacactgctggagtttttcttatctgaagcctatgaatgaccagtgtcagtgtgaaatggtgctttcaagcaaaacgatctttcttaaggctctttgaattatcaaaatgggaagtggtacattttcattgtcactgctgaagacactcagttggttactcttttaattccaaattagacaaactagttctatttcttagtgcttccggaaagcctcctagaagaaaaaaaataaggatacatttgtaaatgacaagtgatttttctgactttaccctaaaatcatgtaagatatgtaaaacaaaccctataggctatccgttccttgtttacgtaccccgagagagcctactttttataaaagctaaatatgtgaattacaaatggctgggctataggttttacttctttttcagctgttggatatcccacctgcctgttttcctctcttctctcccaagccatgcctctcggactcagaagttgaattacatataaccacatgggttgtttggaaacatagtcagtctttatttctagccgcttcatgaagtaggtgtgtgagaccctcagaggaaaatagagaagtagaaacactttgttaattagaaatgcattaagaagctgcatggatcttaacctttgcttgtaaaggaagaggtaataattgattacactgtgggcatacaacattccaggtgctatcttcagtgagggcattttcgagacagaaaggaaaactaatcacaagttctaatcccgagggtaatttagactttgttcacttgcacagatttattggatgcctcctgtgttgaagcaccaaggctggccctggggctgcagcagtgaataaggcagacccagtccccgcctaacagggactgaacacatgctcacgtgtgtgatatttgttccaaaggaggaacacaggttatctgggagagttgattatagcgaggaagaaatcttagtcttttctgtttgagttaaaggaaacattagcatatggttttagagcagaggccctgactcctagatccttatgccctgttctgtcctgcagcccctgcattcagtctgcagtacttccctcccactcagcaccacacccttctgcccctcaccccatcaccaccacaagctttgaagaaataaaggaagtgctctttctcaagaaagccaagaacccctttcatagggcttattagcaaatctttaatttctctttataagatccttttttgttttaagacagagtctcgctctgtcgcccaggctggagtgcagtggtgtaatcttggctcactgcaacctccgcctcctgggttcaagcaattcttgtgcctcagtctcctgagtagctgggattacagggacacgccatcatgcctggctaatttttgtgtttttagtagaaacggggtttcaccatgttggccaggctggtctcaaactcctggcctcaggtgatccgtccgcctcagcctccaaaagtgctgggattacaggtgtgagccacagtgcgtggccactttataggatcttaatttcatcttctagttatctgtaaagaactcaaaaacattttgagtttaaaatgttacccttttatttgttctcatcaactagactatggctaaaccattccagactgggaaagtttacttgtggagtttctaagttagcttcttcatagcctaacaaaaagcagttataataataactaagatatctagaagactatgtgccagtcactcttctaagcactttgtgaggattattacaagacatcatcataacaggctgagaggatttaggtgacttgcctgaagttacatagctagtgaatgtttcagccagtatcagaccctgaaatgttattctggaaggtattctctcagtggtgacactcacagccttgcagtctgtactttcctgagccatcatacacaagggttctgaattttattttctccaaagtggccagttgctgagcattgccttggaaactggagtcccttgcttaggatgcaaattgtgttttttattaaaatgcctgaggtttgaaagcaggattgacccctggtttgtctgaagccatggtttatgtttagctctgatttcctgtttaccagatgctcttttggttgtagaaataagcagggggcaaagctggtttgatttttagctttagctttcttttatctgaactagaaactcagcagcagaggaagcaagcaagcaggagctcataatgcattttgcaggagagtctgctttcttagtaatactgaaattagtaggaaatgcattttctgctccatagaggacaccacataaatactatttcttctgcatgtctcagctaaacaaaaggatggctcagtagcctggagacttagaagccctcagtccttgtatgaaatttagtgggtggatttatactggattcacttgtttatttgttttgggccttgctataataataataaggaaatctcaaaagttcaagtttacatatatttgctgtatgttctgactggtttctagcagagaaaattgttagggaccaatgatactatcttctgtctcttttcttccagtgaatcaatccatctggaaaggtgtgatttcagcctccaaagtctagatcctatttcccatcttagtactgagcagggagggagatatgggttaagaattcagatttcttaaggattgatgaggagctagaaaggttaagtggtttgaacagacatggaacaagttggttattgatttttctgcttctctctctctctcgtgcctttcattccatttcccattctcctgccctccccattcccatcccacttccaaccaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtaacactgaacctacaaccttagactttagggccatatgaaacctaagaagtgacattctccaagcccctgattttctggttggagagattagagcgtagacattacctgcagcacagagagcagtgggggacaccctcctgtcccagcgttgagcaccctgttccccactggcttcgtgtagcagagtgctaaagccattgactatgcataaaaggatcgctgttgatgtaggaacaacagagcaaatcgagtgtcatctttatgatgacgcttagggtttgcaggtgggacgctctgacctgtagccacttgcctcagctcctcctttactctgactgggtcatcagagtgtgtagtctcagtggtttccttagtaagatgtgaggaggaagaggagaattttctcacctcatcatgatactgccctaatttatagcccttttttgaactgtgatgccattgggaaggcaggatggactatagcagttccattctgtgactctctggctggtgccatcctacatgaagtaggatgatgtcacggcaggagcaccagagtctctggagatagaagtgagctgtggcttctgctgactggtagtgaccttgggcagcccctggagacctttccactggagagatccttgcctgtaaaatccactggttcaatctagacgatctctaagggctcttctggagtgggattctgagtcaaggtgagttttttttttttagagatgtactgctctcagcttttgagatatacatccaatatatagtcaaatgccagatataccacatactgttagaaggaaggaaagctgtctccaagctagaggctatgctttttagagatggaactgagacttgtgggcagaaaggagccgagaacagactgagcagaaccagaggatgagtgggagagctcccatcacagagcctcacaccagccaacgaggagaggactggaaggaagggtcttgccttaagaaggtggcaaccaggaaaaaaggcccttgaatgtgactggggccagatattggggatctttgtgttgagagtttctggacattttgaggcaaaagctagatcgtacgagggaataagagattctacagaaataaataagggttaaagtttaaaatgaaactgggccggtgcagtggctcatgcctacaatcccagcactttgggaggctggcgtgggaggatcacttgaggccaggagttcaagaccagcataggcgatatagtgcgactccatttctacaaaaaagtttaaaaattagctgagtgtggttatgtgtgcctgtggttttagctattggggaggtgagacaggaggatcacctaagtccaggagctcgaggctacagtgagctgtgatcgtgccactatactccagcccaggtgacagcgtgagaacttgtttctaaaataaaataaaactgaactaaagattcagtgaggccagagggctaataatcttccatggaaagaaccacactaaagttagatgcattgatcgcaagttgacaaggtgggtcatgtttatgtgacttctttcaatagtcttcattgcctgagagccagaatagaagaaggggattatactttaggggtagagattagtgtcagcgattgtggggagaggagtcccctctcaaagaggacagtttgaagtgtcaaagtgtagggttcaagttgggagagaagtcctgagccccaggaaggcttgtggcctgggccaaagaggagtgagagtgctgtgaggttggattgagtaaagatcctggttggaatttgaagaagtgacaggtttcctatgggagtcttgggatggctggactgaaagaagcaggaggttctcaggacgagctgagcattaggagaagtgagaatgctgacttaaccttttccaagagaacagcacattcagctcagtgccatgaagccagcattggggaggagtgagagaggaagtgggctgactcattcctgggagtaaaatggggctacttgggccagctgaagaggctcttgtttctggggagtggaagttggacccagcaaggagaacaagaaagtcttaattgcttttcttctttgtgcactctgaatgaccttataacagaatgcctgaaactggttaatttataaagaggcttattttggctcacagttatggagactgggaagtccaaattgggcagccttaacttccattgaggacctcctgctgcctcatcatatgatgaggtggaagggagcaggcatgtgcaaaaggggcaagataggaggagcagccttgctttataacatcccactctcatggcaactggtccaatcccacgagagtgagaactcattccggcgagaattaacccagtcccaagagagtggcattaatctgtcttaacaacctaatcacctcttaaaggccccacctctcagcactaccacactaaggaccaaatttccaacacatgaattctggggggatacactcaaaccatagcaaatggtgatgatgatgatgatgatcatcatcatcatcgtcgtcgtcgtcgtcgtcgtcgtcacttgggggcagatctgcccttttggagaggctaattgaaatatttcagctggagtagaatgagaagagttgaaggattattacaacttaatggcagaaaagaaaaatagcttattcattttgagattagatggggattttaatgctgttttgatggcattagttccagagatgcaggaatgcccatgtttcttccctgaagtcacacttgacctcttctgtgaaattcagaggtaactgtgcccaagggaagagcagaatagaagttgtcctgtcactatgtaaaaagctgtgcaagtgcccaatcttccagttcagagccctcgtaaatactgagtttcgagcatgtcagatggacttcgtaggtccttctgctcctttctacctattcttccctaacttcttttttttttttttttttttttttgagacagagtcttgctctgttgcccaggctggagtggcacgatctctgctcactgcaagctccgcctcccgggttcacagcattctcctgcctcagcctcccgagtagctgggactacaggcacccgccaccacacccggctaatttttttttgtatttttagtagagacggggtttcaccatgttagccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggaccaggcgggtgcagtggctcatgcctgcaatgccagcactttgggagaccaaggtgggaggactgcttgagcccaggagtttaagacccacctgggcaacatagtgagagccccctgccctctacaaaaaatttaaaaattagccaagcatggtggtgtgtctgtattcccagctactcagcaggctgaggtgggatatcacttgagcctgggagattgaggctgcagtgagtcaggattacaccactgcatttcagcctaggccacaaagcaagaccctgtctcaaataaatgaataaataaatttttttttttagaaaaggcaactcaggccgggcacggtgactcacgcctgtaatcccagcactttgggaggctgagatgggaggattgcttgaggccaggagctcaagacgagcatggtcaacatagggagaccccatctctaaaaattttttttaaaacacaagcaagctaacaattttaaaactcaaaagagaaatagctaggcctcagtgttcctagccagccccatggaatcaagagagtgcagctgatcaatgtacatcaaaaagccaggccctacctgggactggcacagcatggggacagcatgcaggaggtgcatgggacaaatggcacctgggtttgggcttgagaggcatagtgaaaagacccactagcagtcactttccattttctgtttctgactccaagcaagcagagcagcagttcttcttcctgggtgggacaggttaagaagaccagtaaagggtctctccctcgccacttgtagctacactatctttcctgttcacattcaggtgtgtcttcctcatgaggactgagatgaagaggggtcagactaaagcactgtttgcacgggatttttttaaatagaatttgttatagcgatatcagtaaagcaagagttatgccaaatgctcatagtaggagtttacttcgacctctttttttttccccactcaatactgccaccagttaagacttagacttctcagggaaatccatttgctctgttaaggaaattaatagtaaatagaaatatgttagcttattttaatagatcaatgttagtgtcaaggtttgtctgcaagcagtgaatgaataattataaatagctttcctaaaaagaattgttctgcctttgtgtgtgtacttggaaacataaagtcacattttaaaaaaatttattttcacgaaacagacaacattttttttctcagaaaggaaaatgagatgatagctttgctatgcttagaaatcctaaagctacctttctggtgggaatataaattggttaacctctaaggaggcagtctggcagtatataattgcaagtgcatataccttttgatcattaataaaatttgtttctataatttcatttccttagagaaaaggtaagataagagggaaacagcaaagactcccaagtctttgggattattgtgtactacatttggaaattaagttttcatttcttaagtaagttattgaaagagggaagtcctggccgggcacggtggctcacgcctgtaatcccagcattttgagaagccgaagcgggcagatcacgatgccaagagatcgagaccatcctggccgacatggtgaaaccccatctctactaaaaatacaaaaaattagttgggcgtggtggctcccgcctgtagtcccagctacttgagaggctgaggcaagagaatcacttgaacctgggaggcagaggttgcagtgagctgagatcgcgccactgcactccagcctggcaacagagcaagactctgtctcaaaaaaaaagagtgaagtcctaaatcagtgggttaatccatctgttcttccaggacagatgatattgaataatgaaatgtttgtcaagcagagagaggactgaggataattcagtcaaaacaaacatttggagcaaaaattttgaggtgtgaaagagcctggcctgttccccaggaaagaggtcaaatctggctaaagcagtgagtccaggggaagagctaaggcagttgagaagtaggaggggtagctttgtgtgacaggtaaagaagatgtcattttctgagccagtgtgcatcaaacttcactaccagatgaatgcagaatagaattatgtacactctgcaaagcagcgggggaggagagttagtctcaagcctcacttgtttttccacttctttgttttatctttgacctgtgcaaattttacattctattcctgagtgaatgtttggtatgacatgaaagagatatttcaaattacctaacattttataaatgcaatgctattcatacatactgctttgaaccctggggctatggctgtaggcggtaaagagcctgtgaagtattttcagcaaggaaagtcatgtcattatattgccgtactacagacgggtggagtgaaggggaaaaactggaaggagggaacagcttttgccaggagctcaatacaacttacctcagtgacctgtggatgggtagacaatgaggaaatagaagcccacaaggactgcactgctagtaccttatgaaggcaggaatttactcctggactttctgaccttaaggcctgtactctgtccatatgcttccctgcctccaggaggcagaaccagaaggctcttgccataatccaggtaagaagtaaagaggacccgaccagggcagaggtgagaggagaggcaaggagagaacattctagagagatgaaagagaattgagtgacttcccagatatagtagggagaaggaaaaacaaggaaaattccaggtccgtggcttggatgactggatggatgatgttcatcattaaccgacttaggatacttcagaggaagagcaggtttaaggtggagatgggaaaagaatggtgtagatcctctgattgcataagaaaacaagacagcagaagcaaaggcatggcttgtaatgcccaagatagacattatgggtgggcctcagagcccccgaagactgcattgtagcagccaaaacagcaaagagctcatcagggcttggggactgtcttttaggtttgtttgaagagactgtaccagagggccagggaggaggagaaaggaattgagctggcctatctagagcagctgcatggccaacacgaagcctggcttattcacaagacaacgaagtaagtggggagaaaagaatgtatcagagacagagacctggctcccaacagccagttgttaaaaacaagttcagcatgcagccccctgtaggaaggttcagaatatactggaaatggttggaaatgtcaagcattttccaactcagaagtttaatattgctggacaccgtggctcacgcctgtaatcccagcactttgggaggctgaggcagtcacctgaggtcaggattcaagaccagcctggccaacatggtgaaaccctgtctctactaaaaatagaaaaattagccaggtgtggtgtcaggcgcctgtaataccagctactcgggaggctgaggcaggagaatcgcttgaacctgggaggcaaagattgcggtgagccgagatcgcaccactgtactccagcctgggcgacagagtgagatgcccagaagaagtttaatattgaatataatctttacattccaagggcctttttattagattgtatttctccagctttttctttgtttcttaacatttccctagactgaacattgtgattgatggtgatagttggctcagcatgaagggctgaaaatgttagagaaattgtcagtattactaagttggcattcctggtttctgcctgtcctccctttaggcttggtttgttgtccacttaaaatgtttggtgctctgactgtttgttagtatcactctcaagaatgaagagaaacctcaacctttctgtttccggccaactttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttctgaggaagtaaccaaacaagaagacctcatgagagaggtgggaaggactttaactcctgttttctggtggtttcctttgttgtacttttatctttctggcctttgcttcaaagttcaatatcatgggtcttgtgctttgcatctcacattgcatttcacactccaaggcctatggaatcttgtgcagattacaaatatccctattctctaaagtatgctggactaataattgttaaataattgacttgtaacatgtgcttgccagctgactttcttctctaaggcatcctaaaactagggaaatgagactactggattctattcccagctctgccacttgatgctatatgaccctgggctgcccacatttcttctccatgcctattattttcctttcctcacaaaaacctcatgggcttggctgcatatgcattgggggtggaccattgaaaattctgttaaaaatgtgaaattaaacttctgattttctccttcccacaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgtttttctaattcagttgctcatttatttcagcatgtatctcttggtgcttgctctaaattcacctctagactagtgtattagtccgttttcacactgctataaagatactacctgaggctgggtaatttctaaaggaaagaggtttaatcgattcacagtttcgcatggtgggggaggcctcaggaaacttacaatcatggcagaggggaaacaggcacatctcacatggtggcaggtgaatgagcgagtgcaagaaagagcagggaaacctgccttataaaaccattagatcttttgagagctcactgccatgagaacagcatgggggaaactgtcccggtgatacagtcgcctcccaccaagtctctcccttgacacctggggattacaattcaagatgagatttggctggggacacaaagcctaaccatatcaactagcaattttcaaattgctcccagaactctaacccaagccctacctgccatgcatgaagaagggaaataaagtggctcaagagtgggtgggatcttaaatgtgagccccccagagcaggaaatggagcatgaactccaggaagcttctttatctcttcccatctgccactcttgacataggggacaggtgtggggaacttaaacccttgtcctagagctaaagaacctggccaaaagaaaaaggtagaaaacagcaagaacccaaaagttaagcatctgacatttaagattggccagcccggcactctatctttgtctaaataccttacccaatgacttccagataacgttaatggagtggatctctctgtgcaggaaaaaaaaaaaaaaaattttttgttgtgctctttacccttcaaatagaatttattgttaagggaagaaaaatacatggctctataggattgaagtgctccattgccagaagcctgcaggtccatgattcacaggagcagatctgcactgaacccttgacggttctgcaggtacacaggaagatgaatgatctggggacgtaagagtgccccagaagacagaaatctgtgtttctgtcctttatgctttggggaaatgaatgtgagattggtttctaacaaatacataggccaggcaaggtggcttacacctgtaatgccagcactttgggagaccaaggcaggtggatcacctgaggtcagcagttcaagaccagtctgggcaacatggcaaaaccccatctctaccaaaaatacaaaatttatccgggcgtggtggtgtatgcctgtaatcccagctacttgagaggctgaggcaggaaaatcgcttgaacccaggaggcggaggttgcagtgagctgagatcacatcactgcactctagcctgggcgacaagaacgaaactctgtctcaaaaaaaaaaaaaaaaaaagtaatgttttaatataaaagtatggcaatttccttatcctacttatttaaaacattttaatagctttattgatacataattcacatattatacaattcactcatctaaactgtacgattcaggccacacacagtggctcacacctgtaatcccagagatttgagaggccaaagtaagagaattgcttgaggccaggagtttgagaccagcctaggtaacataatgagaggccagctctccaaaaaagtaaaaattaaaaaaataagccaggtgtggtggagtgagcctgtagtcctagctacttgggaggctgaggtgggaggatcgcttgaacccaggaggctgcagtgagctatgatcctgccactgcacttgtaggtgacagagcgagactctatctcttaaaaataaagtgtacaggccaggcgtggtggctcacgcctgtaatcccagcattttgggaggctgaggcaggtggatcaactgaggtcaggagtttgagaccagcctggccaacatggtgaaaccccgtctccaataaaaatacaaaaaattagccgggtgtggtggtgtgtgcctgtaatcccagct

SEQ ID NO: 16627 - DNA, 20634 bp, Human
gtgcaatatattctcttacattactgcatgcgattagctaacactgataaaatgctattagctagttgcagactttattcatattttgccaattgtcctataatgtcatctatagcaaaagagagaaaaaaagaagcaagaaagagaaaaaaagaaagacaaaaagttttgggtccagaatccaatccagaatcaaacagcatttagctgtcatgcctaggctcctttaatggagaacagtttctcattctttgtctttcatggccttggagctgtcaagagtacaagcaatttatcttgtagaatatctctcactttgggcttgtctgatatttccttgtgaatagattaagatctactagtgtgttccaaagctttacaactgttttttttcctggacagttttaacattctaggtctgtgatctttcttctcaatgtgaaatgaggaatctgtaaccgtttttaggagactcattggtttaggaaaatcaccttattaaatttacagacttgttaagagctacgaagtgatgtgtctcctcaatggatcctatcagaaggcatatatgtgtgttcccttactgggtggtgctaactttgatcacgtggttgaagcagtaactgtcatgtttcttcactgtaaatttaccattttcctttccttcctggaggctagaagtaaaggtcaaggtgttgacaggattggtttcccctgttctttgtttgtttgttttgttttttgagacagagtctttttgttgcccaggctgaagtgcagtggcacagtctcggctccctgcaacctctgcctcccagattcaagcgattctcatgcctcagtctccccagtagctgggattacagcgtccgccacgatgctcagataattttttgtgtttttagtagagacgggggtttcaacacattggccaggctggtctcgaactcctggcctcaggtgatccgtccgccttggcctcccaaagagctggggattacagaagtgagccaccgcgccctgccctccttaagtttccttgcgggagagatactttgagactatgcaaaaagtttgcgggaaaaaatacaggaagcccagttgaatctgaattccagataagccataaataaagtataaatatgacctcccaaagtgtttatctaaaattctgatttgattgggcatcttgtgtttttatttgctagatctggcaaccctatatgtaaatatcttgctcctcatccaactttcacccagttgttttgacatctattgctgcttctgaatcagggttgcacatgcaaccctgacgtctgtctctgaatatcttttatgattttactttttttgttgttgttttgagatatggtctcactctcgtcgcccaggctggagtgcagtggcgcgccttcagctcactgcagcctcaacctcctgaactcaggtgatccttccacctcagcctccccagtagctggtactgtagtcacgcgccaccatgtactgattttggaaaatggtgattttctaactccatcattccttttacttctgttcgttggcattctatcagcttgtcttttcatccaccctttacagtgcttggcacacagtaggcgctcatataattgttcaacgaatgaatgaatgaacttttctcttgtgttgtccggccttcggtgacactagcggcgtcaggcaggagtttgacttcctcagcctatcatggcacgttgccgaggcttcagcgccttacaggacctcgctccaggctcttctggctccaatcaaaagcagggctctttcggacttcgcttacgtttaataaagaaaaccggttggccccttcggctccacctggctcaacagacagccagtggcatgcggcagggaccaatgggtggcggagggaggcggggcctgccacgaggccgcagtataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcggtaagagggtcacagagctcggtcagcgcggaaagctgaggggaacggagggcgaggggcacgccgggcccccgagggacaccgagggaagtccttcccgaacatctccgccccggcggtggtggccgctgaggggtgtggcggggcgacgtggcaccgagcgccgccgcagctctcgactggggcgcttcctcggcgcggagggctggtacccgaagcccgcctttcggagggagccgctctcctgcgactcggggcgtcgccggggcccgtggccagtcggcgggcgggacgggggtggcgtgcggaacgcgaaggcatcagtttacgcggagccttccgacagcgccggccgcctctggctgggatgctgagagtcgtctgggggagaacaggcgagggttccaaaagagcagccctcggcgagttgtccttgcggggaccctagcggcggagggcgctgctgcagctgatgaaatcgcggagccgacttgctcggggtccccgcgccgccctcctccctccgccggtgggagtggcccgcgctgcctccgctctgccaggaacatgaacggactctgggcaccctagctttggctgcagcccaccagagcctgtcagtgccgggctgcgtacatagaggtggcaaacatccgggaggctcccagggccttagggaaagggggaatggagagtgacaagtacccatatttcagcggtacttgcagaatttcagttttacaagatgaagagttctgaagatggatggtggtgatggttgcacaacatatgaacgtatttaataccactgaactgcacttaaaaatggttaagatgggccgggcgtggtgacacgcgccgaggctgaggcacgagaatcgcttgagcccaggagttcgaggctgcagtgagccgtgattgcaccactgccctccagtctgggcgacagagcgagaccctgtctcaaaaaaaaaaaaaaaaaaaaaagttgataaggtttatgttatgtgaattttaccacaataacaaaattgggaaaaatatacaggggaggaggaaaggaaaagctctgtttgcatttttgggtttccttgggaaggtgatttggtcggtcattagagcgctggcattgttggcattgttagagccctgcaccttacaacatcagccccttctttttttcatctaacgttcactgtgtaccagacactatgccaagctgtgcgaattcaaagatgagaaaaactgttcttaatggagctcatgttcctgacaaggggcagaacacgcgtgtaatttccagtcagtgcggaaatgctgttagaaatatttcaaaggcgctgcttgttggagcaatgagttcttgaaggaaaacgtgggaggggactttcagggttttccctggtctgactcttgacctcccccatgtttcgttactgtgtgttttctccccttctccctcttcctgagtgctggcctcatgtgactgtggaccagacctttcctaggcttccatggtccaaaagagatttataaagatgctctcattcattacctaaagaactgggccagtttgtctacactctccaataacaaatgctcttttcactacctttctgaaagaacaagtaagcttcatccacatctctgaaagcaatccatattatctgtactgcacatttgctatttacaattcccacatattgctttcttactgctgcttattttttaaaatactgtttatttttaaatactgcttatttttaaaaagttgtatccttttaaaaatatgagtctgcattctttttttttttttctttgttggatggtatgagagtttcaggaacataaacctatggttggagaaatagtagcctaggagacagtgggattaggaagtcaatggactttagaggcagaagtttgcctttgaatcttgtttctactatcctcagtttcatcttctgtattacagtgttattataatagtcccaaggtaacagagtaatatatgttaaagtgtaagcaaaacacctagtgtttaatagatgtttgttcctttctccattatgtcttccttcactcattatttttcccattaataattgataacaactcttccctaaatcacttgattatgaattgtaaaatgtcctgatactaatttctcatggaaaattacagtactgtaagctattgaattaaaaggaaagtgaagatgctactcacttggattttagttttgaattttattttattttttgagacggagtcttactttgttgcccaggctggagtgcaatggtgcaatcttggctcactgcaacctctgcctcctgggttcaagctgttctcctacctcagcctcccaaacagctgggactataggcgcacaccaccatgccctgctaatttttgtatttttagtagagacagggtttcaccatgttggccaggctggtctcgacctcctgacctcaaatgatccacccaccttgacctcccaaaatgcagggattacaggcatgagccacagttttggattttatttgaacagtcctcttgacttcttcctattctgttgattacctatcttaatgggatttttttctttcctttttttttttcttttttggcaggggaatctctccctaggtcaggttggagtgcagtgctgcaatcacggcttactgcagccttgacctcctgggctcaagtgatcctcccacctcagcttgtgagtaactgggaccacaggagcataccaccatgcctggctaatttttttttttttttaacttttagtagagatggggtctcaccatgttgcccacgctagtcttgaacttggcctcccaaaatgctgggattacaaggcctgtgccaccatgcccagccctgggaattttttctaaacacatctgtgaatgcatttaattctgggataaatgttagctaatatagttacaattttggattccccgtgggacttagctgactctccatttccctgtttattttggggtagcagttaatctgccccttggcaaaagagatgatgctaaattagttaatgactcactcccaaggctgtatttcacattttgcagagttgtgggaagcagaggagggctgacagttatactatgaaagatattcattgcatgtgactttgtttttggttcttgttactctttgactgtttttctttcttttctttttttttttttaagcaaattggcataacatccagaacctgcttttggaagcaaagtttgggacttggaacactggcttttcccagaaccctgtgtccttaacttcagtatatgattttatctgaatgtgctaataccattttctctaagtttactgctttcaaaagaaactttttatgaggtgcaagctaagtcattctcactgactagatatacatatagtgtatatacttatatatatctccttatgtgtaagtgtatctattttaaggatacatgtgtatgtgtgtgtatatatacatatatatataaaaccaagagaaaagagtaagaaattagttttattgaacatatatgcctggcacattatatatgtttgttatttcattcaacataaatgactgttctaagccgttttaaagtagtctttcactctgtagtgttccaggattaggaatgtatttttggcctgcggtgggcattccaggtactaatacaaatcaggaatgaggaatgttgccaggtgtatttgtatcagcaaaacccccctattttaattttttttttttgagatggagtctgactctgttgcccaggctggagtgcagtggcacgatctccgctcacggcagtctctgctcactgcaacctctgcctcccgggttcaatcgattctcctgcctcagcctcccaagtagctgggtctacaggtgcgtgccaccatgcccggctaattttttgtatttttagtagagacggggtttcaccatatgagccaggatggtctcaatctcctgacctcatgatctgcctaccttggcttcccgaagtgttgggattacagatgtgagccaccatgcccggcctgcaaaacccttttaatgaagtcctcttcgactctaattctgaaatggaattgtgaatattaatatgttttcaatttcttcatataccatgggtataattaaatgctattatatgttgtgccatgctagtattatataaaatcagggtaaaagtatttgatttgctgtaagattgtaacttttttctttttttgagatggagtcttgccctgttacacagtctggagtgcagtggcgtgatcttggctcactgcaacctatgcctcctgggttcgagatattctcctacctcagctcccgagtagctgagattacaattacagggtcctgccaccatgcctggcaaatttttgtatttttagtagaggcggggttttgccatgttggccaggctggtctcaaacccctgacctcaagtgatctgcccaccttggcctcccaaaatgctaggattacaggcatgagccaccgtgcctggccagattataataatttaatacttcacaagatgcaatacagattaagataaagtttatatataagattattgcattatatctaagatgttgagatttggtttaaagttggtatttaatcataatgcaataaaaaacacttattgaaggcctaaagattgtgaaagctttaaaatcccatttaaattagcagttactggccgggtgcagtggtgggtgcctgtattctcagctatggaggcaaaagctggagaattgcatgaacttgggaggctgcagtgagctgagattgctccagcctgggcaacagagcaagactctgtctcaaaaaaaataaataaataaattagcagttatcttgagaattaattttatctgaccctacaggatattcagtaccttgatgttaggttttagaatataagaggagattacttcattggtcttgaggttagagcagtcttcatgacaccaaggacagagatctaaagggaaaggctttttttaatgggatcattttacttaaggaagagatgctcatctattttattttagtttagtttagtttagtttagtttagtttagtttagtttagtttagttttttgagatgcagtctttctctgtcgcccaggctagagtgcagtggggtgatatcagctcactgtaacctctgcctcctgggttcaagcaattctcctgcctcagcctcctgagtagctgggattataggcgcgcaccaccatgcctggctaatttttgtatttttagcagagacggggttttgccatgttgaccaggctggtctggaactcctgacctcaagcaatccaccctcctcggcctcctaaagtgctgggattacaggcttgagctaccacgctgggccagatgctcatctttaagtaatgggcactttactgtaaggacatgtgtgaaaataggaaaactgggactcttccacatttgggtttcatggaacccaggaagagttgcataagcagttctctttgggaagagacagcctttcgggcagctgaacatggttttgggaactggaggttcttctagatcctgatttttcttcttgctccccacctcagcaacagttttctgatttcttgccctgttgtctcccattggtgtgactattattctgcctattctttctgtctttgttctgtggttctagtttgaactgcctcagggacgagctcttactggttcaactaactctcactgctctgttgagctaagcttttgcgccaactggaccactggccagcctagagattgttgcccttggcgtcacatactcactcctggtctgtcagctttggatgatatggtggggtccctgggaagagcacattgccaactgtgagaaggagcttcctccagtcccctgccctgcccctattcttaccaggaaagtcttccccagaagggactgtggggagtggtggtcattttgatgtttgacctgtccagtatgttgtttgtttgtttgtttatttttgagacggagtctagctctgtcaccgaggctggagtgcagtggcacaatctcagctcaccgcaacctctgcctcctggtttcaagtgattctcctgcctcagccacctgagtagctgggattacaggagcccaccactacgcccagctaatttttgtatttttagtagagacagggtttcatgtgttggccaggctggtctcgaactccttaccttgtgatctgccctcctcggcctcccaaagtgctgggattacaaacgtgagccatcgtgcccggcctatattgtttgtttattcaactacagaatataatttatcgatttaaaccaccataaaaatgaagtcagttgactgggaaatgatttgaaatacatgcctggctgctaacaacagggacaaaacacgaactacaaatggcatataagcagataagaaaaactatttaacctcatggtgaggggtcaaacaattgcaaattgaaactgtaaaacacttagtaatgatcagggcgcagggtggtgtagcagttaagagcccagactgatgtgagactcagcttgaccaagcgctgtcagtcacttaaactccctgagcttcaaattaatgataataatgatttctatcaactttatccccctccatatgtagctggatatattcattcatttatttatttatttagcagagacagggttttgccatgttgcccaggccagtctcaaactcctgggctcaagccatcctcctgccccggcctcccgaagtgctgggattacaggcataagccactacacctggcagagttttagtttttataaaaattcaagttatttggttttgtgactctgttgccttctgcagaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggtatgtgtccttctgagacctcgactgcggttcagttgaggtttatatgaggcaaagtccattctaatttatgatttcttttttctgattaggaaacccaagcagaggaggctaatgtgattgaactgtatcccaaaactttgtcataggaaatcagactatatctttcggggtttatacagtaggacaggagatactggttggtattctctgtggcttctggaaagaatataagctacattctgttcttagtctttatatttgataggtgaccctgaatgcattttacatttgctttccttgagcaataatgggtctccagtggaggtgtttgagtgtttgcagcttaaagccttagaggcttagggggcatgattgagcaatacagtattaggtgacctcagtgatgaggtcaggaacacagtcgtagatttgaaggaaatgactctgacttctgggaaatagctttcaagttcttcaccgattggttctaaagccaaacatgcagtttagaagcagttcaggtctggatgatggggtttgtgttctaggtctcacggtaccacagattactgtgtctctgtggacaagaggtgggtgggcaggctcagatatgcctctgcctgcccatctgtgggcctgtggtctgagcagcaggtggcctttccttcgaagggctgtgaaaccactcgcgtggctgggtggggttactggcctgtaagcctgtggttttctctgttctttattattgaggagtgaggcctcctgctcttttaattgaaagcctttagaaacctctagataatggcaagccatggcattttgttttgttttttgagacggcatttcgctcttgttgcccaggctggagtgcaacggcgtgatctcggctctccgcaacctccgcctcccgggttcaagtaattctcctgcctcagcctaccgagtagctgggattataggcatgggccaccatgcctggcgaattttgtatttttagtagagatggggtttctccatgttggtcaggctggtgtcgaactcccgaccttaggtgatccacctgcctcaggtgatctgcgcctgcctcagcctcccaaagtgctgggattacaggcgtgagccactgtgcctggccaagccatggcattttaagacattgggaggtagtgtggtgcagaaaaaaagaacatggattttggaaccagaaagactggctgtattattagctcgcttatttatttatttatttatttagagacggagtctcgctctgttgcgcaggctggaatgcagtggtgcgatctcagctcactgcaacccccgcctcccaggttcaagcgattctcctgcctcagcctcccaagtagctgggactacaggcgcgttccaccaagcctggctaattttttgtatttttagtagagacgggttttcaccgtgttagccaggatggtctccatctcctgacctcgtgatccgctggccttggcctcccaaagtgctgggattacaggcgtgagctactgtgcctggcctagctcgcttatttttaaacctctctgagcctcagtctgtctgtaaaataaggttaatgaagattgcatagaatgaggtatacaggatgtgttaagctagtattctctggtgtatatatttgtgaagttacttttttaggttccttgagctacttcagcttttagggatgagtgtgatgatacaaaacccgtatggtagccaagtatggtaggcaacatagcagtgctcattaaatgcctcaaaaatttttttaacctcaaaatttcttataataggaatcaacagtgagacaattatgaaaccagcttcaatttcagaggaagaattgttgaatttaatcaataaactgaataatgatgataatgtagatggcctccttgttcagttgcctcttccaggtgagttttggactccatttaacatgattgctgctgcttctgctcctttccctctccctccctctctctctccctccccatccccctcctcctccctctcctttccttgtctcactctgtcacccaggctagagtgcaatggtacaatcatagctcattgcatgctcaagctcctgggttcaagggatcctcctgccttagcctcccaaatagctaggactataggcatgtccaccatgcccagctaatttttacatttttcctagaaatgaaagtctgtctgtgttgcctgggctggtcttggactctgtgcttcccaaagtgctgggattacaggcatgaactaccatgccctacctaaaatggtttctgaggggtaaaaaggccttgttactttatacacctggttcttcatgtggatttggcttaaaggcaaaataaactcaaaagagtgaatattttattagaaatgggacagaccaactcagaataccaattacgccttgatttagtattgtggtcttgatacaaaggacagtggagggaagcagctgtgatagacgatattggctttgctattggtgtttggctttgcttatgcgagttccttccatgcagatgaagtacatctcagaggcaagctgtagaagaatagatttccttgcgaagcagataagctggagtcaggcagtgctgactatgcggtggtgatttaaggcaactgtgccaatttctttttcagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggtaggtatatcccagaattgcatgtctgtgttaatattataaaagtagtactggcaaatggtaaaaactcatacagtcccaaagagtggaaaccctactgcatatcctctagtcttactccccaaagtttacctctcttaacagttttttttttgttttttgttttttttgagacagggtcttgctctgtcacccaggctggagtgcagtggcgcgatcttggctcactgcagcctctgcctcctgagttcaagcgattctcatgcctcagcctcctgagtagctgggattacaggcacgtgccaccatgcccagctaatttttttatttctagtagagacaggtttcaccatattgaccaagctggtctcgaactaggcctcaggtgatccgccccctcagcctcccagagtgctgggattataggcatgagccatcgtgcctgcccttaacagttgcctatgacagtttttgctttttaatccagaagtctcagtgaaggaaattttctatttttctttttctttttttttgtttttgagacggagtcttgctctgttgcccaggctggagtgcagtggcgtgatctcgactcactgcaagctccacctcctgagttcatgccattctcctgcctcagcctcctgagtagctgggactacaggtgcccaccaccatgcctggctaactttttttttttctcgtatttttagtacagacggggtttcaccgtgttagccaggatggtcttgatctcctgaccttgtgatccacctgccttggcctcccaaagtgctgggattacaggtgtgagccatcgcgcgtggcctctatttttctttttaattttttctttaagagtcagaggtttcatcatgctgcccaggctggtctcaaactcctggcctcaagcaattctcctaccttagcctccctggcctcaagcaatcctccctcctgctgggattacaggtgtgagccaccgccccagccctcagtgaaggaaatttaagatttgatagtggtgacagtgcacattcctgtaacattttgtagcctgtagtatgctttctcctgttttcttttagcccttattatgtgtagcaagttacagctccagttgactgatgaggcaaaattgggttcatgttctaggccatctgactttgttttcctttggactggcactacttttaatgtcaatacatatatttttataggcattccaaccctagggaagaatgtggttgtggctggaaggtcaaaaaacgttggaatgcccattgcaatgttactgcacacagatggggcgcatgaacgtcccggaggtaaggaaattgctttcagggaacactgtccttttttccccatgtaagaactttcagaagccatcctgtgcatgtttggaagtattaactctgttatactttgtatttgttgaaattttgttaacagacaattcagggagtaacctttgtagagaagctgcacccagtgtcacctgagtttctttattattcatttatcatgtaactagcttcagaaataaatttaagttttgagtataagcatggttgtaggcaattagaaaatttcagctatagctttgatagctggagctaaggagcaattcttattcaaagatactgtgtcatttagtggaaaaaaatctttagccgttgcaaaggattggattggtatgactgtaatgtgtcctgtcaggttctgttaattggttctaaggtaaagcctcgtcaatcagttatcacataattattgtaataatgaccttacatgattatatcagaaataaaggcaaaactatatactttcaactatctttcaacatacttaaaacaaccttgagtaattttagtgatattttgcttagaaaaggtaaaattcttgaaaggctttaaaaataggatgaataaatttaattatatgactcaaaacagtcgagctgggaccaatgggttaaagctatatgatattaggtattaattttaaaaaagtaaatgacaattagctgttcagaaaacatggcacaagccattaagtcagtttttttttttttttttttcctggagatggagtcttgccctgttgcccaggctagtgcagtggcacaatcttggctcactgcaacctccaccttccaggttcaagtgattctcatgcctcagcctcccaagtagctgggattacaggcatgcgccaccacgcccagctaatttttgtatttttagtagagacggggtttcaccatgttggccaggttggcctcgaactcctgacctggtgatctgcccacctcggcctcccaaagtgctgggattacaggcgtgagccactgcacctggccgtaagtcaattatttttcagagatgttgagtttctacaatgacttgactagttgagacctaatccaatcccagctttgtgtcagaaatcaagacatctatttttttctttctaggtgatgccactgttacaatatctcatcgatatactcccaaagagcagttgaagaaacatacaattcttgcagatattgtaatatctgctgcaggtaagaacacaagggggatggagggaaggacttcacctcagaagaggaggttgtacccctcatcttagaattcgcctgcctagctgctattcatcattccccttgtaatgattctttgagctgcctacaaagatgaggatagagttgtgattggaataccggtttctggcagtccattatagtctagatgggtgaatgttattcctaaagcttcaaaatatttatattaatatttactgtataaagtttaaatggttccttttgtttcctgtcaggagccaaaataaaaaaataataaaagtaaatagttccttagttaatatttttaacaggttttaataaaacatgttgattagttcttcagggtctcttgaaattgaagttagacaagaatctgacaggtagactgttttcagtactaagttgatctttcctttctccatttccaggtattccaaatctgatcacagcagatatgatcaaggaaggagcagcagtcattgatgtgggaataaatagagttcacgatcctgtaactgccaaacccaagttggttggagatgtggattttgaaggtaaatggtgaaattttatttttaaaaatgaaatcaataaatactacctttcatggacatttaggatagattatttacttttttttttttttttttttttgagatgggagtctcactctgttgcccaggctggagtgcagtggcgcgatctcggctcactgcaacctctgcctcctgggttcaagctattcttctgcctcagcctcccgagtagctgggactcccaaagtgttgggattataggtgtgagccactgcgcccagtcagtatgcttttccctccctctctccttcccttccttctttctttccttccttccctccctccatctctctcccttccttccttcccctcccctcccctcctctccccccacccctttcttccttcgtttctttctctttttttttttttttttttttgagacagtctcactctgtcacccaggctggagtgcagtggcaccatctcggctcactgcagcctccacctcacagcttcaagcgattcttgtgcttcaagcctccccagtagccaggactacaggcatgggccaccacgcccaactaattttgtgtatttttagtagagacggggtttcaccatgttggccaggctggtctggaactcctggcctcaagtgatccacccgtcttggcctcccaaagtgccgggattacaggtatgagccactgcacctggccttagtaggcttttcataagaattagagaaacctttttaaaattatggcttttctagaattattttaggtgttttatcatagtgatggagagcagttataaacttttcagggaattgtttttttccttagacttatttcataattcaagcaatttcttgacttttaacaagtttgaaaatttgatgaagtgatttttctaaaccatggagtttcccaaaaagtgttagagatttctcattttcacactgagagatcacaggcctagaaagttaaaatggtccaggaaaaaaccatacccctgaaatactagaatatactagtagatttcttctttcagttctgtttttttttttaagaggcagagtctcactctgttgcccaggctgtagtgcagtggtgtgatctctgctcactgcaacctccacctcccaggttcaagtgattcttctgccttagccacccaagtagctgggattacagacatgagccaccatgccggctaattttttgtattttcagtagagatgaatttggctgtgttggccaggttggtcttgaactcctggcctcaagtgatccgcctgcctcagcctttaacagtgctaggattacaggtgtgagccactgcacctggcctctcctttcagttcttaagatagaatgtttatccgagttttatgctgataatcctttttttctttccttttttttttttttttttttttttgagacaggatccctctctgttgcccaggctggagtacagtggcaggatctcagcttactgcaacctctgcctcctgggcttgagcaattctcctgcctcagcttcctgagtagctgggactataggcacatgtcacctcacttggctaatttttgtattttttgtagagatggggtttcaccatgttgcccaggctggtttcaaactcctggcctcaaacaatctcccccacctcacaccctgcctcagccccccagagtgctgggattactggcatgaaccactgtacccggcctatgctgataatcctattcctagctttctgtttttattaaagcagtcaaacccatgcctaggtatgtaaggattttcactttaacattaggttaattttttttttaacttctcacttttaaaaaattactgtgctttctgctttggacaaattatacttaaaattaaattaagaaaatgctataggcaggtattgaggtaatgcttattattgttatacttacaactcccacacagttaacctactagatatttctttaatagatttctttataggttacttagatgtataaatattccttgaacaactctgtatgtgcatgttattttactagtgtgttcacaaaaccttgaatgatgtagatgtgatttttgagttttatgcttatgtatgttactttttccttgcatgcttgtttaataatatattaaagtacacacatgtcctttgccataactaaagcagcctgcctgtcttgtttctatgtaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtgtggtatgaatttctgaaattctggcttcctatgactcctagttgtgacctaaccagtttttttctcatttaatcaatgtagctattcctatattcagtaacacttacttctatagccttaaatagataattttttttcttctatttttttttttttttttgtagagatggggtcttgctatgttgcctgggctggtattgaactcctggcctcaagcaatcaatcctcttgcctcagcttcccagagggctgggattacaggcctgggccacccacacccaaacagaggtttaaagagctttggagaaaccagcctcgtcctccagtctctttgtttgtttgttttgagactgagtcttgctctgttgcccaggctggagtgcagtggcatgatctcgggtcactgcaacctctgcctctcgggttcaaacaattcttgtgcctcagcctcctgagtagctgggattacaggtgcatgccaccatgcctggctaatttttgtgtttttagtagagatggggtttcatcacattggccaggctggtctcaaactcctgacctcaagtgatccacctgcctcggcctcccaaaatgctaggattacaggcgtgagccactgcacctggcctgtcctacagtcttatatcacaacaggttgtgccaagctaggagcttaatctgtaaaatacttgaggcagggataggtttgtctgttttggcttttggctttcatgcgagcagaagtagctcctgctctaggcagcttgaggcagaaagagaagaaacaattgagttgacctacctccgtcctcgttcttctgccagctggcgttattcttttgatagttctctggagtttaaagaagtttagatagtttgctggagatgtttttgtaagtgacgtatagcttatgtctctaatccatgcctgcttacctagattattaaatgtggagcaagatgaccagacaggattaaattttattgaattacagttacaagtggaaaaaatgactgacttactgcatggagaagtattatgtcaacctgttaaaagctatggaaattaaaatgttcatgtatatacaaaatataaatgacatgtaaggtaaaattacagtgatcaatttacaacaaagaaattaacagtagttttccagcttgtttgattaatcaagcaggtttactcttgaatccatagcatttctacaatttaatttggacaaagttctattccagatcagccaggttttaaaactgaaatgtgttaagggtggattgttagcttccccaggattggtgtggatgataaatactttttttaaaaattaattattattgtttataagacatggattccagctgtctccctggctggagtgcagtggcatgattatagctcactgcagccttgaactcctggacttaaacgatcctcctgcatcagcctctgaaatggctgggactacaggtgtgtgccagcatgcctagctaatttttaaacatttgtttagagatgggtctcactatgttgcccaggctggtcttgacctcctgacctctgctgattccccccacctctgcctcccaagtagcgggattacaggtgtgagccactgtgtctgacaagaatttatacttaagcataggagatggttctggaaattctaagaaattctgctctcagtaagagtagaggtttggagctttacctcttggcagtatcccttggaagggagctctgagattaaatgtaatcaaacacttattgagagctttctatggaccaggcactacactagacgctgggaattacagaggcaattacctgtcctatactcaaggtgttaatgatctagtgtcatttttctttaaaaaagaaagcacctgcatttgtcatcttgagcaaatatagtaactctaacctcaaggttcaagtgatttactcaaggtttaaatcatagttgttttggagaaagtaagtgtcagatgcactgtggctgtcagggtcatagt

SEQ ID NO: 16628 - DNA, 30974 bp, Human
ggctgtctcagcagaggacactcctcattcacaccatctcctgcctcaattttcagttaatgaggaagccagacctgtaccaagccattgcaccaggtgacccaaaaccacctggaactccctgtgcgtttagcagggatgcaatgcatgcttcttctattgaagcgggggtatcctgggcaccgggtggggaaagtttaagaaacacagatggctgaggcctattcactgagtttctgtttcaatagggctaggtgacacctgagaatctgcattgtgagcacattcccatatcatgctgctgctgcactctggtggtccccatgctttgggaacctctgtgttgaagacgaagcagagtcaggaaggccagtcaggaagctgcgccccactccaggccagataggactggagcctgaggcagcgcaggccagcagggattgagggaggacacagagctgaggggcatttctggtcgggggagcaccaggctgtggtgcccaggtggttgtgggagcatgagggagacacagggttctagactgactgacttctagcttgaagggccgaggggtggacttggaagttggcaacccaggaggcacagcagctttgagggtagggaagaagggttcagttttagacaggatgagtttgaagagctggagagtcatctggattgggatgtccaataggcaattgatcattttagtctggatcagggtgagggagggggaccatgagaatgtggagttgaaagtaatactgcagagctggtagctgataatgtgggaaatgaaccagctacctagggatagtacatgaattacacaaagaagagcaatcatcagccagccatggtggctcacacctgtaatcccagcactttgggagaccaaggtggagggattgcttgaatccaggagttcaagatcgagaccctgtctaattaaaaacaaaacaaacaaacaaaaagaagtccaggcgtagtggctcacacctgtaggccaaggcaggtggatcacgaggtcaggagctcgagaccagcctggccaacatggtgaaaccctgtctctactaaaaatacaaaaattagctgggcatggtggcaggtgcctgtaatctcagctactcaggaggctaaggcaggagaattgtttgaacctgggaggcggaggttgcagtgagccgagattgcaccaatgcactccagcctgggggatagggcgagactctatctcaaaaaagaaaaagaagcagctcaagaatcacaggactgtggaaaatcctacaggccaagagtcttgttaggtgtgcctcaaccctgaagcaggtccctcagtctgcagatatttagagatatttaaaggaaaaccaggaaggagccaagagagaatgaagcctaaggtgtcctgagaccctcagagaactcagcccaagggttaggagcttgtgtcaaggtgcagcaggtgagtagggcacgcaggatttctttcctgggtacggaaggcatttctcttcagctttcattggtcccaggctcgtgccagacaaggcatgattgcacccattttggggacagtgcctgggcgtcccaggcagacccaggggccgcatgcagcagggcctgaggagggaggtgtggacggaggaggcccgctgccattcttggtatggttctcactccaggagcacagctgcatctggtctcactctgggcagcttataaggcctggtgtgagttttgtttatgcaagtgcagcataaaaggaacaaatctaccagcaccggggctgttgccactgagtccttttgcatacatttttcaaatgataactcactctacccaccccccttccctacccccaaggcgatttattgaaaaaaccaccttatatggtaatattgctaacacaccgtcagctggcctttttagggactttgtttaaagaagatccgcctctggggttttatattgctctggtattcatgccaaagacacaccagccctcagtcactgggagaagaacctctcataccctcggtaagtactgtacggcttttgccacctcttcctttccggggctgcctggcctcctgggtgcgggaggtgcctccagattggcctggcttctgtgacgctggcccagatcacacaccagagcccttggtgggcagcggcacctgcaagcatactgcagcctgctgagaaaaggcgtatctggccatgggacatcctggggcaggggcagcttggaaccgtgctccctgcctcagaatggggactggcgggatataatgcctgcagtctctactagccctgctccccagggccagtgcagatccacaccctgatgtcctttgtcttgggttagaatgtctgggaggctgttttaggggatcatatactttgcagaaaagcagcttttcagaatacttgagtcaaagccaacagtggtcctggtgtctgtgagctgtttagtccatgaaatgtctgtgctgggaatgggagggtattttcttcaggtcccctgtgggtctctctgtcctctgatctgtgcttggctgaggagaatggagggtttctgcagtccttgaaggctctaggatcattgggggatggagaaaattccacttgccctgtggcatcgtgaggtttcagggtagaaggaacttgggacccatctagttcattctcctctgatgaggacattgaggcctagagacgtacagccactcatccaaaagactcacacccaactgtgacccatttgcagatgtcattactccccccaacccacccaacacacacacaacacatgcacaaagaattaagaggaagatgagatgaaggggccacttctatgtttggcatcagaattcactagcatctcttcacaggtgaggcaggctgggtgtggcagtgcaggccttgaaggcagactgtcaggctaaccaagttactgagcgacctcagcttcctcacctgtaaaatgggggcaagaataataatatctacttggcgatggtgtgaggattaaacgagagaatgcgtatatacagcactcagctcaaggctgtcagggcccggccctgagttctcaaactttaagaatcacctggagtgcttgttaaaacacagattgccccatgccccaccccagattctgattccagtaggccgagatatggcctgatacttggaattcctaacaagctcccaggcgacactgaagctgctggtctgggaccacactttgtacagggaggctctaagtgctcactttgattacttgaatgtgggtttggactctgatactaacccttgggctgaaaagaggaagagcttcctgtgacagagagggatgggtgctggagaaactgcaatgaacagtaagatcctacatgccaggcctgagaaaaggggatgggccgtgtgacatcatgaccttggggcgagatatctttcctctttccccttgttcattctgccaacatttattgagcacttattatgggccaggcactgtctctgctccttagggacagtggagaggcttctgcagttactggaagagacagataaacagatgagaaccatggagcaaataagtacacgaaaggggtaaaggccaggaggagcccatcactcaacccaggagttatcagggaagacttcctggaggaagaggtgcctgagcttggtcctgaagtaaggaccaagcttggtccttcctggtaaagaggaagcatggtctttgggactcaagtggctcaattccactgaatttagatagcaaggcaggaatcaggtaaaactaaattcagaggggtccgcagggctggattacaagggctttagactctaaaggatcaggctatggggagccatggaagggttttaatctggagggtatctgttgaaggggctgctttggcagctgtgaggagagtggactggaacagggcaagagcgctactgcagcatgcggtggtcctgagctggtggcatgggtgccgtgcaggtagaagtaagaagggctggtgataggttgggagggaagagggcggcaccagggcattgggcatgggctcagggtgggtggtgtgagtctgtgagggcagctccgggcagaggctgctgatgaggagagcagtcctggaggtgtggagttggggtgccaggggggttttggtgggggagatgcacggcaggctctgcaggcctagagctcaagagaggggtctggacaggagcagagccaggggagtgaatggaagtccgggtaagagccagaagataaggcacccacgacagattgtggaggatccaaaatattactcagcagagttgtttttaattgaactcatgtatatatagaacctagtgaagatatcctgaagttaattagaggtgctgttagaattttccatcgtggcagtgtttttcatagacaatttctctctgccagggtttctgatggtttgtatatacgtgtaggcaaataataaaaggcagagacgcagctgcttacatgtcacttgaagctctcacccaaaaacctgtcgccaactattgtttgaaatctcatcatcgcagaggccctccgtttaggcctaacactttctgtcaaaatgaaaatgtctttgagaactgacataaattcaactttcaatagtcattgatgtgtgaaatggatcattcaattcctttcaatatgacaggcttcatcctgggagcaagttttgatggagaagagtaagagagattaataagaatcattattctttacagcccttgacgacagggattgacgaggcccagatagtaaatattttaggctttcggagcctgaagttctctgtcacaagtactcaattctaccattgtaaccaaagcagccatagataatatgtaagtgaatggatgtggctgtgtttcagtaagactttattagactctgagatttgaatgtcatataatttccatgggtcatgaaatatttttcttcttttgcttttttctcaaccgtttgaaaatgtagggccgggtgcagtgcttgcacctgtaatcccaacactttgggatgccaaggcagtaggacaactggaggccaggagtttgagaccagcctgggcaacatagcaagaccctgtttcaacaaaaaaaaattttttttgaaattagcagaatgtagtggccatgccagccacatgcctgccatcccagctcctaggatgaggagaaaggatccttgagctcaggagttcaagcctgcagtgagcttgatggtgccactggactcaatgcctaggtgacagagtgaggcccagtatctcaaaaaaaaaaaaaaaaagaaaaaccattctgagatataggccatacagaaacaggccggaatttgccttaccctgatttacaatgtctacggcaccttcatttccgttctgtcatcttgtgagatagatactatcatttccatgttctagcggaggaaactaaggcccagggaaggaagggactgggctgtgggaaaggggaaccaggagggagaagagggtaaaggaaggaggagcagtgggaggatttctagagccaaacttgtctcctttgaggtgctggggagggtggattttaacagctctgccctcacattgggtttgaggtggccagggagacgggtgagtgagtaaatgacttgcattcattatgtctttggtttctggccacctttggggctaggggaataaaagcttcattcctgagtcagtgagagcttcaatgaagcccagatgtcattcgtgctgaaagaaccagaacaactctctgctccctgccaagcatgaagcggttgtgaccccaggaaaccacagtgactttgactctggttcagctgacatgctcgagtctagccacaaattaccagaaagcagctgaggaaagtttagaatttctcctggcagagatggtccacgagtctggctccagggtgaaccccttcttcctagagcagcacggggccctttggaggctcaactccgccagccctcccactgccttccccctgccttccccaccctcacttcggttgagttttgccttcaaaatagcagactccaagccacctgaagggctgcagaacagcgttgttgacagcttcaagtcgccttgtggcttctctgagctgctgctgtgctttggaaacgaaattccaggctctccctctttctgtgtgtgggaaacaccggagagagtttggggagggagacaaaagggcccattgaaaacccagacaggcttgaactgtaagtcacaccggagagagggttgctgaggggaccctagagggaggcagtcccggagcacagctttgcttctttggctacttcctcgctttggaggttgctttcttctcaaggtggaccacctgctagaacagggcagcactgctgttcactggccagcttggagagaagactgcccatgtgattctaagtcaggcccttgtgactgaaccaccatgaggctggactgtggggactcgggtatcccagaggcagagcacaccaggtctgggaggggggccactcagacggcaacattgtcattcaatatctattgaacacctactgtcttaatccatgtttgttgctaccacagaatatgtgagactgggttatttataaacaatggaaatgtatttctcaaagttctggaggctgggacatccaagatcaaggcaccagcagattcagtgtctgtctggtgagagcccagagtctgcttccaaggtggcaccttgttgctgcaccgttacatggcagaagggcaagagagagtgagaagggaccaaattcgcccttttataaaaaaacccattcttgagaaggacattagtccattcaagagggcagaaccctgctcttaaaattggtaactaaatttcaacatgagttttgagggggacaaacattcaaaccatagcaccgcctgtgtgttaaacacccacttaggtgctggggctgtaaaaagtaaatctaggcgtggccctggcacaggagggactccatttcatagagagaaaagaacacagacccttttgttttagggtgcttgctgccaacagctctggagagacaggctgaagcaaaaacaccaaacatggagaagttatgacagttccccaaagtagtgacgaaggcacatctcaggcttgggaagtgtcctcggtgggtgccaggcctgcctttcccagcctcttctcggtgaagagatctctggctaagttctttaccttctctgagatttggaacatactgctgtttcacctaccaaagcaacttgcaccttttcttttccttttttttttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgcaccttttctattgtattaaatatttcagtttctccattgtatggaggcttccagcaattagtttacaagccaacttatttactattcagtaactttttttgatattgagattgttcctaattttgatcattttaaacaaaggtgtgaaaacaggccaaatcttttcattcactcatgactatttcacaaagatagattcgtagaataagtattttcaaattccctttcagaaaagtagtacaatttaacactcacaagcagtgaatgtgaagccaattctccatacctttgccagcaagggtggccccaagaaccacacacagtaccccagctaagggcaaaggtagcttttatcctggccatagcacactgctgatggtcaacaagacaccaagtcctgctcacagatgctaaacagagctttcttttttcttttcttttttttttcttttttttttttttttttgagatggagtcttgctctgttgcccaggctggagtgcagtggctcgatcttggctcactgcaagctccgcctcccgggttcacgccattctcctgcctcagcctcccgagtagctgggactacaggcgcccgccaccatgcctgggtaattttctttttttttgtatttttagtagagacggggtttcaccatgttagccaggatggtcttgatctcctgacgtcgtgatccgcccaccttggcctcccaaagtgctgggattacaggcgtgagccaccgcgcccggccacaagaactttcacagtttggtgattgaaacccacatataggaattcatattcatttcattaaatttaaccttggctgtgtgtggtgggtcacttgtaatctcagcactttgggaggctgaggcaggagaatcacttgaacccaggagttcagaccagcctgggcaacagagggagactctgtttctacagaaaaaaatttttatatcagccagccatagagcatgcctgtgatcccagctacttgggatgctgaggtgggaggattgcttgggcctgggaggtcgagtctgcagtgaactgtgttcttgccactgtactgcagcttgggtgacagagcaagaccccatctcaaaaaatatatatatatatatcttctgattcagctcattttctgtgccttttgagatcttcttggacttttattctttcacccagtgtatttaatattactctctcccagctgttttatctgaaaactttatcaacctgtgctttatattttcattcaattcatttataaaaatgtcacatgagaaagggtcaagagtagagccctgggacatattgctgcctcctcattgacattgactgaggcagccgcaaatataccaaattgtattattgcttagtacatggctttatcaagagggatatcctattctggaccttgtgggctggtttagagagtgaggactcatcactggggctatgggagacataaggatcagcagagacagaggcaaagctggatttaagaagtcacagcaggcctctcccctagtatgagccttgctttgaacatatctgggaagggcttccttttagtcttgaaaatgtttacaagcctctgctcagcatctacctagccttcagacctcgcgttctcaggcctgtggtgctgtctcctctctgcttcagtatggtcttctctgtccagcttctgcatgaggccatctggggccaagggtcacaggttttagaagttcccctctccccgctccatgccataggcacctgcaatcgcacatcctggataaaacttcagccggccttctctttatgtgcctggcgcctctcttttctctgggtttttggaagtctgcctgcccagcccctcagctggggccttccccacttctgccccgccccactgggtcctcccagggtaggaggcaatctctgactgtcttccgaggctctgttgcttctccttcatcaccaaatgccaggaatttgtcagatgctgtttgtaactcaaaagaaagaaagaaaaagaaaaagatacaggaaggaaggaaggcagaaaaagagaaagaaagaatgcgtgcagcagatgttgggaaagttaatttcttcattattttgcatccatcccagttcggatctcagcatggggtagggaatcctctgttgtccccatctgtcgaggcaacagtgagtcccatcatggagtcccttcttttcctctctcctcccagagtgccccttcctcatcaaggtgcttctacccttaggagtgtacatttcacctataaccactgcctattttttcctagtgatatgttatgctattgatttttaattatataaactatatgcaaatgcagcctccttgtaaaaaaattaaaatattatagatataacccagcacttcttctcccagttcctttccacactcccagaggtaatcatgataatcagtttgctaggtgtccttccagaacttttagcttctttctttggcttgtatatggccaccttctcactgcatcctcccgtggcctaccctctgcatgcatctggatcctaattccctcttcttataaagacacccattgtactggagtagtcatactggatgacagccatattgcattaatctcattttaacttaattacctctttaaagaccctatctccaaatacagtcaccttctgtgtactgggggttaggacttcaacatgaatttttggggggacacaattcacatttcagggcagagggaggaggctcaactgccagtgagtgggaggccaagcccatgcctgtccctcctggaagtgtgccctgattgcaggtagggtcaggccccaaagccaagaaactgtctccaaactgattggacaagtagctgactagttctcttctcccccaaatcccaaggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccaggtgcgtgctcatctggataccaccaggctttgagccactaggagtaagcgctgcactgtggagaccctgctgagctgggggttaggggaaggaaatgtgtgtgtgtgtgtgtgtgtgtgtgtgtgtgtgtgtgtgtgtgtgtgtctgtgcgtgtgtgtgtgtgtgtgtctgtgcatgcacatgcgtgtgtgcacgccaggtgtagggagttcttttctgattaactgatagagcaggaccctttaaatagaaatatccagggccaaaaccaacatacatcaggcacacaatgacactactatgtctggcttacatttggggggttgccaggtttggaaaaattaatttatatgggattgaacaagcctcttgcctttaagaaatttacactttgtgaagaaatacacataactaaccagagatcatgggctgtaatagaggtaaaatatttcacaggaagggaaaagtatcacagaaaaagtaatatctgagaataagaaggatttcagcaggtggagagaatagcaaagatttggagatctaagcaggcacaggggacttgaggaggatgcatacaagtcgtgtgtgtgtgtgtgtgtgtgtgtgtgtgtctgtgtgtgtgtgtgtgtgtgtctgtgtgtagtaggatgaggggaagaagtgtatgggaggggcttgttttatctcagaaaacatcgttgtctgaagagaaagaagaaaggccaccacacaagaaatcctccaccttctcttcctgacaccttcatactcactggcatctgctccatcctgtctcctgctatcctgtttctgggggaagaaaggctgtttttcccatccttatccttcttcagagaccttccagtgcctgaatccctctgtgtggagccctcagccattcatttctcttttcttctctttgcattgcagggtgtgatggtgggaatgggccagaaagacagctatgtgggggatgaggctcagagcaagcgagggatcctaactctcaaataccccattgaacacggcatcatcaccaactgggatgacatggagaaggtatctgtagacttccccttaatgagcctgctttaatgatcacccatcatcatgaccctcgtattcataggccactgtgctctgtcaactctccctgtaaaatgcttctcacttctgtctttcctttcttttcagccccacgaccatttctccaacctaggctgccaacatctctccctggactattgcaatggcttcctggctgatttcttggtctcttgccctcattcaccgaattaattctctacactgctgcaaaactgatctttctaaacacaggtcagctcatgtcactcacctcctcagaaatcttcagtagctcttcattaaccaacagggggttcctaactccccgtcttggcattggaggacctttccctgcctgatccccgcgatcatcttttcctgaaatatttactcaggccagtgctcaccccttctttaaaatgctggtgctggctcaagagaggcaaacagccatctctctcattcttatcttccctgtcaagacttcacataggtggactgatgctagactatgatgatgagtctccagtgaaagtttctaagtagaactctctcagggtttctagaagcatttttgtttaagaaaatattgtggggagagcgggatttttaaatggtggagctcatggtaaacaaaattatgtgtgcaaaatgttaatagagcctttctaatattcttgtgattaactctggtgacagttggctgagtgttcttgtttctgcaacgcctgtctttggaaatgtgatagggggcttattgagcagactgcaactggaaatgaggaatgttgacttgaagtctgtaattcacttatacttttctctaaatcctagactgagtcactcaatgtgagataagtactgcacataaaatgcaatggatttcacgttatacagtggagtgggtaagagcagagacattagaggcaatggcaggaaatccaggtgcaaatcccaccctataagtcttagttttcccatttgtaaagtgaagataaaaaacactttgtgcattaggttgctttggagattgaattagctaaatgcttagtataatcccaaggcatggaacatacttatgtgctcaataagtgacacatatgattcatatatatgtaacagtatctaatttaaaaacataataggccgggcgtggtggcttacgcctgtaatcccagcactttgggagaccgaggcgggtggatcacaaaatcaggagcttgagaccaacctggccaacatgatgaaaccccgtctctactaaaaatacaaaaattagctggacatggtggcgggtgcctgtaatcccagctactcgggaggctgcggcaggagaatcgcttgaacccgggaggcagaggttgcagtgagccgagattgtgccactgcactccactgtgggtgacagagtgagactccgtctcaaaaaaaaaaaaaaaaaacaaaaaaaaaaaccacataatagaggccagtggctcatgcctgtaatcccaacactttgggaagccaaggcaggaggatagcttgaggccagcctgggcaacatggtgataccctatctctatgaaataaaaatgtaaaaattcactgggcatggtaacacatgactgcggtctcagctattcaggaggctgaggcatgagaatcacttgagcccaggtggtggaggctgcagtgagctgtgttcacgccactgcactccagcctgggtgatagagtgagaccatgtctcaaaaaaaaaaaaaaaaaaaaaaagaaaggaaggaaggaagaaaacataatagacaaataatagacaaactattttattcacagtagtgacaacatgtgaactctttaaagaaacccttaaaaataaattatgtgccttaaggccgggcacagtggctcatacctgtaatcccagcactttgggaggctgaggcaggtggatcacttgagtccagcctggccaaccaacatggtgaaatcctgtctctactaaacaataattagctggatgtggtggttagcacctgtcgtcccagctactccagaggctgaggcaggagaatcacttaaacttgggaggtggaggtttcagtgagccaagatcgcatcactgcactccagcctgggcaacagagtgagaccctatatatatttttttttaaaaatgtatatatgtataaatataaaatcatttcattatataatcatttcattatatatctataaatcattgtgtgtgtgtgtgtgtgtgtgtgtgtgtatatatatatatatatatatatatataatcttgtgtgccttaaaagaaaaaccaaattgggtaaaagtgtcaaatgtcctcaaattaatttataggctcattgcattccaataaaaattatgtgacataattctaaagtatgtttgcagaaataaataagcaacaattatgagaacaaaatgaatttttttaattatgaaggaagacataatgtaataaaatacaatataaattataaagttaaaacaatttgataccagcaaaaaggtaaagaggaaatatataataaatgaaacttccagcatcagaaaggaggaaaggactagtcaataaattatttctgggacaactgattagttatttttggagctagagaatcttggtttatagccctaagctcataccatttcaccaaacacatgtcaattaaatataaaagttaaatgtaaacatttaaattaccaaaaatataatacagttaatgtgagcatttaatcaaatttctggtaagagtggtcatagagaaaaagaatgacaaatttgacttcttaaaaaatcgtaacttttaatatctcaaaaataaccaaatttaaaagccaaataacaaattgcaaaacaaaagggcaatgagggattaatatgaacagttaatgcaaattgacaattaaaaatatgaagtgtcccccagacaaataaaaaacagttaattagctgaacagaaattatgaaaagttgcaaatgtgaaaaaatttaaactcatttgaaacaaaaaaattgaagtaaaataactaggtatgatttttacctatcaaattatttcatattttaagagtgagagcactgaattcagttaagaatggggtaaaacagccacttttttattctgaagtaaagattggtttagcctatttgttaataacagaaatcagaaagtcttccaattgctatgttctttagcccagtcattccacttttagaatcttcttctttggaaaacatcctgaatacaaaaaataaattgcaatatgcacaaagataactatcataggattatttataaccaaaaatcaaagacaccatgaatagtaatgtgattaaatatatgatagtatatgataaaatgttatataagcattttcaaaagtttaagtttatcaaaaataaatatttattatgaaaagtaaaataatttgttataaaaacaaatttgaacatagtataataatataataaataaaagaatatgaaataaataatgatagtaataaatttaaaaatacataaagacaaaggttaggaaaaagaaaaaagccaaaatgttaactgtttgttgttaggtgatggacataggggagatttttattccattaaaaaaaattttggccgggcgcggtggctcacgcctgtaatcccagcactttgggaggcggaggcgggtggatcacgaggtcaggagattgagaccatcctggctaacacggtgaaaccacatctctactaaaaatacaaaaaattagccaggtgtggtggtgggcacccgtagtcccagctactcgggaggctgacgcaggagaatgccgtgaacccgggaggcggagcttgcagtgagccgagatggcgccactgtactccagcctgggcgacagagcaagactccatctcaaaataaaaaataataaataaataaataaataaataaatacatacataaaaattttgagctaggatcttcctctgtcgcccaggccggagtgcagtggtgcagtcataactcactgtggtcttggcctcctgggctcaaggaatcctcttgcctctgtctccggtgtagctgggaacagaggtgcacaccacatccagttgattttttaattttttgtagagacagggtctcactttgttacccaggctggtctccaacccctgggctcaagcaatctgcctgtctcagctccccaaagtgctgggattacaggcataagtcaccacactcgaccttaaaaatatttttctaactttaaaaattatcaacatctttaacttttaaggtataaaaactccaaaaaataaaccaaaatcaagtgcagatgcttgagcccaacacccaaggattctggttcagtgggtcagatgatcccaggtgactctgagacagggccttgaggaagcacattttaagtagcatggggtcccctccttaagaccagttgctgtccttcaggctcctgtgcaatgctcacagtccagggcctctgcctgtgccattccctctgcctcggatgccttttgcagcagcctctggagaccttcttttgccctcaaggcccatttaaatccctcagataatgaattactcctacctcttctttcacttaaaatgtggcttgtgtttttctttttgtttgttttggtcttttttaaacgtctctctcccctctggactttgcaactgagaatagggtgccatgtctgattcatatctgccctcatcacacttaccaccgtcttagcacaaacctggcggtccataaatacatgggtccaatggcatcaaatgaccctgtgcctcacctctgaggaaaccaaagccccatgtccctgctacactttgcccaatccctctgaaagactcctttttggtcgtacttgatcactgaagaaggaactggacacaggaagaaattaacttcctctaaaacagtggttcttttttatttttgagacagggttttgctctgttgcccaggctggagtgcagtgccatgatcacagctcactgcagccttgacctcctgggctcaagcgatcctcctgccccagcctcctgagtagctgagattacaggcaggcgctaccatgcctggctaattttttatctttttgtagagacaggcccacagtgtgttgcccaggctaagcggtggttcttaaccaggatgattttgcttcccaaaggacatttggcaatgtctgcagacattttttattgtcacaactggaaaactgctgctagcatccagtgggtggagaccagggatactggtcggccctccacaacaaagaattatccaacctaaaatgtcatagagctgcgattgagaaaccctgctttaaagcaccagcctggccaataatagccagtgaaaattgagcccaagtgcctctgtcagattctcagcaggagatagtgtacactcagctgcggttttgaaattgtttgacagtgtatactcagctggggttttacaactggttaaatgaatgtcctacagaaatgtgcatagggttaaggcaactacaaagggatgtcgaggcacccaagagccagcaacagagggagctctcacacccctaaacatgaaggggtcaggtgacgagggcagtgtcattggagcttagtgagagcttgagctctgaaagaggggctgcccaacaggaactgtgctcatggagggccacgccattgtcaggaaatagaccctgacttcttttgccctcctactttccagcctcttgcaggaatcttctatcagccaaatatagccagaagccagaaagcaatgaacacttgagtgatacaatgtgccttgcatcactcagtgcacaaaggcaggggagagactgtaggagagtgaagaggagggaaggtcaaatggaaataatgaacacatagaaaatactggttccaggtctgagtcctacctggggccctgttgagaaggagtataccctttaaatgtcaatcagaaatttccagggctgaccattctcctctccagatccatcccatcctgtgtaacatggtgccacactctcccagcatgggaatgtcaatgagaattttccagccattgggagtctgccaggctcatatggcttttgtctccaccagatctggcaccactccttctacaatgagctgcgtgtagcacctgaagagcaccccaccctgctcacagaggctcccctaaatcccaaggccaacagggaaaagatgacccaggtaagaagccaggaagacttgaacactggcataagaatgcaacatggatgcttggccagatactttctccccttcaaacatcagtgcaacagaactctctgaggacctgctatgtctgtggtccatgccaggccctgggggagtgggtgtggaataatgaactatcaaactggcatagttcctgcccttaatgagattacaaaccattctacaggccaagaagtgctgtgatttttgccaaataatcttttattcttcattgtcctttaagatcatgtttgaaaccttcaatgtccctgccatgtacgtcgccattcaagctgtgctctccctctatgcctctggccgcacgacaggtgagtaatcctgtaatccattccttttctgacttcaggggaggtagggaaaagctggggtctggcagaggctcctgctcagaagaatcaaatggacagctgaagtccaggcaaaatctttcttagggataataggtgagaatgcccatgtggaatgccagatgtgagcctagctggtatagttggaaaaaacatccagcaagaactgtttccctcacagtaataattccaggagcttctacacatacacacattccaacaatactggaatgtttctgcttcatgaagcagaaagagtagaacctgtggtggtggaaatgtaagtgcagttacacattgcttaatgacagggatacgttccgagaaatgtgtgtcattaggtgactttgtcactgtgggaacatcagagagtgtacttgcacaaacctagatgctgtagcctactacatgccccggctgtatggcgtggcctattgcttccaggctacagacagtatagcatttaactataattaatactgtagggaactgtaacagaatggttaggtatttgtatagctaaacatattgaaacatagaaaagttacagtgaaaatataatatcaaagataaaaaatggtacacctgtgtagggcacttacatgaatggagcttgcaagactagaagttgctctgggtgggttagtgagtgagtagtgagaaaatgtgaagacctaaaatgttactgtgtactactgtagactataaacactgtacacatcggctgtactacatttataaaaatattattcttggccaggcacagtggctcacacctgaaatcccagcactttgtgaggctgaggtgggcggatcacctgaggtcaggagttccagaccagcctggccaacacggtgaaaccccgtctctactaaaaatacaaaaattagttggacgtggtgtcaggcacctgtaatcccagctacttgggaggctgaggcagaagagtcacttgaacctgggaggcagaggttgcagtgagccaagatcacgccactgccctccagcctgtgtgacagagctgagctccgtctcaaaaaatatgtatatatatatattattctttcttcaataataaattaaccttagcttactgtaatgttttttaccttataaactttttaatttttaaagccatttttactttttttgtagtgacagtaatagaaaaacatcttttttcgacttttttttttttttttttttgagacggagccttgctctgtcaccaggctggagtgcagtagcgtgatctcggctcattgcaacctctgtctcccacgttcaaacgattctcctgcctcagcctcccatgacttttttttttttttttttttgagatgaagtctcactctgtcacccaggctggagtgcagtagtgcgatctcagctcactgcaacctccgcctcctaggttcaagtgattctcatgcctcaaactcccaagtagctgggactacaggagcgtgccaccatgcctggcttatttttgtctttatttagtagagaaaaaaaaggagtacaccctttaaatgtcgatcagaaatttccagggctgaccattctcctctccagatccatctcatgttggccaggctggtctcgaactcctgatctcaagtgatctgcccacctcagcctcccaaagtactgggattacaggtgtgatcatcacccccagccaaaaatattttcatttatatcctttattctacaagcttttttctattaaatttattttattttattttttacttttagagcttttttgataaaaactaaaatatacacacattagcctcggcctacacaggttcaggatcatcaataccattgtatttcatctccacatcttggcccactggaaggtcttcagggttaataacatgcatggagctgtcatctcctatgataacaatacctccttctggaatatctccggaaggacctgcctaaggctgttttacagtcaactttttatttaataagtagaaggagtacactttaaaataatgattaaaaacatagtataagagctgggtgcagtggcttatgcctgtaatcccagcactttgggaggctgaggtgggtggatctctttgagctcaggagttcaagaccagcctgggcaacatggctacaacctatctctacaaaaaatacaaaaagttagccgggcattggtagtcacgcctgtagtcccagctactcggtaggctgaagctggagaattgctggagcccaggaggcagaggctgcagtgagctgagatctcaccactgcactccagcctgggtgacactcaaaaaaaaaataaaaaaataaaagacagtataagaaatacataagccagtactagtaccatagttgtttattatcattttcaagtatgttgtacataatgtatgtgctgtacttttatacagctggcagcacagtaggtttgtttacaccagcatcaccacaaacacgtgaataaagcgttgccctatgacgtgatgtcagctatgatgtcactaggcaataagaatttttcagcttccttataatattatggcaccaccattgtgtatgtggtccgaagttgaccaaaatgtcattatgtggacatgactatatgtggccttggtatagaagtgtgctcagcgtaacagaggaaatctcaaaataaaatggtctttaataggaacttgacagcttccataaacatttgtttaaacgttcattaatcatttattcactgatttatccattcattcatccatcatatattttccattactccctacaatgtgccaaacatggtaccaggccatgggcacacactgacaaataagacagactttgtcattatggagctaacagtttagtgggagatagacaaaagtaaaagataatttcactgcatgtgataaggacaatgatggagaaatgcatggcatatacagtgtcgtatcctgtgctttgcactttggtttttgtttttgttttcattttgagatgtagtttcgctctgttgccaagactggaatgcaatgatgtgatctcagcacaccacaacctccacctcccgggttcaagcgattctcctgcctcagtctcccgaatagctggaattacatgcacctgcctctgcacccggctaatttttgtatttttagtagcaatggggtttcaccatgttggccagctggtcttgaactcctgacctcaagtgatctgccccccttggcctcccaaagtgctggcattacaggcatgagccaccgcgcccaaccttgcacttcgttgcaaacatcatgtttaatagccacgtggtagtcgttgtatgatggtttcattatgtatttattttaccatttctctattgctggagctttaggttgcctctcatttttattatacaatatgccatgattcaggtccttacacaagagtaagttgctgctttctggacatttattttgcatctggcccttactgaaccatctaactaggtctaatggtttcttaattgattctgttgggtcttctgtataaaaccacattatctgcaaataatgacaattttggtagtcacacctcctatttctattttctgtttcactgcaattggctagaacatcctggacaatattaaaaaatagtggtgatattgtaatgttttctcatccgttatgatgtggctgtcagattaagaaatacgaggctggacgcagtggcacatgcctgtaatcccagcactttgggaggccgaggcaggtggattgcctgaggtcaggagttcaagaccagcctggccaacatagtgaaaccccacatctactaaaaatacaaaaaattggctgggcgtggtggcaggcacctgtaatcccagctactcaggaggctgaggcaggagaatcacttgaacgtaggagacaggggtttcagtgagccgagatcatgccattgcactccagcctgggcaacaagagcaaaactctgtctccaaaaaaaaaaaaaaaagaatatgcaatgtagacttaatgcaaattgacaagtatgcattaccagtaatgtgtttcaaggaatacaaaaaaaggacacattttacttgccctccagaggcctacagtctcactggggggaaaaaagtgacatacataaaaaataaaaaatatgattgatgattcttgtgatgggtgaatattcttaactggtaaaggaaaatatggtagtcagagctcattggtaacagtcctagaaagagactgatgaaaggcaagaatgagaattttataagcctgatcctctctgtccacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacaggtatccagccccttttctgattctgactggagctcagaaccaatctggtttaggacaagaagttctcaggaccaatgagaattctgtgactctgtgtctttaaactctcctgagatagactgagaggccttaagctggggctaggcctctggataagaccagatagtcatggaagcagtccctccttccccagagaccagctgcctctgtccacgtccacaccaggactagggctagtttccacaggctgaatggtagtgaagatctgctgatgcatttcattacctaggggcacctttggtttgaggacaaattgaataagtgaggcccgaatttctaaggggaaggtgtcatgtggcccacctgggcaatcggcattttttaggtgggagcctctctaggttctgtaagatcaaacatctgagtctagaccagaaatatgtcctgcaaagcccccaggaaggcctaaggctttgtcagaaatctcatgcaaagtcctgcatgggaatcaagacttgagactccctctttagaaagaggagtagaagaattaagattgaatggagtgacgcttgaccctcttcgcggcaagtctatcatcatcctatgactgaacctaaagtagacgtgaggccaggcatggtggctcacgcctgtaatcccagtactttgggaggccaagcaggcagatcacttgaggtcaggagttctagaccagcctggccaacatggtgaaatcctgtctctactgaaaacacaaaaattagccgagcttagtggcgcacgcctgtaattccagctacttgggaggctgaggcaggagaattgcttgaactcaggaggtagaggttgcagtgagccaagatagcaccactgcacttcagtctgggtgacagagtgagactctgtctcaaaaaaaaaaaaaaaaaaagaataaagtagatgtgagaaggaggttttcatggagatcaaaatgggacaaccaaactatcagagctcagtattcaccttctgtcatttctgctccttccagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggtgaggtgctgcccacagtccctgccaatctcaggaggggagggtggaggagtgggtgaggtatggagagagaaacaccaggagtcatggccactttgttaattacatacacgtacctcacattttcctaggaagggccaaaaatgtattttaaaaaaaattagggaaaatctcattttaaataaaagggaaaggaaatcaagatacaggaaaagcagaacaggaaatataacatgaaacttaagaatgaggttaaaacacagaaagtttgtaggcagcaatgtagcaaggtcaggttgtagtttagcaagattcttctatctacagtgtggaatcatattgcatggataaaagaccggaggcttggccaggcgcggtggctcacgcctgtaatcccagcactttgggaggctgaggcaggcagatcacttgagcctgtgagtttgagaccagactgggcaacatagcgaaaccccatctctatgaaaaatacaaaatttagcagggcatggtggtgcatgcccatggtcccagatactcaggaggctgaggtgggagaatcgcttgagccgcagagatcaaggctgcagtgagccgtgattgtgtcactgcactccagcctgggcaacagggtgagattctgtctcaaaaaaaaaaaaaaaaaagagtagaggtaagtagaccaggcagatggcaagagccagtttggcgtgcaggaccttttgctctagaagactgtgatgccaggctacagtagctggatgtcaacctgcaggcaatgggtgactgtcagatgacatgacgagtatatccatacaatggaatcttatttggcaataaaagggaatgaagtattgatccatgctgtgaccttgaaaacattatactaagtgaaaggagccacacacagaagaccatatggtgtatgattccattgacaagaaacatccagaataggcaaacctctaaagacagaaagtggattcactgttacctagggctggggcagggatggaggggaaaatggggagtgaccgctattaggtatgggggtctcttttgaaggtatttaaaatgttctaaaattagattttggtgatgtttgcttctgtggatatactgaaaatgactgaattatatctcaaaaagttatgaaaaaagaaagatgatataacaaaagtgttcctttagaaatatgcttcaggcaacagtgtaaaagatcaggccgggtgtaatacctcacgcctgtaatcccagcactttgggaggccgagatgagtggatcacaaggtcaggagatggagaccatcctggtcaacatggtgaaaccccatctctactaaaaatacaaaatttagctgggcgtggtggcatgtgcctgtaatcccagctactcgggaggctgagacatgagaatcacttgaaccagggatcagagtttgcagtgagctgagatcgcgccactgcactccagcctggtgacagagcagactccatctcagaaaaaaaaaaaaaagatcaatcagaactggggacaataaaggaaaggccatgacaaggaagggggtctgatcttataatccttctgggagatattaaggttctgaactagggtagttgcaacaatcgaagaagggtcatttgaggagctggaggtgtgcatatttaggaagtgatgcctgttgaccagacactgtgatctccactaggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaaggtgggtcttgcctcagttgtctccatcctgttctttgtataaagtcttgcctacctgggagttcctcggaggcagactgccagacctgataacttgcaggtctcctgggttcaatatcatcctggactggagccaattttatcctacagaattatgttccttgggcattgatgggctgaagacccacttagcatggatctcaaacataatcccaggactgtcacatgagaagaggctgaaagaatttgggatgatgagaatattatccaggtgtaatggctcatacctgtaatcccagcattttggaaagccaaggtgggaggatcacttgagcccaggagttgaaggccacaatgagctctaactgtgccactgcactccagcctgtctctaaatataaattcagatagatcctgtctctaaaaataaataaataaataaataaatagaatattgagagggttaagaaggaaatcaggagatgggaaatagaaggaaagaaaagaaggaggtcacactatggtatctttaaactttattgctctgaaggagggtaaaagttccaaagagtggatgtttggtcatagggccagctctgcttcaaactcaacagggacattccttgattcctgaacatctctgatctactgtcccttcttggccatgcccttccccatactgcctcccaacagggcctctcgcctcctgggcatctgcaggatgggagcttctcttctgcctctggtctccaagcagtcacacagacatttttagctccttctaggaactttgctgctaacagctttagagaaagagttgggaatagaaatatcacattggttgaaagttacaaagtctcacaataaagctggtctctggggagtaggcctgatgtaaggaaatgtgttctcagtcaatattctaagaaccttcatgaaggaaggctgccccgggccttccccctgcctaacagatggtgttcatcacagagaaatggagaaaaccagcaggaaactggtgagaacctgtgggctcttctcacccagagccacaggaatggtgcattactgaggcctgtcctgtggagagctgtgccaggcctggggcaggggctttttaccaggactgtgtgtcagtataccacgcctagcctcactcccagattctggtccaacaagtctgaattgctcccccatcacctacactgataaacaaccaccagtgatctgatgcatttcccaattcatgagccacagctctgacttaaacagtacgtgccagccttcatggagtttaggatctaattagtaaacattatcaataccaggacaatctaaataaaagcggaagggaaaggacactctaagcagaggaaatagaaggagcaaatgtgtccaggcaggtgtgtgcttatatgagcacctatccaaattggacagcaggatttgttataggggaactgggggagatgaggcaagtctcaaggacacagaagaacagatttggggtgggggtagggcttatatttaggaccaccaacctaagagaagccagagttttctcatgagaagtgtccaacaataaaatttgttaccttgctagtggctgtgcattcccagtccttgaaataatctgttcaaggagcatttgtgtgacttttgtctgcctggataataaaataacttctaaagatccttcttattctacaattccatgatctctgtgatttagggactatgtaaagagattctacggcaacaaaaaaaatcaatttattatctggtttgctctagcactgaattcttagacccttccaaaactggaaaactagttgaagaatcatagtccttctggatcccctttgaagtagagttcaaagttgtttgacctgacaatcaatttctaaaagctaagcccaggattcctagtggaaagcatgaacaatgtagatataaatttgaggacttctgagatataattggctgatgacagatagctcaaaacagggtttgggtagactggtttatactcaggcatggaggaagcccagcccaacctgcccatgcttccaaactccaggcaagaacagaacaaggttccccttatagatatttgtattggtcagctattgccaagtaacaaacaaccgtggaatctcaggggcacctaacaatgagcatttattactcgtgcatctgcgcatcacctggaagttagctgatcaaggtcaggcttggctaagtaagtggctctgaattaactgcaggtccagccagctcaggtcaagtccatatttctcattaatgggcccaggctgaagggctagctgcttcccaggggcagctcttctcatgcacatggcagagcaagagaacatgcccaagtacacaagcatatttcaagcccctgtttgtgttatgtctgctaatatcccattggtcaaagcaaacacaatgcccagccttacagggagcagtgcactcttcccatggaaggaataagggaagaggggggaagtgaaggttttgagcaataatctaatctatcacaatgtttctcctgttcttttctgaccatggggctccccttttctgggataagtagatttttggaccaccttgcttattcccttggggactgatcatgattcaccacatttgttctttgcagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttacttctctgtgtggggctcttttttcctgggctatgtctcatacacagtgctaaggacttttcacacattacttttaatccatgcaataatgctgtaaggtaggtgctatcattatacccatattacagatgaggaaattgaggctcagagaagtcaaggacttgcgaagatcacacagattccagattaaaattcaagtatctgactgcaaagctagtgctccttctactgtgtcatcttgttttcttttccttgaatataagtaagaatgaggctagatgactcttgggatgggggtagaaacacagactttcagtgatgtaagtccttgtgctctagggcagttcactagggaatatgaacgcagtcgtgacataggcttatgggatgtgacatgaagagttcacatacaatgttactgtcactcacgtgaaggagggtcaccgtgggcttaagatctctatgatctctatgaggttgtcattgaggattaggctgtattttttttttgtttttttttgagacagagtctcactcttgcccaggttgtggtgcagtggtacgatcttggctcactgcaacctctgcctcctgggttcaagtgattctcctgcctcagcctcctgagtagctgggattacaggcatgcgccaccacgcctggctaatttttgtatttttagtagagacggggtttcaccatgttggccagtctggtcttgaactcctgacctcaggtgatctgcccaccttggcctcccaaagtgctgggattacaagtgtgagccaccgcgcctggccaggttgtattttgccccaaaattaattaagaaaggagtagcatcgttaggaaggacattttctctccctccctctcctgttcctcctcctcctcctcctcctcctcctcctcccctctttatcaatttcctccctacacactaggttaattttgtttaattttacaagtatttactgaatttttggcatctggaattgccgggtaaggccacaagggatttatgtttccaacaaagatgattcctgcccattagggtctcactgcatacaggcagagatagacacatgcatacaagacagtgacacgaagtgaaacaagcgcctaaaagtactatgagaaaataagggatgataataatagctaacatgtattcaggccaggttaagagttttgcatggatttcctcaattaatcctcaccacaaccctatgaggcaggtactagcatcatttcccattttatagctagtttactggttactaggtcacccagctagttcaccttagaactagatcctcacattgggctggtgcacctttcacctccccacctagcaaagtcccagccttcgtgcccccatcagatcccacctggtccatgaagcttcccagacatacccatttggagacagtggagtccagtggttaagcgcagacacttcaatgccagacattcctttcaccctcccagcacttgatctctgtgggtggggtgggatggaggagcggctttcataagcccttaggggatttctgtgtgaggaccagaagcagaccctgaaatgaggattccctgcaaacgacttattaaagaagtgctctgaggacagctggtaagcagagtgcgggggaggggggcgcagaagaggaaaggggaggaaatctgtcaagggggtaattgcagataatgtcctggagagggcagcttcagcctggccccgcccactgggagctctggagtctaaggttagcctggtgaaggacagggagccaggctttcacagtcccacctgccagtggttggtgagggcgctccctgggaggactgaagtcctaggctttccacctgtatcggcaaaggcctcctccaaagaagagctgcaggctctggttgctggaagagaaggcacaggaggaggcgggagcgatctgagatgtagggcaccgacactgcgctatagaggggcatccggacctcca

SEQ ID NO: 16629 - DNA, 9676 bp, Human
caaacacacacacacacacacacacctacctcagcctcccgctcctgattatgcgtttaaagttcttaggtgatcccatgttcgcaagtgctcagctatagcaagtttcctttaattttaggtagaatttgttcatgcaatactttcgcactgagtactgcagtggagtcagcttcctttccaaagcccaggcaacaaggaaaaatctgaagtaaagacaaaagctctcctttgccttggggagagagtaaggagctagtaaggggccccatgatgaaaagaacctaaagcgggaaacattgtgttttcctgctcagagggtaatgctggctccctagggctatgtccggggttctccagccccactccagggctctgctttcccgaccttgctaccgtgatgccccggccgggaggcaggcggtgctcgggtgcagcttcggggctaatccgagggctgcgtgtcaagcccgcacattgaggcctgcggagaactgagaccccagtccccgcaagcccagcctacgcaggagagcgctgccctctagcgactataatgggacatgcagcgcggccggagccccgcgggagcagcgccgctgcaggtcctagcgactgtagaaatcagccctttgcagagggcgcagagggcctggaaacctctgggaccttttcccaggaactgtttatggtttccccctaggtctaggagacatagatgcataggtggattggatacatcgatggtagctataaggtaagcagacaatggtcacagatggaaaggtggacggacggatgacggatggttagaagatgttttgagggcttgctatagtgccaggcacaaggctaagagatttcgtccactatttcatttgattctctccagaaccttatgaatggcatattacctctgttcctatttttcaaatagggaaactgaggcctcaggcaatgtaagcagcttgccgcttagcaatcttttgcagagccaggaagcgggaaagcgtgtcttaatggacagtaccagcctccacagtgtgccctcggccccctcccggtggagaagaggttccaagccccggcgtcccgggtagggtgtccctcatccctccctccccaccacactcctggcgcgctgacattacacccgccccggcactcccctctcactgatccaacacccccggacaccctggacagcgctctcaaggcagtaggtcttcgacttgggagccccggggagctggttaaacacggatcctctcccacagtggctgaaaagcgcgcagtcccggaacctgagggtttacctgcttctacgcttggccaagggtctctaactggaaaggtgaaaattctgtcctgagattttaagattcccagaaactttcaatcgttcagttcctgtaaccattaattgagcgcctaaactgcgcaccttgacgctgttagatgctgcagtaaggaactcggagtcaagtgtgggggacaggttggtcaataaatgacgacattccggacggctgtgcttggtgcccacggggacccgcgagggggcccagggaggaggcgggaaaggggcaggttcaccggcccgctgggtctccagcacattccagaagtctaagccagtccatctatccttccaaacgcccccacctcgcttccctccctggagcccgcatcccacggtgcaatttcagtgactttatgcggagaaacttgatcctatctcactctccccaaacttcctaactgccttgggtttgtcacctggccgtgtggggagccaccgagcgccccctgtggcccccacccgagctcggcggggggagcggcgcgcgggtgctgggggaccgacccctcccgcgaaggcgtcggcgcggggctggcgtagggcctgcgtcagctgcagcccgccggcgattggggcgcgcgcgcctccttcggtttggggctaattataaagtggctccagcagccgttaagccccgggacggcgaggcaggcgctcagagccccgcagcctggcccgtgaccccgcagagacgctgaggaccgcgacggtgaggccctacgtccgccagcacaccagggcccgcttctccccgacgcccgccctcctcacacttgccttcttctcttccctctagagtcgtgtctgaacccggcttttccaattggcctgctccatccgaacagcgtcaacgtgagtgaatttgcccgaagcttgtctttgctgagcgggtttggggacgtctgcccgccctctttcccttcacatttcattgcatgggttccccaacagcgttccctggttcttctttgtgaccccagtcaatgtcctgcctcccccggctcccgctctctcgcccctggtctgcggcgttctctccggaatcttgccctgggccgcggacgcccaggaaaagagccgggtgccccaggcagcctcgcgttgggggcgaccgcgccatcccgggaaccgcgaggcgatctgagtcgcctccaggtctacctaaaagctgtcggccgggagggcggggccccagaaaggagcattcctgcgggcttttgctcgacgatcccctgctgaggctgtcgcggcgagggtcctgccgagggacccgttctgcgcccaggcaggctcgaagcacgcgtccctctctcctcgcagtccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggtgagtgttgcgcgcggcgagtgttgcgcaccttgtgagacagagtttccgcaacagtacgcggactgcctccggcccaccgcgcggcgcgtatggcggttcgcaccgggtcggagccgcagcggcgcgagcccgtggtgacctgggtgtctcagctgttcctggaacactgactgaagtcctgccctggctcttagcttcggggatccgcgactatctggggaccggtaagggtagcggtgtcgccgcacaaaccaagtttgttttaaccctgggaattcgggaaccccgagaagtcctctgttcagcacctcggatagcactgggttctctcctgggctgtcagaaggaagatggctgtcaccacaactcctaacatatcccagctaagggcccctctacacgcagtcatcttcccatctttcccacaaataatgtaattttttgttagtgacatttcggtgcctttctttagatttatgttccccagctctcttaacctcaggtccctcattccctaccctcacctgtaaataggagagagcaaagggatggaaaaggggtacggggagaggaaggcgaaataaccgtagacaggaaagagttcaaactgtctcactagccagtgatgctggaattcaacttctgtttcaactgccctttgtaatagtaactaaaacaacagtttaatttggctatgagaaaggaacaagagaagtggccagtgtccaatgggtgacaacagtccaaagatacactgcactacagggggttggggaaagaaaaagctgaggacaaaataactttcattctgatcatggttccccatgggctgtcgaatcacctctggtgctctactgagtctgaatctccaacctcgagactcaggtagcttcacttttaccagctcccctgacaattcctttgcattgcttttgaaatttgttgaaattttatggtgacttaaaaagctcatagagaataatgtattcatccaagctgctttgggttccacctggaattgaggaaattttaccttatgtagatgtttgaaatggggagaaaaccaaggaacagtttccaaatatctgtggtatatatttcaggttaaatgtttgtttctttgacctgtgctaacttggcattaaagagaagacacataggaaggttgtatatttaaactatgagaaaaatgtttcatcttcaataggagaaacaatccccttcacccatctttcttctttctcctgtagtcatgagcttttaacctatgcctaaaaattgagccagtgctacaaatataaggatagatcttgtggataaagaattttagacacagaaggaggaagagaaatccaaaacatgccacatagaagactccactttctgaccccataattccctgtgcccagtcacacatattttgagctttgcctgctcaacatgtcaggggctcagccccctcccctagctttctctgccatctgaataaaggttatatggattctagtctaatttttctaatcacacagactgaccccaaagtagtatcatatttacttaaattatgtgagttagcgaattaatatgactgacttttaatcatgcctattcaaatgggtttttttcatacttaatctgtttgattcaccaagctcccaaaatgctactaatcttccttttgcattgttgaggaacttgagcagagctcactgggtagcagctagctcttccctgggtatcacctcaaatcttgacttctctccctctctcaccctcttctcatcatgtaacaggattgtgggggaggagaagaggaaggctgctctttccagaattttccatactgctttttatgctcttgttgttatcacttattactattatcattactttaatccaggtgatggaatggcacgtgtagtgttagcaacttgaaaaaaatagataataagcaaccatcaataaaaatagtcttatagaaaggcattttgcataataactgatttgcattggaccctacatttagggttgttattgtctcaatgacaaaaggtttacttagtgactgtctcgctagaattacaacattctgggattttggctcggatgcaaaagacatgtgagaaacgaggttgcctagccaaaattatgtagtgaaatcaatgtaacaaatatttattgagcttctaccatgagaaagacacttatgattggtactgtggtggatgcagagatgagcaggcgtgctatggctgatgtccagatagaatttcccatctaatgtgatcttgaccataccacacaaagtgtggtaaataccacaaaacatgcatacatggttataggagccatcagttaacatcgctaccttagtacgagtgcattattctgatatttgttactatttggttttgaaggaatctcacatcacatacatttaaaaatcttttggtattagtatgcaaaacattcaacattaatttttaacaacaagatcacttagatacaactttagaatggaaatattattgctccttaaatatcttaagcttctaatggtgtttttatttgttcatcatatgtcaggaataaaataagacattttaattattaatggatcatctttagattcttacgtagttatatatttaatcttctcagacacgaagcttaaatactcattaagagcttactaaatacgtgccttcaagattttgttgcactaataaaatgctttctttcattgtgaaaataatatatgtgtatttaacatcacttaatataccagtatatttttaataataccaagaaagacttcagagggctataaaaaactcctgaaatgctaagaaatatcatgcatgttttgtaaatgttcacatattagtactctctttatcatacccaagtgatgtgttaaatagaaaaaaacttaagatcattcgaatgtatagacttacaatgattttatatttaatatttatataagaaaaaggaaagaatgtatgctgatgattcctattttaccaaacaccatgatttccattgaaaaatactttttctgtacaacagtgactaaatgtgaagaaaataaacatgaataatttgtgcacttgcatttgtataattttatatctgatctcatcattatagacattttgttcaaaataataaagtctgttgtatccagcaaagaaaaaaggaaaaaaaaaaagatctgtacttacaacaaattaacaaattaataagaatgcaaataattcatcagatttaaattgagtttttaggatgtgtttataaactttttttaaattgttgtttttctttgaagattgaaagtatttgcaggaatactcgataccattttaggtaaaatattaacacaagaaagcaaatgacccttaggttattaatattgattttatctctaagacaagaagataaaaggaattttgaggaaatatccctgattaggtaaataaaaatttctcctttttggttagaaaaatctcaaacaaaattatatcagaagtggaaaattatccagtgaaattagattgtgaaagcagtcaatctaagttaaaactgcatggaaaattttttttaaaattctttaaaatttctatgggtttaaaatccaaaggcagattcctaactggattcagtgaacccctccactttcacctttccaaattttatttgtttcatttgcatgctcagccttatgaaaagtcgtgataagaaattggagatgaccttattataataaggaagttatgatgtcaaagcaagcatattttggtccacaaaagttcatttgcttaatgaaatcacagaagcttctttttatcattacatcaaattgttttcccaggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaatatttttcccactagtggccccaggccccagcaagcctccctccatcctccagtgggaaactgttgatggtgttttattgtcatgtgttgcttgccttgtatagttgacttcattgtctggataactatacaacctgaaaactgtcatttcaggttctgtgctctttttggagtctttaagctcagtattagtctattgcagctatctcgttttcatgctaaaatagtttttgttatcttgtctcttatttttgacaaacatcaataaatgcttacttgtatatagagataataaacctattaccccaagtgcataatatccttgtaagtctctttttctccaaggctctcatttacctttgggtttccgcatcaatcctagactcagggacagtagaaccatctgcttttgacataattttgacatcataatcattgtctttcttctccttcagccaaggctcaaaaacattttttatttaattcctcacagcatgaaatcttagattagtaaacacgtgggagcaaaataaaatgtattttcactctcatttctggaaatcagatacatgaagaaaaaccaaagcctaataaaggagccagctatgcccccattaaacacacacacacacacacacacacacacatacttgcatttacatcagatgtgtatgtctcttttcttcagtaaagtattttagaagttagtaagaaattaaagataatttagtccaattttacaaatgaagaaagggaagccaagaaaggttgtgtagttggcccaaagttgcccagcagttgaaggacaaaaataggattaaaaccccaaactttttgtgcccagtcaatatccttttcactgcggttccttatctcctatccacgtcactagtaagaattgtaagaacgtggaactacatcttagtcaccattgtacacctctacactatgactgtagcagattctccaatatcggatgaatggatatatgaatgatgaataaattaatttggtgaccagataatgaggaaagatattgtgagtgttttgtaaggtaaatccccaaaacacaaggtgcttatgactacttcatattaatgagacaatgctcagatataagaaatgtaacttttcatttttcttattattattattatactttaagttttagggtacatgtgcacaacatgcaggtttgttacgtatgtaaacatgtgccattaactcgtcattctggtttctcttcagatcgtgcaaatctttcgcctttaacttttcatttttctaactgaaacaacatacggcttaacccctactcactaaatcatttttccaggacccccaccaaccctttctcttgtgtttctcaaaacattggaatttagcaactctggaaagtgggggacgagtctctggtctgcagtctaccaaggctgctgccgagatgctcactgtgcaagcctgtgtgccccatctgataaggcagctgcactgtgctcggcagtttgttctctctgtacagccccgccagggctcacaggacatccacatgatcatgctgttaggagacccatctcctggaattagtgcaaggaatcacagggccccacactcacagagccccaactccatcaatcttcctgatccttggtaaactaattttttcttccaggcaaagcccgggaggaaaaaagacaatacaataattattgataagataatgccattattatctcacaatagtccaatatgtatacttacatatctcatacaatgtgtttgagaaaataacaaagttcaccatcagacaaatacatttttcaaagcaagcgcagtttcatgcgcgtcggtgtgaagagaccaccaaacaggctttgtgtgagcaataaagcttttaatcatctgggtgcaggcgggctgagtccgaaaagagagtcagcaaagggagataagggtggggccattttataagatttgggtaggtaaaggaaaattacagtcaaaggggggttgttctctggcgggcaggtgtgggggtcacaaggtgctcagtaggggagcttttgagccaggacgagccaggagaaggaatttcacaagataatgtcatcacttaaggcaagaacaggccattttcacttcttttgtggtagaatgtcatcagttaaagcaggaactggccatctggatgtgtacgtgcaggtcacaggggatatgatggcttagcttgggctcagaggcctgacacacagttcttttttttttttttagagatgagggctcacttggttgcccaggctggagtgcag

SEQ ID NO: 16630 - DNA, 98828 bp, Human
  misc_feature (1)...(98828): n = A,T,C or G
tgaacctctccgtttttctttcccttccttcctccctccctcccttccttccttccctccctccctccctctttctctctccttctcttcctttcctttttctttctctctttcttcctttcctttccctttctctttctttctttctctctttctctctttcctttctctctttcttcctttcctttccctttctctttctttctttctctctttctctctttcctttctctctctctttctctcgcttgcttgcttttctggagctctcagagctggtcagagccctccaggcctacagctttcgtggagtcagagccttcatctcctagtatggaagcaaccctcttggtctccccacccgcttcgtacagttggccaaatggtctgaaacaaatgaaagacctgcctttcagcatgttttgggaggttcagacagcgcctgactcaatgagaacggtcagcgacgagcggcgtttccttcttttaaagaccctctacaattccaggcactcctgcagctgtggaaacattccgaacggcttagcaaccaggacaccctctgcgccgaccactaccagcatcgcaggcttcttgagctggctttcccagtggaaaaccatgcttggtgtttgcacactgttcaaaggatgttttcgaacaaagcaccgaggaaggggcgaaaacacctcaacacagccgttctctggggttggagctattgaactgtgacatttgcgaagactcaacttgtttatgacacggtccaaataataacccttgcagactgcccgccccccccccccacccccagcactctccttagattcaggtaaaagcatgttataaccgtctataggacaaacaggcaacagtagcagtgaagtgactcaagtagccaggatcgagaatgaaggtgctcaaagaagactttagtttgatctgtatgtagtgcgctcatcttttttgaaactaggaaattaaaaattagaataaagtttttatttaatatgcaaatacatccgcaaacccatcaggaaacataagagaaatcagtgccaaaggagctctttctcccagccctctaatcctggcaggtttgtggatcgtggacggggagcccctggaaaggaccgcgccgggaagccgggccctgcagggactggccgcggctgcaccggcgttgcccgtcgcacactaggaggcagcaccgcgccgaggaacccgcagcagacgggcagccagcgtgtgtgcctggggcgagtgccctcgcctgccggcgtccccatcggaaaagtgggggcgagggcagcctagcggaatagctgcgggaggattaaatgaacgagtgcaggttcaccttctgggcgctgacaacgatccgtgggctctcgcgaaatgccaagtcgccgtcccgcttgctcccataaaagttttgggagccacgcggcgcggcgggcgggctcctgagtccatgagcggtcccaccgagcggtccccgaagcttccccaaagcccagcccgcggctcgcggagcgtggtgtggggggactacagtttccagagtgccctgcggcgacgggcggagccggggagcgcccgcagccaattagggggtcccggggctctgccggggagcggcgggtggagccgggccggtgggcgggcgcggggacggtcccctggaacgggtccgaggctctcgcaggcagggctgggccgggcaggagctgcgaggccggcacaagggaggcggccctggggacctgacagggcgggggcgggggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggtgagggcgctgaggtgggtggccggacgcgcgtcgaggggctccggaaggaagggatgcctgagccggacccggccagcctggctccggctccgagggctgcccggcgctgaattcggggtccctggccctcatcccgatgactcttgttttttggggggaacatcactcggcccggccgagtccctgcgctctgggcgccccctccgggcacggttgccgcccccaccctagccctgtttcggagcacttcctgtgtgtcctgcactgcgctcggcgccgcacggggagacaaaggggcgttgacaggacctcagcatccgagagggccactcgagggaccttccagggacgttccgtaaaacggcgatacgggcacacttttttttttaagagagaccacagatgctgtgggaatatcgaggcgatgtggaccgagaaactcggctgcgcttggacgggttgggagctagggacacatctgaagatgagccagagacagggaagtggggtgggcgaggggtggcccatggactgagaggtggggcttggaaaggtgggttggggctggtcagagggggaggtcaggatctggtgaatgctgagcctgggggaacagatttgattccgtcggtctgagtcacagctggggagtctcccagcctgcagtcacctctcccctagaggaagacgcggcagagagcttttgtggagtgggtggggcagagctgattgagtctagagaagtgtggcagcaggacgttggtttctgctcctgggagctaattctgaggtggtgagttgttttagggagccaacacctacagcttgactcccccctttcccctaagaaaatttttactgggagacgcccacttgttaaattggtgtatacctccaggagagcacctctcttctaagccactatcctcctccttggggctcctgtagcttgtagggcactctgaccctaggattgccgttctatgaggctggaccacagagaaggcttctccaggccttctcctctgacttggaagtggtctatcgcctagttaccgaagtagttcctagatgaccggtgttataatagcatcatttgggagcttgtcagaagtgaacaatctcatgcccagccccgacctgctgaattagagtctacgttttaataagatcccaggtgattcctaagcaaataggtttgagaagtactgccctagaggcttggagtggtggcgttttttcttttttcttttcttttttttgagacagggtttccctctgttgctcagtctggagtgcagtggcccgatctcggctcactgcaacctctgcctcctgggctcaagcaattctcctgcctcagccttcggagtagctaggtctacaggtgcacaccacagcccggctaatttttgtattttttgtagacttggggtttcgccacgtagcccaggcttgtcatgaactcctgagctcatgaaatcagctcgtttcagcctcccaaagtgttgggattacagcggtgagccaccctgcctgacctggagcggtggcaattttgagaccaaccaggcccactcagtgtctttttttatttttattttttgtgagacggagtctcactctattgcccaagctggagtgcggtggtttgatctcggccctcactgcaacctccacttcctgggttcaagcaattctcctacctcagcctcccaagtagctgggattgcaggcacacaccaccatgcctggctaatttttgtttttttagtagagacggggtttcaccatgttgtctaagctggtctcgaactcctgacctcagttgatccacccacctcggcctcccaaagtgttgggattacaggcgtgagccactgtgcctggcctggtgcctgttttgtttccttgccacctcccctctgagcccacacttcctgttatggggtagggagaggtcttgtgatccgagaggcagtgcttttggactgccccgacttgctgtcctcctttgcctgagggccttgcccatatttgagggcagccagctcaccctgtcctcagcacgtcttttctttactctcctcagagctgcatcttcttcctggtggcaccagagaacgatcctcagccttgcaactgtctctggacactgccagtgtccttgactgccttagacagagcctgctcctgcagctgtgctctgactactgtgagggcagctggacccctgtggtcagctcaccacaggacccactttctccagaaggttcagttggtgtttttagcgtatgctaaacatatgggttttttgggccgggcgtggtggctcacgcctgtaatcctagcactttgggaggctgaagcaggcagatcatgaggtcaggaaattcagaccatactggccaacatggtgaaaccctgtctctactaaaaatacagaaattagccgggcatggtgatgcatgcccgtaatcccagcgtctcaggaggctgaggcaagagaaacgtttgaaccagggaggtggagggtgcagtgagctgagatagcgccactgcactccagcctggcgacagagcgagactctgtctcaaaaacaaaacaaaacaaaacaaacatatgggcttttttttttctccgttaggggctttcaattgcattcttgtccccttccccgcagtgtgtcctggcttcacagggttcatcttcctttaaacttaaacgcagaactttgctttcatgctggtaagatttccccttgtcattttcagttgtgtttcctcctgctttagtcccttaagactcccctgctactctgaaagtttcatacaaaggaactcatccgatccacaatcgatactgtctcctcttggttctccaaagcacgtggaaagtcagtttttaaaaaagtgactccagggccaggtgctgtggctcacgcctgtaatcctagcacttcaggaggccgaggcgggtggatcacttgaggttaggagtttgagaccagctggggcaacatggtgaaaccccacctctactaaaaataaaaaaataaaaaaattagccgggtgtggtggcgcgtgccctataatcccagctactcgggaggctgaggcaggagaattgcttgaacccgtgaggcggaggttgctgtgggctgagatcatgccgctgcactcgagtctgggggacagagggagactctgtctcaaaaacaacaacaataaaaacaaaaagtgactttaattctcaaagttgtgagctgtctccaccacagccctctccgcctacctccgaatccaccattttctcttaattaagggtgagccagaccaagagagctgtgtgattgctgatagacctgaacaatctattacctacttggccttagcatgtacccctctgacctaagccaaccccatatgtcccggtgcccagagaagagaagggactagaatccagggctctgggcttcagttgaacactttttccttagtcaccagctaaggaagacccatcctggatcagagatccctgtcacccaggctgcctactcgagaggtgctgtttactcacccctcctgcctgaagtcgaagtaggtattgcttttactaaagacccctctaatcaaggaccacgactcctgcccacttggttttccctggcctggttactgaagtaacccaaaccaaaaattccatcttggtgttatggctggaaccagagattccattttgacacggcacctgagaaagcaattggcagggagctgaggagggactgccagtagcactgtttttcttctgacagcctaagtgtcgaaggcttcctgaggtctttctgggccttggaagtctgagtttgtcacagtgtcaggagaggactctgactccagatttcctgaggagtcttcacaggagcagtctccgagatatcaaacctctttttttcctcctctccctgataagccttaatgtgtctgcctcaggagaaaaagaggaggataggattgattttgtgcaaagtcaagctcattctcactcaatgcctatgtgaatgcaaattgatttcaaaagaaaaccagtcctacaaattggtttcaaaagaaaaccattcctagttaattactagaatacaaagtagactgtaatcccagcactttgggaggccgaggctggtggatcacttgacgtcaggagttcaagaccagcctggccaacatggtaaaaccccatctctactaaaaatacaaaaaattagctgggcgtggtggcgcatgcctgtaagcctgtaatcccagctactaggaggccgaggcaggagaactgcttgaacctggaaggcagaggttgcagagagcagagattgtgcactccagcctggacaagagagtgaaactctgtctcaaaaaaaaaaaaaaaagtaaagtttacaagctatatggtttcaaaattcttatcactgaaaataatcttcattttgaagaggaggtagaaaggggaaaaggtgatagattgagtgggaaaagctgactttagcgggtgtgcttgctgtgatagcagcaggcaacacaggtactcatgcacacaatgtggacagggagcatggagaaatgaaaggagttgggttagcaggctgagatgatttttctgcttctttttgtttgtttttagagacagtgtcttactctgtctcaaggactggagtgcagtggcaccatcattgcttacttcagcctcgaactcctgggctcaagggatcctcctgtctcagcctccagagtagctgggactacaggcacacgccaccacacctggctaatttttaaattttttgtagagatggggtctcactatattgtccaggttggtcttgaactcctaggctcaagtgatcctcctgcctcagccatccaaagtgctgggattataggtatgagccactgagcctggtatccttcttaaaaattgctttgccagcctgagcaacatgacgaaaccccatctccaccaaaaatacaaaaaattggccgggcgcggtggctcacacctgtaatctcagcactttgagaggctgaattgggtggatcatgaggtcaggagttcaagaccagcctgggcaacatggtgaaaccccgtctctacggaaaatacaaaaattagccaggcgtggtggtgggcgcctgtaatcccagctgctctggaggctgaggcaagagaatcgcttgaaattggaaggtggaggttgcaatgagctgagattgtgccattgcaaaccaacctgggtgaaagagcgaaaactccgtctcaaaaaaaaaaaaaaaaaaaatgagctgggcatggtgacatgcgcccgtggtcccagctactcaggaggctgaggtgggaggatagcttgagcctgggaggcagaggttgtggtgagccactgcacccacgcctctgcactccagcctgggcaacagaatgagaccctgagaccctggctcaaaacaaaacaaaacaaaaaatagaaaattgctttggttttgattttttgttgtttttaagcctttttttttttttttttttccctctgagacagagtctagctctgtcacccaggctggagtgcaatggtgcgatctcagctcaccgcaacctccgctttccaggttcaagcaattctcttgcctcagcctcccaagtagctgggattacaggtgcgcaccgccacacccggctaatttttgtatttttagtagagacggggttttaccatgctggccaggctggtctcgaactcctgaccttgtgatccgcccgcctcagcctcccaaagtgctgggattacaggcgtgagccaccgagccggcctttttaaacttttaaaagatttattgttttgcaaaattgggagtttaccaaacaaatagcagcaattaagaagaaaaaaattaccctgggttccatcagcgtctgttgacatgttgatatatttccttctagacttttgatgttgtggtgaattttttttcctgcttggttctaatcatatgtatctgtagtgttttatttctttttttcttttagacagagtcttgctctgtcacccaggctggattgcattagcgcgatcttggctcactgcaacctccacctcccgaggtgggagcataacctgaggtcaggagttcgagaccagcctggccaacatggcaaaaccccctctctactaaaaatacaaaaactagcctggcatggtggtgggcgcctgtaatcccagctactcagggagggtgaggcaggagaatcgcttgaacctgggaggtggaggttgcagtgagccaagattgtatcactgttctccagcctgagtgacacagcgagactctgtctcaaaaaaaaaaaaaattaaaataaattaaataatcgtatgccaggcactgtgctaggcgctttacgtaatacgtaatagaagacaattatcccttcgtaaaaatcacagagctatgcaaaatcatgcagtaaaaaccagaggccttatgggaagaatggggttgagggcacagcacttaaaaacttcatcagtggcgtcttttaaaaaaagttcagaatctaaaatccagtagtacagttttacgcaagttacgtggagaagaaatacgcacatgctgcggtaagtaggcattttacctgaaaaaagatgcaccacatgggtggatgtgggtgctgggaaggcagcagcgtagggagctgtggaaggaggtgtgtgtgcaatctgatggcagatgcacatgggtgtggctcagaggtggttgatggatgtcagaggtgtgtgcctgtgtgttttgtgcattccttcaacacctgagtcagctgagtgcagttttctgcattcatctgcggcgttcacttgctgtttctatatgtaaccaaatacgaccttagcattatagcagaatcactccctggtatgttgatggtgttggagcaaagttggcaggttcaaaataagggttctcacagagccaactgtatcttgatgaacagctttgtagagttcttgctgtatgttattttattttactttagacagagtctcactctgttgcccaggctggaatgcagtggtgcaatctcagctcactgaaacctctgcttcctgggttcaagtgattctcctgcctcagcctcctgagtagctgggattacaggtgtgcgccaccacgcccggctaatgttttttttttttgttgttgttgtatttttagtagagacggggtttcaccatgttggccaggctggtcttgaactcctgacctcaagtgatccgcctgcctcggcctcccaaagtgctgggattacaggcgtgagccactgcacctggccgttgctgtattttaatttaccttttaggctagactttcttttttgagacgaagtcttgctctgtcgcccaggctggagtgcagtggcacgaactcggcttactgcaacctccgcctcccaggttcaagtgattctcctgccttggcctctcaagtagctgggattacaggcgcccgccaccatgcccagctaatttttgtattttttagtagagacgagattttgccatgttggccaggctggtcttgaactcctgacttctggtgatctgcccgcctcggcctcccaaactgctgggattacaggcgtgagccaccacgcccggcctaggccggactttcaaagggaattactaggtcaaagcatatgcctatttgagggtgattttaaaaataaaatgagataaattaatacaggtcccctttgtctcttgctattgctgagagccaattcccaagtcctcttagacccctcaagtgcacagggggccttggcagctgctgctcagagcttaggtgcctctgctgtgtgctggctttaggagtgatgtgacattctgccctccctgcctggttgagaggaagctcaggttaagtgaggtaggagccctcccaggccgtcttgcccgtccctgagccagagtcttctcctttcacctcctctcctgcctactagtttgaaagcttgggtttccacttcctctggggatggggaaggtctcagtcctcccctcctcctccggaaagagatctggccccaggcagtaaccttgtttccgctcagccaagtatttttaaacccaagtccatgctattgtgagtgggtttctaactcgtgactcagccctcatccaagggggtctgaacttcccgtggatgacgcccttcggcttctgcgtggggccctgcccacagccctgcgggtctgatttcacactggccgttctgggaattttttttggctgatgcgaaagcaagctgcggtggaagggatcgaaacaaacagatggacccgccctccacctaggactctcctgtggcctggcctgccaaggttacctagattagggggactctccagaggttgtcaccccatagcccccagaacagccctgggtggtcactctcaggccccctgctgctgagggtagtggaacagggtggtggtgaagggaagagatttggggctcagtaggatctgggtcctagtcctggccctatttgaaccccaaataggtgaccacctcctcctctgaacctgaatcttgtgtctgcaaagtggagttggccacagggctgagaggagttgaggaggtgatgtgtttagcatctgattctcacccaggaagggctcaggaaatgacgatgaggtgttatgattgctgctcttggtgtcagatggagaagctcctgacctgtcactatgactttagggacaaggcaggaatacctcggtgttgatagcatagccctcataccagcgcttcctcacctggcactactggcattttgggtggggtcgttctttgttatggagctgttacgtacattatagggtgttccacaggatccctggcttcagcccactggatgccagaacacctccttgcagttgtggcaaccaaaagtgtccccagacgttgccacatgctccatgggggagggaggcataatggctccagctgagaaccactgtcttgtgcagacgagcgttcctttattcagcccggcagacggtatttgttgacctcctctgtcaggtctctgggtgtgcaatgagagagttgggtctttcagtcagagaagccagggtttgcatcccggctgtgccatttagccactgtgtcctttcaggcaagtggcttgtctcagcctccctcagcttccccatgagtacagtggggctgactacacctgcgggagctattgtgagaattgcctgagtagctcatacagcgggtatccagttagccaccgtaggtgctcaggataagaaggcggcctcccctgctgcttccagtgtgtcatgggggaggagaccgaaaggtgctgcctgagatgagagttgtacagggacaagcaggcagccagccgagagcggggaagcttccacctggtacggcaggcgggatggtgataaggtggagggaaggaagtccaggccaggagagaggccggcccatgagtggcccgaggttgctgactgctggccgttgagcctgatgtagcggcctgatgtggcctgaggatggggccacacggtgtggcccccacgcgggttgaaccaaatttgacttgattgccagtatttttaaatgaagagatttcacagaaaatcccagatttcggtcttctctgtaagtatcagataatttgatcctgggctgggcgcggtggctcacacctgtaatcccagcactttgggaggccgaggtgggtggatcacctgaggtcaggagttcgagaccagcctggccaacatggtgaaacttcatctgtactaaaaatacaaaattagctgggtgtggtggctcatgcctgtagtcccagctacttgggaggctgaggcaggaaaatcacctgaaacctgggaggcagaggttgcagtgagctgagaaagcgccattgcactccagcctgggcaacagagcaagactctgtctcaacaaaacaaaacaaaacaaaaacaggtaagttggtcccttctgtctctgggctaatgatgctgtccaagggagtgttacgcaggctatacaggcaatggcaggtttcctagtcacctcattcaaaccagaggaaaaatagggaaatgaattttaatggtatatttatcacttcagcatgtaataaatgcagaattaaagcaatgtgttgtattctttttcatgcgaagtctttgaaattggtgggtgttgcacttatggcacatctccatctgcaccagccacatgtcaggtgctcgatagtgacatgtggctagtgactgccatgttgggcacgacagatctggcctctactgttgcctcctcaaacccagtggtcactggatttgggaagtgggcatgggccagggccaggccagatctgcaatagcatttgggggcgtggctcattcgggctgccgtgacaaaataccataggctggatggcttgcaaacaataaacattttatttcacatagtttggaggctgggaagtccaagatcaaggctcccacagagttggtgtctaacgagggcctgctctgcttcatagatggtgccttctcgctgtgacctcacatagtgggagggacagaaggacagctagccttctagggtcttttctttttttttttaaagactgcactccttcatccaggctggagtgcagtggcatgatcgcggctcactggcggcatgatcgcctcctgggttcaagtgattcttgtgcctcagcctccagagtagctgggatcacaggcgtgcaccaccacatctggctaatttttgtatttttagtagagatggcgttttaccatgttggccagtctggtctcaaactcctggcttcaagtgatccactcgcctcggcctcccagagtgctgggattacaggcgtgagccaccgcaccggcctctggggtctgttttacaagaacactaatctcattaagacctaatcatttcccaaaaggcccctccttctaatgctatcaccttggaggttgggatttcaacataagaattttgtagggacacagacactcggaccatagcagggaccaagtcaagagagctttgaatgctaagccaatgaatttagacttggcagttttgatctcaaaaaatgtcctgcctgccttaagtcccccagggcctgatcaggtcagcccatgtaacattagagaaggactgtcttttgatgggggaggaggccatgaccagagaggcgacacaattgcagggtgccagagccaggattcctggctgcccaaaactaaggtggtccatgctgaatggaggctgggccagagtgaccgaccctggtgaccgaaccaggtgggtgtgggagggaaggccagagctgtagttggaacccgaatcagagctgagggagtgaggtgacaggtgagaggtgaccagcctgagaagatgtttgtgagacaggaggcatgaaagagtctagggcatcttaggagatggaaagagagcagagaggatgagacaggaaggcaagcttgtgtctgctgcggatcagaggttgtctgggaacctggaggaattcctgcagttcaagcctggctctacctcttgcaggctgtgtgatgctgaggaatttacttatctctgcctcagtttcttaagctgtgaaatggtgatggtaatggtacaatcacatagggctgttggaagatgaaatgagacaacccatggaaaccacttagtctaggacactggaagaagtcatgtaagtgttagctctagattgtttattgagcacctacttgtgccaggccctgtgggttccaaagtgaacaagatagatgagtagggagttgacttttgctcagttcctacatgtccatcatttattcttctcttatccccatgaaaggtagggggatatcctcactccacacctgatgaagcagagacccagagaggtacagtgacttactcagggtcacatagcttttttatggcagggctgggacttgcatccagatctttctggccaggagcgtgtctcttttctcttgcatagcacagagagaaagacaaacgggcttgttgggcagtccacggtcgcttcagtgcggtgtctactcttggccttgtggtctctgtgcccaggaatgtcacccttctttgcaagcgtgcctcagctggatggcgatggatggtggcctctcatgcagaggaagtggtgaggggtgcaggcaggactagcacaggaagtggcaggggaaaagggcgggtgtcagggcggggaagctgagtgctcctggggcccctcctggcaccctggtgggtggggctgctgggaccgcagcagcctgcagtgcagggtgtctctgggtcttgtcagcagagcagggagggtgagtgctgaaaggcttccttctcccttctccctctctccaccatactcaccttccacttcactctttctcttcccctttctctctgcttcccctgtgatgcattttttcccttctccccccatagcttaccgattttttcatactaacagactatagcagggctggcacttcgggtggctaggagttcacgaccagcctaggaaacataggaagactccatctcttccaaaaaatttaaaaaattagccaggcgtggtggcaccaaatctagtcctagctgctctggaggctgaggcaggaggatcacttgaggccaggaattcaaggctgcagtgagctgtgatcacaccactgcactccagtctgggtgacagggcaagaccctgactgaaaagcaggttgtctgaaaacaacaataacaagaaaaaacaggctataccagagccagaattagacactaagacttggggagaaggatggggacgaggagggactttaccaatgcactggtgactgaagagttaactccagccagcctgggtcaggtggtgcagggtggtggaggccagtggtgcctctgggaggagctgagggaagcgcagctcctttctgcttccggaccattgccattgcgctggcgggtcccctgcctgccagtctacctgtgactctgtacagctggctcctcctcattctccgggtctcaactcagattccctcctcagagaggcctgtcccgaccaccgctccctgaccatggtggcagctgcctgtagatttccttcagggctgttgttacaaactgggattctcttgtgtttctccttctttattttctgtcccctccagcagatgtgaagtccctgaggacaaggagtgatctttgtgtcccctgcatttggaacagggcccgcggagggtagatgttcagttcataactgctgagctgcaggcatgcagtggctcgctcatacctgtaatcccagcactttgggaggccgaggcgggtggatcatctgaggtcaagagttcgagaccagcctggccaatatggtgaaacgccatctctattaaaaatacaaaaattggctgggcgtgatggtgcgcgcctgtaatcccagctactcaggaggctgaggcaggagaatagcttgaacccgaaaggcggaggttgcagtgagctgagattgcgccactgcactccagcctggtcaacaagagtgaaacgccgtctcaaaaaaaaattaaacaacaacaacaacaaaaaatacctgctgagcaattgaaaggatgagtgagtgaatgccgggcctcgcttgttgcctctccctggacaggccccgcattgtggttatgacgtggctacactcgggaggccgcattgtggttatgatgtggcgctggaatcagttctgagcttcctcctagcttccctgcctgttggctgtgtgactttgggcaagtcacctcacccctctgatcctcagcatcttgagctgtgacgtctaaatcaaaacagccctttgccccgactttgcgaacattgatgcttgtggccagccctcactgtcctgcctcacacacaagatgtaaatgtggctgttactgtgattgttgccatttctgtggggtgacttaagctgatcttccccttcctggggcttgacagaggcagattgccttgaggccctgaactcctcccttgcctgttacactgcagggtgcttctgggtggagggatgtaaagcgttctgggatcagcctcagtttgttgctctctctgttatgaagataaaataagcctgcatcccagcctggagacggcacagggctactggggggtctggtgggatgagtgtaaggtctcagctctgtgcctgccccagggtgagttgtagttgagggcaccagaagtggagcatttgtgccctggagaaagaagctaatgctgatgcctggcttcccttcactctccttcctggaaagctccacacagtcttgtctgggagcccaggcccaacgcttggccctatgaggcagttgccactgtcagagccagcattgtcaccctgaggcaatgacccttgtcagagctggcgaacctccctggtcagccctgagattctttctacccttgctttgcatcttagagggccctgatacggggttggggaagcctgagctccctctcaagaccccttctttttgggggccctcactgccctccccacaaccgccactttgaggtgataggaaacccatctttgagctggggagaggtgactggggcgcctctgttaatgaggaaactggagctccagacactggtgctggcctctggtctggctgcaggaccatctacagtggctaggagaggacccctgaagaccccagcccaccccacgcgggtctcctcgcctcagaggcttttttttttcttttttttgacagagtcttgctctgtcacccaggctggagtgcagtgacgcgatctcgactcactgcaacctccgcttcctgggttcaagcgattctcctgcctcaggctcccgagtagctggaattacaggcacgtgctaccacacccagctaatttttgtatttttagtagagacagggtttcaccatattggccaggctggtcttgaactcctgacctcaagtgatccacccgcctcagcctcccaaagtgctgggattacaggcatgagccactgcgcccggccacttcagaggcttctgacctggggatgctgttcatcttacaagtcgcagctcagcagttggcattgctgtgtaaccctgggcaagtgatgtcacccctctgaaccttggttttcttttctgcaaaatagggacaatagtgcctctcacagtgggacataggcatctttacacctgcaccatcatgaggccagtgccaaggacacacagccagatgtggcagaactgacccaagcccagcgtcacatctggatgatacctagtgttggtggaacacgggtatagcttggtcctgccatttggagagcatttgacaacatgtaaatcaaggcctatgcttttggatgcggcaccacgcgaccagggtggcatggccccatgatagggagctgctcaaatagaggagggtcccgtcactcagtggaacattctgccacccttggagatgacgttggggaagagtgttttgtgctccgaagggctgtgcatgccatactgtttgtttttttgagatggagttttactcttgtcacccaggctggagtgcagtggtgccatctcagctcactgcaacctccaccacctgggttcaagagattctcctgcctcagcctcccgagtagctgggactataggtgcgtgccaccatgcctggctaattttgtatttttgtagagacagggtttcaccatgttggtcaggctggtctcaaactcctgacttcaggtgatccacccacctcccctcccaaagtgctggccttacagggggattacaggtgtgagccactgtgtccagccatgctatactgttaagtgaaagtaagaatgaccagtgtatacagtttaatcccaattttgtaaagtatggaagaatatatttgtggccagagagagtataatgagtgaatatttctagactttcactctggacccagcctattctattctattctattctattctattcattttattttattttaagacaagagtttcactctgtcgctcaggttggagtgcagtaacgcgatcttggcttactgcaacctctgcctcacgggtccaagtgattctcctgcttcagcttcctcaagtagctgggactacaggagtgtgccaccatgcccggctaatttttgtatttttagtagagatggagtttcactctgttggccagactggttttgaatttctgacctcaggtgatccacctgtctcagcctcccaaagtgctgggattacacatttgagccaccatgcgcagccaaggacccagcctcttctaagcgcctttcacgtataactcattaaatgctcacaacagcttctggaggaggagcggttacatcttcattatgtaaaggtataaaaggctgggaagtgaggacaaagaagtcccctcaggggcacacagctgggaagtgttagagctgggattgggaaacagttcaagaacgtcccaccgcagaataccaaaggcgagtcccttggattatgaaaagctttgattttcttccttgtaccattatatttttaagattgtctttaacgcacagatgttacttcagcaccacaaggactgttgatggaataaacaggccgacttaacctctctgaggtttgatactgtctctaaaacagagttcatgaatggacacgacccccaaggttgtggtgaagattaaatgagtgtcttaaacacatgcaggcagggggcataggtggccctccataaagtgcttccttcctcacttcctcctcctctgtggaccccggagtcctctcccctctgcaactccgcattgagtctcactgtcctcctctgggtagcgaggagcctgggaaaggtgggagcggtcccctgcaaggaggcagagcccatgggcacctttcacgcctcctttatcagtgataggtgggttggattccccattggttttggagagctaacatctgagggctcccacatccccagccaagttggacaggttgctcccgttttcagccaaggccaagacttggtatctttgggccaatcccgtttgggtttccgtattttatttgctggttcacaagaacttttgcggctcaacatttccctgagctgtgccagggtggctggccaggcttcccctccctgagggagacagtgttcaaggcacgtctttgaaagccacgtcattctgcttttgggcttcatgatctttgccatccttacatgtcacttgttctgaaacttggccatctcacttgtcgttgagctgaaacttggcatggtgatgattgattgggaagtggtttctctctgcttggcaggactcagctgtgtacatcctggcccagtcgaaggctttggctcctgcaaggtaaagaggtgccatctttcaaaactggagaacagccagagattcagaaatagaaatatgttatggagaaagtcgacttcttatcactttcctttcctctcttatgtggaggacctcatttctctctgtttgcagggaggcacaaacaccagttttattcattcattccttagtcatttaagaatacatactgaaaaaaaaaaaaaaaaggatacatactgagtgtctgccatgaccagagtaatagatacattggtgaacaaaataaacatgtttttaggctttcaaaaacaaaaaatacacagttccaagagagaacagtaacaaccaatagtcaactggctaacccatagtggtttattgattttcccgtgcgtcactgaaattgtttatgtcttcatcaggaaacgaaggcctggtgtcctggcttccgcaagcacacttagctagtaagtagtagagttgggacttgagcttaggtcctgcgctgtttccacaaattgctcgatagaaatttgctcatttctaagtttgccaagatggggacatcggagggagcggggtcgattcctgtaacaataactttattggctacaggattgaaggaaggagagaggctgatgttcatagaacccagcaagggtgggctcaagtgccttttggaaagaagggaagatgataattgtctactccctggacatacatgtcattcctttatccctctcatacccacctagtctcatgcacacccattcatgcccctgccaactcactctcccatgcatctgtccatccttccattcatctgcccatccacccaccctcccattcttctgcccacccatccattcacccaacctctcatccattcaccatcccacttaactcattttcccatccattcctccagcccctacctcccatccgttcactcctccatatgcttgtctgcccacctatcttcccgttcactcccactcccactgtcccatctacccactggctcttctgtgccaggctctgtagggtagactgagaggagtcaggtgggctgagcctttcagagatcacagccaggtcagagaatctgtgatgcagatgcccaggggacagggcagtctgcgatgaaaaccttaacaaggtgcaaagagattctagtcggggaggtgggctggggttctggggaagatgtcatgagctaggctggggttgagttcgattttgctggctgattaaacgcaggtagggaggaggtgttctctgtggaggagggagcatgaagagggctgggaagtaggcagcaggcacggggctgagtgagagggaatggcgggaccctggggaagtgggcaggggcaggtcatgagggtgtgagtgctgggccagggagctcctgcgttagcttgtcagcagctaggagcccttgagggttcaccctgagtgtttctggttgaaggccacggagggaaagaggggaaggagggctggcacactgagcagctgggcgggagacccctggcatgacaactttggtgggctgctgagggcacagagcactgggcggagagccagagctgagctccaggcctgccagtgcctcctagctatgtgacctgggacaagtcagtttctctgcctgggcctcccttttctcttccataaaaggcgatggtggtacctctgtgtacttcatgggcctgtgctggagaaaggcgggctgctcgttgccctgcagcaagagaccataagagggtttgacaggcctttttcatcctgagcccgcaaggacctgggcctcccaaggcccaggcccgtggtgcataaggctcctgtcctctgctgactcacgcctgccagccaggggccttagtgggctctaaactcaagcccatgtcagctggccaccccggctctgtgtctgctgtcctcaggtcaccccctttggctttatgttgggcccttttcctgcacatagtcagttctgctgtgaccgtggttttctctggggccagattttctctctcctaaatagagtcgcagcccttcctgcgattgaccgccttcatcaccatgcaaagattaactgtgttcaggcagggacagcacagctgtacattgtgtgacacccagaccaagccctgctttggttccagtggcctgaaccatatttgatacatgcctggcacggccgtccagaataaagacagggaaataggaaccctgagccctgactgctccgtcctttggctctgacccacacccaggcttttcatccgacaggtcagctgggagccttccctcacacctgccactcagccaggttgctaggagacttccgtagcaaatgatcattgggtggggttcctctgctgattccttgcacatgtccccttttgcttcctagaaaaagaaacccatgtttcagaatctgggtctgggacagtggagtgagttttagatgctcccttacctccgaagaggcattttctgccagagagggctgggggtgaactttctacagtgatcgaagtgttctgtatgtacctgctctgttcaatacggtagccacagtgtggtggcacgtgaaatgtggctaatgcaactgaggaactaaatttttgcttcatatctattaatttaaatagccacgtgcggctagtagctactgtatcagacagtgcagctcatgtgggttccgaaagaacgagggtgtctgtctctggaacgtgtaaggcaagctcagatgaagtggtctctctctatgtgggaggcttatttgcaccagtcccagtctgccctcgctgggacccctgtggataattgccagatgtcactgggtgaaaatcatctttataaatcgcttgacttcattatgctgtgttttagctcgtccctgtccataggcacatgcagttttcccaaaggaaaattgtagcctagttacaatttcattatcctattttgttatttactattatggcttaaggattttttctcattactgtattatcttcttgtttatcatttaagggttacttaatatcccattaagttaatttaaccattgtctttagtgatttcaccttttttctattattatggactaatataaactgaacatgatcctagtacatttcttttgttgcctttcttttttttctttttttttttttgagacagattcttgctctgttcccaggctggagtgcagtggcacgatctcagctcaccacaacctctgcctcccaggttcaagtgattcttctgccccagcctcccgagtagctgggactacaggtgcgcgccatcttgcctggctaatttttgtatttttagtagagacggggtttcactatgttggtcagcctggcctcgaacttctgactttctgatccgcccgcctcagcccctcaaagtgctgggattacaggcacgagccaccgtgcctggcctgttgtctttttaaaagtatttcctggccttaaattcccaggaatgagggataataggctgaaaaggtattttcatggcttttaaaacctatttccaattgttgtctttgaaagattgaatcagtttctattcttgtcagtaatgcgttcacccattttactacatcgtctccagtgctgggttgtcacaattgcatgtttttgctaatttattaagtgtaaaatgatcctttccacttttttggaggaagattcttttggcagaagaattccatagttgctgttggcctctgtcctacgtgttttccatgtaggtctccaaatcctagattatcagtcagctctttggtgaggtctcagtgaatgtcaccttatagattatggtgggcttgggaatgaaggtggcccttgatacacacgtgttgtgtggtgaggcactcctctagatatctgttccttgctggaacagccccagagagagggaactcatctccttcttggtggccaatggcaggaatccaaaagggaatttatcggctcatgtaactgagaagtctacgggtagagtccgccttcaggtacagctgtctccaggtgttccacagagccagtagcactccatttgtgagccctgcttctgccatcttggcctcaccctccggcagccactctgaaggagtggcaagatgggctacaagacccttcagcctttcattctaccgatttagcagcgccagagaaagaaaaagctgctgtcctgataacttcagcaaaaatgcaaacaactggccgagcgcagtggctcacgcctgtaatcccagcgctttgggaggccaaggcgggcggatcacttgaggtcgggagttcgagaccagcctgaccaacatggagaaaccccgtcgccactaaaaatacaaaaacagccgggcgtggtggcgcatgcctgtaatcccagctactcgggaggctgaggcaggagaatcacttgaatccgggaggtggaggttgcagtgagccaagatcgcaccattgcactccagcctgggcaacaaagagggaaactccgtctcaaaaaaaaaaaaaaaagcaaacaaccaaaaacaaatttaaagagccacccaggcacgaccctgttggcctgccttgggaccatgcccaggcatctctgaaccaatgactgtgacaagtttcattttcaggcgcccttggttcagtcctctgattagctgggcctggggtatgcccctggcccagggtgaggtcaacccgctatgaatcccttggactcagagcgagggagaggcagtgtccaaaagcaactagagttttgaatccacaagggggaatggatgctggccaagtcccccactgctccccagccccagggtcaatttcccagcagctccagtggctcccagacctgaggttaggggtgccccaggaacaggcccctctaggctctttgctcttgtgttctcatttactcttcttgaggcacacctgtgtcacagatgagacaagtgtcacagatgggaccctggtctctgcattcgccttggtggactcagcttcctcatctgcagaggggggttggggagctggagttaaggaggggtggctaatgttttctcactgtcctgaggtctgtgatatcagctatttcccgggaagcggtgggagcaacacactgatcagtgggcagccgggagggaaggggagggcctgggggtgggtcccctgctggcctttgtgcagctgactctcaggaagcccccagcccctgactgggctggctgggccccttgggtgaagcagtgtccccggctgggagggttatccccacctcctccaggctgggccccttgcgggtacaagggggaggattgttcccacagaggtgcttgggccagaaaacacaagtggccactgtgtatctgctcgcaagggtgtgggctgaggcgttagtcactgccagccagcagtggaaggctgggccaaggctcccctcatcgtgcgccggaacccggccttgcttcagccgctgggagagagggacatcggaggccacagacagccgcttgttctttatgctattccttgcctgccaactcccacgtgggcctcatctacttggaccacccttagctttccaagactcacccactccctaagacggctctcatcagagcatggagagagttggacatcatttcaccatccatcctcccccatataggggggagactgaggcccagatgagacttttgcagaatatacaggcatctctggcaaagctgtcagatacatggaatttgaacccacattggccggaattcaattcctaatcctttgaacctgctgtgtgaccttgggccggtgacttcatctctctaagcatcggttttcttatatataaaataaagcccttaatagagagttgtaaaagttaattgaagggatcaacggtcttctcatgccctctctcagctttagtgcctcagacctagtttgattttcaggcccccttaggggcaggatggctttaggctggaggctagaagtcaaggagagcttgcagcagtctcagctggctcagcagttgttctgagaatgcatttcattggctgacttgatcacatgccaattttttttttttttttttttttttttagatggagtttcgctcttgttgcccgggctggagtgcaatggcgctatcttggctcactgcaacctccgcctcccgggttcaagtgattctcctgcctcagcctcccgagtagctgggattacaggcatgcaccatcacgcccagctaatttttgtatttttagtagaggtggggtttcaccatgttggccaggctggtctcaaactcctgacctcaggtgatccacctgcctaggcttcccaaagtgctgggatcacaggggtcagccaccgcgcctggccacgtgcctattcttgagccaatcactgtggccagagggagcgcggtattctgattggccaagatgagtccctacccacttctagatattgtattttagggactggaaatgagggcaggttggtccctgctgaagaaaaatcggggaagggtgaattatgatatgggagggcagtgattccctcatgcaaattttcctaggcagaaaattgcttgtcttgttcattagaatttagccaagtaaatagtggttgaatgaatgactagggaataagctgcttcctggcagtgtggtgtagtgaacactaggccgggagtcaggaggccactgtgacagctcacagtcctgctggattcccaagcctcagtctgctcacttgggaaaccggcaccaaggctaacgctggccttaacggtttgttggcagatgacattctggctgcctgagcactcctcagctgccaggcactcccttgctgtgagtggttgctattggctgtgattgtcattcatctttagcaaagggagatagaacagggagctctggacagtcatcaggaaaggtctttgggggaaatgttttggaggtaaggaaggcttgaattggatccagcctttaccctccacccccactcgctgtgtgacctgaggcacatcaccccacctctctgaatctttttcctcatctgtaaactggcaataatatttgtctttaagggctggatggaggatgaagtgagaaattccgtttaagtcctgtcctggaacacagagagtgctcagtcagtgttagctgtttttatcatcagccgtattacatctcctgtggcctcaaggtgatggattgctgcctcaacgaggctttgaaagaatttaattttggccaagtcactttttggtccgtggttcctactaacctctgtctggcaggttctggtctccatggaatctgagtgaggtgctgggtagcgggcgtgccttgtgttgacactggtactggctgaggcctggccgtctggtcagtgctgcctttcaggatggtgggcaaggcaaggtttgtgcactcctggaaaatggtccccacctgggcctcctccaccatcaggagacaacatcccttttcaggaaacccaggtaaaggtgacatgcggccttctttgccagctttcaggactgaaagatgagtgattgaaggggggcccttggccagctcagcatggtcaaggtggttgccttggtcactggccctggctctagccactccactaagccttcaaccttcctctcaggaaaggagcagagctggtgtaacctctcttctgggtttggagaggaggaaggggaggagtaggaagagaaagaggaatgtgtgcagaaggaaaggattctttccagccctctggtggggatgtacagaaatcagctttacaaggaatgaaaaggcagggacacaatcagttaagactgtgtgtgtgtgtgtgagagagagagagagagcaagtgagcgagcaagcaccagataacttaaatgatgggtggctaaggcattctaaacaagctttttttaattttaatttttatttatttattttttgagatggagtctcactctgttgtccaggctggagtgcagtggcgcagtcggctcactgcacctccaccttccgggttcaagcaattctcctgccccagcctcccgagtagctgggattacaggcacccaccaccctgcctggctaatttttgtatttttagtagagatggggttttaccatgttggtcaggctggtccccaacccttgacttcaggtgagccacctgccccgacctcccaaagtgctgggattacaatcgtgagccactgcgcccggcctaaacaagctttcaaaattgagtttaggggagaagtccccacagagttagagccacatgagctggtaaattctaggacaatgactggctctggaaaatggcccatcatgaaatgtccttccctgaactgggctcctgggcccagtgtggaggcatcccaggctctggcctgcaagggacttggatggaggaagaatgtggccaccaagagtgtgcacacctgggcatgggactgccttagttccaagcccactctgccgcctcattcctagggtactctgcctcggatcggtctcctcatctgtctatgagatattgacagcaccacattgtagggtgatccaggagataaatgcactgacacatataagcagcactgcctagtgctgcatgcagagtggatcaagggtccactccaacatattattatcaatgacataatatgacaaatggcatattattatcactgcatgggatcctggggactttgcagctcaattaatgaaagaaatatttatctaaactgagaatgagtgtacagaaagcaaatgtggagagaaattgcctgcttgcaccactcctcagtatttttttattttttttttttgagacggagtctcactctgtcacccaggctggagtgcagtggtgtgatctcggctcactgcaatctccacctcctgggttcaagcgattctcctgcttcagcctcccgagtagttgggactacaggcggtcaccaccacgcctggctaattttttgtatttttagtagagacgaggtttcaccattttggccaggctggtctcaaactcctgacctcaagcaatccacccatctcagcttcccaaagtgctaggattacaggcgtgcgccaccacacccggcccaccccttagtattgcttccttccagaaggctccttggtggggttaggtgccctctcccacaccccatcataagcatgctgtctcgtcactttcagtagagggctgtgtctctctagctagactttgagctggccagggagagggttgctctgtgtctgtattgtgggcaccctgtgcagggctggcccagtagtgctctgttaaatgtctgttggcatctggtcttagagacttctaagtggtggagattgtagggagaccttgtacagtggtggaaagtgcagaaaattttgacgttagaggatcctgatgcaaattctggtgccactcccctagttccaatcacatttcccctctaaacctggacttgcacgtccgtctgtggaatgggggaaactccaagcctcgggtccctgtgatgacaggaatgaatgctcattgtcatccatagggtgctagatgtgcaggaataacttggccagccggaatttccggtgcagtcaggttccagagttgttatggaaggcaagggtggagcgtgatcaatattatccttaggaaggtgccacggtggagactaagctataatatgttcattcagtccagaggagctcgttttccctgtgctttgcaatagattgctgtttaaggtctccagatgagcagcgtgcttttaggggccttttttttttttgagatggcatctcactctgtcacccaggctggagtgcagtggtgcgatctcggctcactgcaacctccacctcccaggttcaagcagttctcccacatcagcctcttgagtagctgagattacaggcatgtgccaccacacttggctagtttttgtactttttagtagagacagggtttcaccatgttggccaggctggtcttgaactcctgacttcaggtgatccacctaccttggcctcccaaaatgctgggattacaggcatgaaccaccgcacctggctaggggccattttgtagggaaatgtgtttgtggtttttttttctttcttttttttttgagacagagtctcactctgtcgcccaagctggagtgccgtggtgcaatctcggctcactgcaatctccgtctcccgagttcaagcagttctcctgcctcagcttcctaagtagctgggattacaggcgtctgccaccacgcccagctaatttttgtatttttagtagagatggggtttcaccatgttggtcaggatggtctcaaactcctgaccttgtgatccgcccaccttggcctcccaaagtgctgggattacaggcatgagccactgcgcccggcctttttctttcttttttatttatttattttttttgagacagagttttgctttgttgtctagtctggggtgcagtggtgccatcttggctcactgcaacctctgccttccgggttcaagcaattcttgtgcctcagcctcctgagtagctgggattacaggtgcttaccaccatgcccagctgattttttggtattttagtagaaatgaggtttcaccatcttgcctaggctggtctcgaatttctgagctcaggcaatccgcctgtctcggcctcccaaagtgctaggattacaggcatgagccactgtgcccggctgttttctttttttcctgtcacccaggctggagtgcagtggcaagatctcagctcactgcagcctccgtctcctgggctcaagtgatcctcccgcctcagcctctcaagcagctgggactacaggtgcatgccatcatgcctggctagtttttgcatttttttttgtagaggcgggatttcgctctgttgcctgggctattcttaaactcatggactcaagcaagccacccgcctcggattcccaaatgctgggattgtaggcgtgagccaccgtgcctggccatgtgtacttgttcaacaccggaaccccatgcagcagggtgggtgagatgtttgctgcagcattccccaccaacgtcctcgcaggatccttggggagctgtgggtcctcacctcccatttcccagacactagctccttgtgtgcaatggggtgggattgcttgctccatttacatgattatttctctctcttttgaattgtggtaaaatatacagaacatcatatttatcattttggccaattttaagtgtaaatttagtggcattaaatcagttcacagctgtgtagccatcactgctgtctacacctcaaaattttcatcatcctctacaaaaactctttacccactaaacaataactccccatttcccctttctaacccctggaaacctctattctactttccacttctatgatttcagctactctgggtacttcaggtaagtggaattatacactatgtttcctgtgtctggcttatttcactttacataatgttttcaggattcatccatgtagtttgtgtcagaattgccttcctttttgttcctttttatggcagaatattttagtgtgtggatataccgcattttgtttattcattcatctttttttgttgtttgtttgttttgagatggagtcttgctctgtcatccaggctggagtgcagtcgcatgatcttggctcactgcaacccctgcctcctgggttcaagtgattctcctgcctcagcctcctgagtagctgggattacaggcgcccaccaccacgcccggctaatttttgtgtttttagtgagatggggtttcaccatgttggccaggctggtctcgaactcctgacctcaagtgatctgcctgcctccgcctcccaaatattcttcatctattgatggacacttggattgtttccacactttggctgctatgagtatataaatatctccttgagtccttgctttgagcttttttttttgggtatatacctatgagcagaattgctaggtcctaggataggtctatgtttaacctttcgagaaactggcaaactgttttccacactggctgcaccattttacattcccaccaacaatgcacaagggttctaacttctccagtcctcaccaacacttgttattttccattttttaaaattatagccatcttagtgtgtgtggagttttcttaccctcttattcctcacataaggaagacttgttttgcctaggtgacatgcatctacgaaacagttccgctgtaactggtgggcacttacgcagtctgccttttcattctactgttagtgcgtgggaaatgttgcaaataaacgcatcaaacattcctatcataaattttaaacaaattttaggccagacacagtggctcacacctgtaatcccaacactttgggaggccgagatgggcggatcacttgaggccaggagttcgagaccagcccagccaatgtggtgaaaccctgtctctactaaaaacacaaaatttagccaggcgtggtggtgcacatctgtagttccagttctcgggaggctgaggcaggagaattagcttgaacctagaaggcggaggctgcagtaaacagtgatcacaccactgcacttcagcctgggcgacagagtgagactccatctcaaaaaacaacaaaaaaaatttttaaacagatttaaaaaaatgttttttcttttgggatggagtctcactctgtcacccaggctggagtgcaatggtgtggtctctgctcactgcaacctctgcctcccgggttcaagcgattctcctgcttcagcctccccaatagctgggactacaggcgcatgccaccacactggctaatttttgtatttttggtagagatggggtttcactatgttggccaggcttgtctcgaactcctgaccttgtgatctccctgccttggcctctcaaagtgctgggattacaggtgtgagccaccgcacccggcctagattttaaattttaaacagagtgaaagtaccctttgaatgcctccctatttctggcccctccccagcctgctgtcaggcagtatctttcctgagttttccatacattcacagatgcttgtgagcatgtatgaaggcgtagttttccattttttatgcaaaaagtattgtgccatttttattgttcaatgacttgggtttttttcttcgttttttactgaacaaatcaacagtctttccatgttggtatttgtagagctgtgtcattcttgtatttttgtttattccatagtgttgtaggggtgtatggtacttactcttaagtacagacatgatgtgtggctattgttaagaacaatgtacgttccggttcagcatctggacatccggcctctgttttcacactcatgcaggactgcgggctcacgtccaaaggtcagtttcctgcggagcatgccttgttgacctcctgtatctcctctttgcaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtgggtaaggctgccgccctgtctgtcccagctcagcccccatggcctggtgctctggagctagcctggtcctgaagtcttcagctctttctcagcatctgctttgaggacgagggctagggcaaggagatggtgaagtagggagctcctggccacttacccaccctttcctgtggtgcctcccccttgggagtagaactagtgatttggaacagaaagcgctatggcctggcctcgaatcccagccctgctgtttacaagcttaataatcctaaccaagttcctaacctctccatgccttagtttctccatctgtaaggtggggctaataatagtacctagctcatagagtgattactgcgattaagtgagttaattcatgataggtgcttagaagagtgctgggcacatgtaagagcccggtaagtattggctgttttgttatttgtcatagtagcacttcttctgccactgctacagctgttacatggagatccttctcgatggctgcactaaagaagggggctctttaccagcccgctattctccatcagcatcctcacagtgtggttgtagcttcaagcgccatcttccaaactcagcaacacccctcaacttcttttttttttttttgagatggagcctcgttctgttgcccaggctggaatgcagtggtgtgatcttggctcactacaccctccgcctcccggcttcaagcaattctcctgcctcagcctcctgagtagctgggattataggcatgtgccaccatgcccagctaatttttgtatttttagtagagatggggttttgccgtgttggccaggctggtctcgaactcctgacctcaggtgatccgctggccttggcctcccaaagtgctgggattactggtgttagccaccatgcccagtcctcttcattttttttttttctaattcttccaaagaaatccatcttctgactgtgcccttctctactgttgggcatttaggctatttccttttctttctttcttttttttatttttatttttattttgctcttataaacaactctgtgatggacatctttggatttttttgtgtgtcctctgagagcttttttatgagaattttttttttttttttgagatggagtctcactctgttttccaggctggagtgcagtggcacgatctcggctgactgcaacctccgcctcctgggttcaagcaattctcctgcctcagcctcctaagcagctgggattacaggtgcatgccaccacgcctggctgctttttatatttttagtagagacggggtttcaccgtcttggtcaggctcttcttgaactcctgacctcaggagatccacctgcctcggctgcccaaaatgctgggattacaggcgtgaggcactgtgcccagcgagaatttttaagagtctttaatgtctattgccaaactggcctcacagagccacttttgatattaaccaaaggagatctcccattgacccacccacccacccagccacccactttctgtccattcatcttcctctctgtgcatacagcatttgttggcctgctgactatgtacccattaagaaaaatagctattatgtttctattcctgttattgattgtggctgggtaccaagttcataactttcccaggtccaaagatactacttatagtagctagcatttattgagagtttactgtgtgcttggccttttgctatgagtttcacttgcattatgtggtttaatcttcattctgtgaggttgttgctttatcccatcttacaaaagaaaatgagaaacaaaaaagctatgtgagctgctccccaggccacacagctagcaagtggcagagctggaaaaccaggtagagccaaacacagtttgtaactagactgcgactgtcatgctgttgtttaaataaatacgctagacttttccgtccctaaattgtcactttaggctggtgctttctcctccaggcccactgctgtggccaagaccatttctttccctcctctattgtagctgccctgacagcctacatttgttactttgtagaaggccccagctcctccgatttgccttttagacactatgagatcaaggaaggtggccctggagctgggtagataaagagggggaaaggatggcaggcaggagagacagcgtgggcagtggtgtggaggcatgaaaggtacagcctgtttgggaggtggctagtctagggccagggcagcatgtggtgaaagatgagggtggtaaagtaattgggggccatgttgtagaaggccctgcatgccaaggtgaagacttatccctccatcttttactgcagtggttctcaaagtacaacccttggatcagcacaccctggatctttgttagacatgcaggttatcaggcccctcctgaggcccattgagtcagtaactgaggtgaggcccagcaattggcgttttaaggtagggcccagcaatctaagtgactctgatgctcgtttaagcttgagaatcactgttttaggtaatggagacccagtggtacttttttgcaggggagaggcatattctgtgttacagaaagaagtcaggtttgagaggacaagagaaaaacgtggaggcagtttgagaagtggtaagaatagactaggccagaagcccaaggatgtgatgtggaacatcatctggtcaggggaggcttcagaggaagggacatttgaacggggtcttgcagaatgcataggagtcctctggggagataagagaaggaagaacagtcaaagtagagggaccagcaaatgggcaaaagtgtagaagggagaagtccagagatacaggttgaaggatgcaccaaccctttgatatttccttctgtgtgatggttctcaggcgcatcttgtgaccaggcctgggcccctgtggctttaggagcccacttttccatgtggatatctttgacaaaaccagttctggacctggggtctgctctcagggactttgggatgagaaactggctgttccccaagtgtcttaggtcccttctgtagccatggcagacagggacagactttcccccgagtggggtggaggtcattcaccacatcaccccatgtgcaatttgacaagattagctcatttttgttcagaatttgtaatcatggcaaaatccgtctgtgcttccttatcactacttctgcttttgaatatcaaatggtgcaagttggagaaaaacaagccaaaatgctctagaccagtagaactataatgtgagccacatgcatcattttacatttctttctttctttctttctttctttctttttgagatggagttttgctcctgttgcccaggctggagtgcaatggcgcgatttcagctcaccacaacctctatctcctgtgttcaagagattctcttgcctcagcctcctgagtagctgggattacaggcatgcaccactacccctggctaattttgtatttttagtagagatggggtttctccatgttggtcaggctggtcttgaactcccgacctcaggtgatctgcctgcctcagcctcccaaagtgctgggattacaggcatgagtcactgcacctggcctatatgtataattttacatttctaacagccacatccaaaagagcaaaaagaaacagatgaaattagtttcaataatataatttatttaacccagtgtataaaaatatgatcattttgacatgtgatccattgaaagagttattgagctattttactttttttcattctaagtcttcaagtccagtgtatattttacacttttaacacatctaaatttgggagctaaattttcatcagaagtccttgatctgtgtttagatgtcataaaatttacagttgagaaaggtagattcacacacccaagttgttccaacattcttaaacgtttcccagtaactgaaccaagtctcagttttcaaatttaaatgaattagaagagaatggaataatacatttaggtctctaccgtcgccacatttcgaacactcagtagcacatgtgttagtgtctcccatattggacggcatagacagtgaagctctagatgactcccagggcccaaaatgagtgactgcaagaaggcctgggctgacctcgtgaatgtcctctgctaatagctacccccatcctccacccccagccctgagccagattttggtctctgggcaaatctttcaatggccgggggatctcttttccaacatgtattacaggagcaagagtgagttctttgggaagaaaagctctggtgtctggcatttggcccatttctgaatgcacatatgtccacctgatcagtttcaagctaccaactcgatgtcattaacagagttgggaaggcctctggcctcacggagctcaaagtctagtggcagaaacagacggtatgaaggccagtgaagaagtagatgagaggacttgggcaagtgacaagtgagtggaagaaaaatcagtggggaaatgcagtaggcattcctgggtagggtcaggagcaggtgctgtaaacacgatggacagagaaagcctctctcatgaggtgacattttagctgagagccaaaagaccagatggaggcagacctccaaatgtgtgggggcagaaagtgccaggtagagggaatcagaagtgcgcaggccctgaggcaggagtctgcagaggaccccacagaaggtgttgcggctggcgcgtggtggagggagagcggcagagtaacgtgaaccgaggctagactgtctgcagcacatgctgctgagcagctactaagtggaaggccccatggtggggactggggattcatcagtgagcaagagggaaacggtcctcatcctcatggagcctccagtctacatgtgggagacaactaacagcgcatgaacacataactccagcagtgatcaggatggatataaaattgggaagtgggccgggcgcggtggctcacgcctgtaatctcagcactttgggaggccgaggtgggtggatcacgaatcaggcgttcgagaccagcctggccaatatggtgaaaccccgtctctactaaaaatacaaaagttagccgggcgtggtggcgtgtgcctgtaatcccagctactcaggagggtgaggcaggagaattacttgaacccgggaggtggaggttgcaatgagccaaagattgtgccattgcactccagcctgggtgacaagagtgagactctgactcaattaaaaaaaaaaaagaaaaagaaaaacaagaaaaacgcaaaggtcggcctctgaagcctgcaggttcgcaatccgtctcctgcctgccacttactgtgagaccagagccaattccttctgtccttgtgcctcagttttctcaactgtaaaatggggatcttcacagtagtgcctgtaggaataattgagctaatagttgtttacaaatagaaaaggtctataacagggctgggcacacagaaacttcggtaagtatcagctgtcaccttcatcgtgcctctccttcactttctgttctctttggtccccggcacggggcctggtgtgaaatctgtccatggtagatatgcactggggagatgaaaggagacaggacgtgcctgcccttggtggggcaggggtctgtcgcgagcagccaaagtccctttggggtggcccagcccaagaacgctccctaagacttcctgatgaggaagttggctggcgccgtggttaccctccctgaaggagtgactgtgggcctttctcagtgtggcttcttgcctcaaactgagcattctgtaaagaggaagtactggtcccaggatcaagagcagggcatggatgggatgagcctgctgtccacatgtgtccccatatgaccacacgttgctggccagggtttctgtggcttgtggtcctgggctcagaggccagcccttggtcattgacagagattgcatatctgacctcaaaacagccaaaactgtaaagagaatgtgacacccggaagtagctgacagtgctgtgtactttagaaagttgttcagtgtggcagaagggatctggggctggaatcaggagacctgagttcttctttctttctttttttttttttttgaggtgttgtttcgctcttgttgcccaggctggagtgcagtggcgtgatctcggctcactgcaacctctgcctcccaggttcaagcgattctcctgcctcagcttcccgactagctgggattacaggcatgcaccaccacacccggctaatttttgtatttttagtagagacggggtttcgccatgttggccagactgttcttgaactcctgacctcaggtgatccaacctcctcagcctcccaaagtgctgggattacaggcgtgagccaccatgcccagcctaggagacctgagttctgcctgggaccaactggctgtgtgacccgagatgagcttcctttcctgggcctctgtttcctaatccataactctaggggcttggaagggaggatcccaaggaggtctttctttcttttttttttttttttttttgagacaaagttttgttcttgttgcccaggctggactgcaatggcgcgatctcggctccctgcaacctctgcctcctgggttcaagcgattctcctgcctcagcctcccgagtagctgggattacaggtgtctgccaccacacccagctaattttttgtatatttagtagagacgaggtttcaccatgttgaccaggctggtcttgaacttctgacctcaggtgatccacccgcctcggcctcccaaagtgttgggattacaggcatgagccaccgcgcccggcccaaggaggtctttcaacggagtctgcccattttatcctggcccttgtatctctgcagttctgaagtctggatctgtggtcacctggcctggggcagccctttttggcagttttgggtgccagaaccctttccatttgctgtggggacctggtcttcctcgggctccctggcactcaccaacccctgccctctctctggattgggcctttggggcacccggttgttgggacacacacacacacacacacagacacacacacacacacacacacacgagcactttgtaaagcactttaaagtctgcacaggctttgcagccctggaggtgggtgtattattactgtatcgacatgcccattttacagaggggacagacaccctaaggctcagggagggaaagtgggggaggaggctggcagctccttggcctagagggtgaatcaggaggcagggggtggtaacaaaaggaaggaggcagcaacatgatgatgtggatagttggcctcgtcaggaatgttttctgtgctaggcctgtgccgggtgggctgtttcctgactatctcaccaaatcctcacagttctgtgggattgagttttgtttgtttgcttttgtattgctctgtcacccaggctggagtggagtggcatgatctcaactcactgcaacctctgcctcccaggctcaagcaatcctccctccttagcctcccaagtagctgggattacaagcatgtgccaccacacccagacaatttttgtattttttgtagagacagggctggtctccaactactggactcaagcgatttgcctccctccgcctcccaaagtgctgggattataggcgtgagccaccacgcctggctcgagattgagatgttgtcacccccattttacagatgtgaagaccaagggttagaacggtggagtggagaggctcgtcccacatgtcagagccaggctccagcccaggtctgcctagctccaaagccttctctcctgccccctggaatgcccctctctgggtgccaggctctgggcatcactgggaacagttcaaaggatgtaatctgtgacccccacccttccacttgaggggccatcgtccggcagaatgttttttggcagggcttggtggtgaggaggcctgtgccgggggacctgtccagctgctcccttgggcagtgacccgggtgcggttggtggcccagagcagatggagctgtgaagcagcaggtggataactgagggctttgctgggatcccgctgttggaatagccggcctgggctgtctatctcacatgcagaggagcaagggtgattgtcattccaggattcgcccaccatgtcaccaagcacgtccatgtagcccttcctgtcaggtcagtgcaccatctgaccttgtccttcccctgcattagtactctccgggcacctcccagccctgcttccctctgccccccaccctgtcactcacaccctcattccttcagttgatcatgcacagagtgggattggaatctgcctgcaccctgtcctgctgtgtgaccccagacacgcctcttcgtgcctctgagctccaggcttctcatctggacgtcggggatgatagtgctgatcaccacagtgtgtccagggttggaaacccagctggcagacagtagcagtgtaggagggtcccagacctgctcgtggctttcatggtatgactccaagccaggcatcttaactagcaggacaggcgtgttgctcatagtccacatcagccaacagatgtgtgaaccacgcccacaggctacgcagatggcaggtgtgatacgatcacatgtatattggttttcatccgcaattcctggctcataactcccatagcccttattacaatgttttgttatcatgttgggtgagttaggcctcaggagcaggccccaggaaacagagtctctctctctgaccttctcctgtcctcctgtcacctgcctaaggcaggactctaatctgattgtgggtcaagagaccgattccagaggggtcttataggaaggcatgccacacagagaggccaagaaaagtctgaggctgggcacagtggctcacgcctgtaatcccagcacttagggaggccaaggcgggcagatcacgaggtcagaagttcgagaccaccctggccaatatggtgaaaccccatctctactgaaaatacaaaaagattagctgggcatggtgacatgtgcctgtggtcccagctattcgggaggctgaggcaggagaatggcgtgaacccgggaggcagaggttgcagagagccgagattgtgccactgccctccagcctggacgacagagcaagactctgtctcaaaaaaaaaaaaagaaagaaagaaaagtctgagcagcaggtcttgctgggtttagaccgtgcacttttttttccaatcacgtctctgtacacggttgtcagtcatgcctgtgtaacgaagtcttcataaaatcccaagaggatagggttcagggaacctctggacagctgaccaggtggagcttcctggagggtggtgtacccagggagggcatggaagccccttgccccttcccccagcctcaccatacacatcccttcatctgtatcttttgtaatatcttctataatgaatcagtaaacataagtaaatgtttccatgagttctgtgagccagttccagcaaattaaccaaattcaaagcagggttcgtgggaaccccaactggaagccagtatctcagaaggtccagaggcctcgacgtgcaactggtatgtggggtggagggcgcagtctcggggcctgagccctcagcctgtgagatctgacgctgtctcccggtagatagtgtcggaattgaatcggaatacacacagctggtgtccactgcctgtgtgtggggaaaacccccacatttggtcacagatgtcttctgtgttgatgattgtggtgtgagaacagaggaaaaacaaggtttgaaagttattcctcaacagcaagctttttgtactatttgaattggtgtggccctttatacatccacacctttcatataagaatccagacatctgacttggccccacgggccctattccctcgcaggctctgtgcgccaggctgggtgtggctgcccctctacataggtacatgctccctggtttgtcctgccccggccaggtgaccactctggattcatgctccttcctgtatgagataggagcagatgattccagtgctgtgggaaggagtgtggagacaaaggaggtagagggggctgtggggctgtgttccgttttccttgtgtttcttgagctgcttccttcttcctggccttgggagtgggttgtctctggtggaacctttagcagttgcagctatcgtggcctctgtccccgtcatgataatacctacctgtgtctggcattccacatgcatgatctcatgtgattggcctcccacctccctcgtttagacagggtagcaatgattcactcagtcattcattcactcaccaacacatgcttccccggggagcaccggctgtgggcccggcagtttaggtgctggcgcacagacacgaaggcctgccctctggaaatttacattctacagggggcagggaggagggggaggcagacaacagacaataaaagtaaggcgtatagtatgtgagttggtgacgtgagttggtgacgtgtgctgtggacaacagatggacgccacacagtgtgtgtgtgtgcgcagtgttttactgtcctgtgggaggtgtgagcttgcccaggacacctgttgtttctccagccttgcacggggcaggcgctggtgcagggctgtctctgtggatggtgatttcggtttccagcatggacacagcacggacacagcatggacatgctactaatggctgtgctgtactcactggacaccaggttctgagctacaggctttccctgtgtgatcccatgtgatcacaaccagggaggcagcctctaccatcacccccactttacagatgagcatactgaggcttggatctccgaagttacttgtcccaaggtcattctgttagtgtccggccataattgggacccaggtgtgtctggctccagagtggaaacccagtgctcaccttggttcacgtgggagctttggttctttggagacatatgtcccttgactaatgaatccgggaaggctgggggttgcccttagggaagtgcttcttccctggctttctgagcaggctctgagcgggccagcgcgtgctctgcctgcagtggccaccgccccacactgccccacccccgccgccttggtttgactcctacctgtccctcaaggaccaactgaaaggttacaaaacatttagcaatttgagttgaatgtgccgccttccaacagctggtgtgcttttccctgtcccttcttacccttgtcctgggatttgtgagtccatctcctgacctcctccttgggggtcactttcctcagggcaggggcatgggcctggctccttcccctttgtgtccagcactgtccttagcagagctggctttagagaacagtggccagagagacagatggtcaaatggatgaaaaatgtccctgcagacacagaactgcctttgtctctccgctagggctgaagtccggttagcatctgcacagagtctgatcttagccctgatcttggcatttctggaagatgggatggactcaagctcaggggactttgaccccagagccagtgcttgcgacctgtgggccagatagtacctgagggagttaggtcccctgaaattgagtcgccttggttccatcctgaggtgccttgggacttgggcacgcgtagttaggtgtgcaaccacctgagtctcctcatctgtaaaagggggtggggggtatctaagtcatcccttagatgttccctcccctttgcctcggcaggactccctccacccggccccatggcacgtacacgcttaggaacctcaaggtcactccctctgttccagatgcccttgcccatgggtgaactcagttcaccctgctcaagggcagtcctaattccttccccaggcttccttcgaatgtggtgggtgaggctgggggtggaggaacacgcctggcccagcgttcctgggaggcctgggggtgtaggctgcctagtaaatggcagcattgtttggcctggagctcagagatggggagattctgggactccacccacagcagctggctgctgatatgctaaggacatttctgtgttgactgttgcgttttttggtgtctgcctccagggacttgcttctcaggcagaggccttggttggataacttttgtcttctgtgctgtattggagaggctaaggaggttcccagcaccgccccactgacagcatctctcagtgcagggaggcctggggggctgatggtcatgcctacctctgcttccgcaggaagaaacaagcctagagagggaaagcagcttgcccgtggctacacagctaggctgtccgtgtgtcttggagtcagactgaccttggtctatactctggttctgtcacttattagctgagtggctttggggaagccccttcccccaccaaacctcagtttccccatctgtaaaacaggaatatttgtattgcttatgaaattaagtgaaggaatgcttatcaaacacttagcgccatgccacgtatgcactagcggctcagtaatggcagccatcatctcttctctcttggttggcagtagagggagggactggcttgcctttgtcctgcttcgtttgcacaatctggctgtcatctctgttagccatcttttggctgttctgcccctgatttctgggcatcttaaggctactgaattttttcattcatgtttattcattcatttattcaacaaacacttatgatgatgtactaggtcccgggctttgatattggatcgtatgaagggaatttttttagatgtaaactgcttcttcaaggataaagtgacttcgctcactttgaacctacatagtccatgttgcaaatgaccttattgctgttgagagcttcattttccagatgggaaaacagcggaggctcagagcaggaaagaggtcaggacagccccacagaaggatggtggcagacccaggaccatgtccacatctcctggctgtggcttatttaatttgagttctaggagttttgctaacatttatttattgagcacctttgtgtacccaggacatgctcttggcctcaggaaagcccagggaggtgaggggatccaggcccagagcacggtgtggtcactgcgtgttgatgcctcacctctggagtcaaagtgccttaattttctttctttctttttttttgttttgtttttgagacagtgtcttgctgtgttgcttagcctggagtgcagtggcacgatctcggctcactgcagcctctgcctcccggttcaagctattctcctgcctcagcctcccgagtagctgggattatagacatgtgccaccacacctggctgacttttgtatttttactagagacagggtttggccttgttgcccaggctggtctcaaactcctgaactcgtgaaccactgcgcctagcactcggttttttcttgaggacagctggggctgtgacagtgccaacccaattcctgctggtcctactgcctatacgctgtaaaagttaatgtctaaaccctgtgggtggtccaggctcacccttatctgggacatcctggcttccttatctctggtgagcaagctcacttggtatgtgtgtgctgaccagtagggcccagagagggctggagcaaagaagcagaggggcctttccccccacccacccaggggctgtgacccagcctgtttgtggcttcctccttgaggcatgaggagggatggggtgcttagatctctgccacttatctgtgaccttaatcttcctgagcctcagtttccccatatgtaaaatgggaatacaataatacctagtgctggtaatactcgataacatttatcaagcattgacttactatgtaccaggcaatgtcttttgttctgacatacattatcctacttaatcctcacaataaatcttatgaggtccaggcattttttaggatacctacctcaaatagtgagtgtgagataatccatggaaagcacttagcatacggcccggcacagagtaagctctcaaattgcattaggtgtcgtagatagggataccgaggttggcccaggttaaactgctaactgcctgccttgtggggatgttgaggacatgatgtaaaaccttagaacacctgcacacatcgggttttctttgtgcgcattacttagaagggtggaaatcaacttggcacagcactttggtgtcaatatttattcccagagggctggtctggtggagaagagagattttaaaatcctagctctgtcagtcctaagcaatattgagctgattcctaatttgcacagctctaaagacgtttgtgtagtaatcagtcccacggcaactctaagtggacactgggccaagaaggcaaataattacttaaattgaggtgtgcaggtctaatgctgggtgtgtgacgtgtgctgtctcatttatccccgcctagcaggtggagataaccatccagacccatagattggcctcctgaatgtgaactcccaggagatggaaactgttttttcactgctgtattcccagtggctaaaacaatgcctggtacagggcaggtgcctgataaatttatgaatgaatggacgagttaccttagaggtgttgcggcctgccaggatcccgtagcaaggccccaacccttacacggcaccacgacagctgctcgatctaaactgatgggggtcatggaacacaggtgtccagtttcctttggccctcagccagagaagaaagccggcgattacaggctgctgtgacatcccccatcagacaccctctgagagcgcatataggctgaggttgccagggaaacaaggagttcctgggtgcagagaccacacctctgacaagagggcccaggtagagcaggcacctcccttaccagagtgtattacctgtatctaagcccatgcaggaccaccttatttttctctcttttaaatttttttttttttttttgagacagggtctggctctgacacacaggctggagtgtatgtagtggcacaatcggctcactgcaacctctgattcctgggcacaagccatcctcccacgtcagcctcctgagtagctgggaccacaggcacgcaccactatgcctggctaatttttttttgtattttttgtagatacgaggtctcactttgttgcccaggctggtctcgaactcctgagctcaagcaatcttcccgcctcggcctcccaaagtgctgggattacaggcatgagccaccgcgcctggccctaaattgtattttcttgtgataagaacacttagcgtgagactaccctttaaacacattttaacgtgtacagcacattgtgcagaccatagctatagcgttgtccaacagatctccagagcttattcatctggcttaactgaaactttatgcccagtaatgagtaactccccatttcctctaccatcagcccgtggcagccaccattccactcttgattctaggattttgactgttttaccagattcctcatttaagtggaatctgcagtacttgcctttccgtgactggcttattccatgtagcataatgtcctcagggttcatccatattgtctcactttgcggaatttccttcttaaggcagaatagggatccattgtgtgtacatactacattttctttatccattcatctcttggtggacatttaggttgtttctacatctcggcttttatgaatagtgctgcgatgaacatgggggtgcaggtatctcttcaggatcctgcttttaatgcttttggataaatacccagaagtgggattgctggatcatatagtagttctatttttatttttattatttatttatttatttttgagacagagtcttgctcagttgcccaggctggagtgcagtggcacaatcttggctcactgcaacctccgcctcccggattcaagcgattctcctgcctcagcctcctgagtagctgggattacaggcatgtgccaccacaccaggctaatttttgtatttttagtagagacgaggttttgccatgttggccaggctggtctcgaactcctgaccccaggtgatccacctgcctcggcctccgaaagtgacgggattacaggcatgcaccaccacacctggccaagtagttctgtttttaatttttgaggaacttccatactgttttctatagcagctgcaccgttttgtatacccaccaacagtgtgcaagtgctcccttttctccacatcctcatcaacacgtgtcatcttttgtcttcttgatgatagccatttttacaggtgtaagatgatacatatctcactgtggttttgatttgcctttccgtgatgattagtgatgttgagcatctttttatttacctgttggacatttgtatgtcgtctttgaagaggtgtccattcacgtccttcattcattttttaattgggatattagggttttttttgcaatcaagttgcaggagttccttatatattttggagattaacccctgttaaatatatggtttgcaaatatttctccccattttgtaggctgccttttcattctactgattgtctcctttgctgtgcagaactttttagtttgatgtatcccacttgtttatttttgggttttttttttttttttttggctgtgcttttggtgtaatatccatgaaatcattgccaagatcgatgttaggaagcttttcccctatgatttcttctaggagttttatgacacatttatatgtgtcatctttaatttcttttggcaacaatttgtagttttcagtgcacaggtcttttgcctccttttttaagtttaacacttcactttgtaattcattttgagttggtttttgtatatggtgtaaggtagggctccagcttctctctctttcatggatatccagttttcccagctccatttatcaaaaagactgttccttccttattgattggtcttgttggcatccttgccaaaacccatttgactatatatgtcaaggttttatttctggactccctctctcttttcttttttttttttttttccagagatggggtctcactatattgcccaggctggtcttgaattcctggactcaagcagtcctctcacctcccaaggtgctgagattaccagtgtgagccaccatgcccagccttatttctggactctctattctgttctcttgatctatatgtctgtctttatgccagtaccacaccgtattggttactgcagcattgtagtacattttgaaatctggaagtgtgcgaccttcacctttgtttttctttttcaaaattgttttggctatttagggtcccttgagattccataatattttaggatagatttttctatttctgtaaaagatgccatcaggatttgacagggattacaatgaatctgtagatcatgttgggtagtattgacatcttaacaatattaagtcttccggtccataaagctgggatgtcttccatttatatgtgtcatctttaatttttattttttattttattttgagatggagtctcgctctgtcgcccagactggagtgcagtggtgtgatcttggctcactgcaagctccgcctcctgggttcacaccattctcctgcctcagcctcccgagtagctgggactacaggcacccgccaccacgtccagctgattttttgtacttttttagtagagacggggtttcactgtgttagccaggatggtctcgatctcctgacctcgtgatccgcccaccttagcctcccaaagtgctgggattacaggtgtgagccaccgcgcctggccaatctttaatttttttttgcaacaatttatagttttcagtgcacaggacttttgcctcctttttaagtttatttcttcttaagtttttaggaatactatataaacattcctaagtatattcattttttgatgctgttgtaaattgaattttttgtttattcattgttagtatgtagaaacacggttgatttttgtgtgcttatcttatacctgcaactaaatgtgtttattaattctaactttcttgcataatctttagcattttctacatataagattatgttgtataccaacagaaataattttattggctgggcgcagtggctcatgcctgtaatcccagcactttgggaggccaaggtgggcggatcacaaggtcaagaattcaagaccagcctggccaatatggtgaaaccccctctctactaaaaatacaaaaaaattagccaggcgtggtggcacatgcctgtaattccagctacttgggaggctgaagcaggagaattgcttgaacccgggaggcggaagttgcagtgagccaagattgtgccactgcactccagcctgggtgacagagtgagactccatctcaataaaaaaataataataataattttatttctcctttccaatttagatgtcttttatttcattttgttgcctaagtgcactggctaggactctcagtgctatgttgtataggagtggtgagcgtgggcatttttgccttgttcgtgatcttggaggaaaagctttcagtctttcaccattaagtgcgatgttaactgtgcatttttaatatatggcctttaatatatggcctttttttttttttttttgagacagagtctcgctctgtcgtccaggctggagtactgtggtgtgatctcggctcactgcaagctccgcctccaggttcatgccattctcctgcctcagcctcccgagtagctgggactacaggcgcccgccaccacgcccggctaatttttttttttttttttttgtatttttagtaaagatgggatttcactgtgttagccaggatggtctcgatctcctgaccttgtgatccgcccgcctcggcctcccaaagtgctgagattacaggcgtgagccactgcgcctggcccaatatatggcattttaatatatgacctttatatatgttgaggttgttttcttctattttgtttgttgagtatttctcatgaagtggtgtttaactgtgccaaatgctttttctgctttaactgagatgatcacgtagtttttttttatctcctttcatcgtgttaatgtggtatattacattgatagatttttgaatgttgaaccatccttacattccaggaataaatcccacttgatcatggtgtaatctctcttttaatagttgaatatgattcgcaagtattttgttgagtatctttgcatcagtatgtcagaggcattcaaaccagagtgactttatcttgaataggggctgggtaaaatgaggctgagacctgctgggccacattctcaagaggttaggtattcttagccctaagacgtttatagttaagggaacagaaacagacccaggatataacagacccaggaactgtcctgatgtccttatatcttaagaacaaaaacattcctagttttaaaataagtctcactttaaagataataatatatgcacagtgagaacacgtggacactgggaggggaacatcacacaccggggcctgttcgggggtggggggctaggggagggatagcattaggagaaatatttaatgtagatgatgggttgatgggtgcagcaaaccatcatggcatgtgtatacctatgtaactaacctacatgttctgcacgtgtatcccagaacttaaagtataaaaaaaaaaatagataataataaaggctctcatgaaagacagtagttacacaaagattagcaatcctttatcacaaacccttgtagtagagcacatctcctccatgatttttgttatatataagcaagcattgtacctaggtgggcacgttcctcctcttattttttggaatgccatgctctgcctatggaatagctattctttcacttctttactttatttatttatttatttatttattttgagacggagtctcgctctgtcgcccaggctggagtgcagtggcgcgatcttggctcactgcaagctctgcctcctgggttcacaccattctcctgcctcagcctccctagtagctgggactacaggtgcctgccaccacacctggctaagtttttgtatttttaatagagatggggtttcaccatgttgggcaggctggtctcgaactcctgacctcacgtgtccacccgcctcggccttccaaagtgctgggatgacaggcgtgagccactgcgcccagcctgtgtggaggttttaaattactgttcagtctccttagaagttacatctattcaggtcttctgtttcttcatgatccaggcttgccaggttgtgtttctaggaatttttctatttcatctagtttattcaatttgttgtcatacagttgttcatagtactctctgatagtcctttctgtcaaatcagtagtaatgtgtcccctttttcatttctgattgtagtaatttgaggtttttttttctttttttctttttctttcttttgtttgtttgtttatttatttattttgagacagagtctcactctgttgcctaggctggagtgcagtggtgtgatctcggctcactgcaacctccacctcctgggttcaagcgattctcatacctcagccacccaagtagctgggattacaggcgtgtgccaccaagcctggcaaatttttgtatttttagtagagacagggtttctctatgttggccaggctggtcttgaatgcctgacctcaggtgatccaccccaaagcactgggattataggcgtgagccaacgtgcctggccataatttgagtttttaacttagtctgtttagctaatgaacatattttaaaaattcttttggatctatatgtaggagggaattgccatttggatcaatagtaatgctacgtttaacatattgaggaactgccggactctcccaaagtgcctggactgcacattttacattaccaccatcagtgtatgaaggttccaatttctccatattcctgccaacacttactgttgtttatcttttgttttttgagatggagtctcgctctgtctcccaggctggagtgcagtgacgtgatcttggctcactgcaacctccgcctcccaggttcaaatgattcttttgtctcagcctcctaagtaactgggactacaggcgtgtgccaccacacctggctaacttttgtatttttattagagacagggtttcactatgtcggccaggctgtctcaaactcctgacctcaggtgatccacccacctcagcctcccaaagtgctgggatcacagacgtgagccaccgtgcccagccttgttcatgtttttaattctgagcattctagcatgtgtgaagtggtatctcattttggttttgattagtgttgccctaatgactagtaatgttgagcatcttttcatatgcttagtggccatttgtacatcttctttggaaaaacatctattcaaatcttttgcctattttaagattgggttatttgctcttttatttttgagtgctatgagttctttatgtattctggatactagtcctttatcagatatatgatttgcaaatattttccatttgtgggttactttttctttttctttttttttttgagataaagtcttgttctttctcccaggctggcgtgcagtgtcacaattattgcacgctgcattctcgacctcccaagctcaaatgatccttccacctcagccccccaagtatctgggaccacaggtgtgtgccaccataccccgctaatgaaaatttttttcctttttttttttttgtaaatatgaggtctccctatgttgcccaggctggtctcaaactcctgggctcaagtgatcctcccatctcagcctcccagaatgctgagattacaggcgtgagccattgtacccagcctttactttcttgatactgtcctttgatgcacaaatatgttcaatgttgatgaagtccagggtatctattttttctttggttgcttgtgcttttggtgtcatttttgtccatctggtcttttactaacccccatataccctttgacacatatttagaggtcctcaaaatttttatttaaagatgggaggatatggaaatatttttttaaaaaactcattgaaacagactgcagtacggtctttaataatgaagatccccaaagcttctgtgtgaatactcagggcttctcaaaccatctcttggtaaaggctgatgaggatgatcatacatcctaccaaagcccctcactctttggtttgaggcaagataaaaaggaacactggtgatgaaatttaggataacaaggagcataaaagaggcagtacttctgccagtttgcccccaagtttctctaccaacatcttacagtgccttttgttaaggggaggacagatgtggtcccagggtccaggcctcttgctcttataaattcccattgagcagtagttctcaaagtgtgaccaggggtccagcaacagcagcagcatctgagcacttgttggaaaccagattcttggaccttgcttcagacccactgaatcagaagctctggagtgggacccagtgatctgttttaacaagcactctgctgaacgttcaagttggagagccgttggtgtagcattttcagctggtacaacctggagtctgccacctggagagtgtggttactcatcatctcctgccaagcgtgggatcaggtacttttggtaacaagtgacagcaaaccttaaactaacctactaaacagcgcagaaattaattcgtttgcatattctgcctaaaaagtcagtagggagcaggcttgttctccgttttcctgtgattctctctgtcttcctctgtgtattagctttgtcttcacacccacttctctcgtggttgcaacatggtttcctgcaaccatcagagttgtgtgcttcctaattagctccagagtgagacgacgtggcattccacaccatcaagcacaactcaccagcttagctctgatgacaccagccctgagtcagggcacgaggcagaaaattttcctgactggcttagcaccctgcttctacccctcccttgcaggggatgagtaagtcctacccagttctcatggctatttcacaaaggggaaggaagacatggtgtatgtggagggggaggtagccatggtgcccaggacatcaggactcatgaaatggcctcttcgctgtttgtccccaacccactgttttttccttaataatgcatctagagggatctttccaaagcaaaagcctgtctacaacacctcttgcttaaaccctttggtgtatctccccagacacacacgcacacacgcacacacagctctccagattaggttcatactttgagatgttcaagttctagttctaattgacctccagcctgctggattcccatcctttggaaccccatggaatgctccgccattacccgcttccacgcttttccctgctgccccacctctgcttctgtgttctgccaggaatgcctttacccttccccacgtggtaaattcacccttcaaaactcagcctggatatctgcttcctctgggatagctctaaggcaggttaatgaccgtgtccacaggcttctgggttacatagtcaccgtgtgcctgcaccactcatttctatatctccctcagctggtgatcttggggcagggacctgtttgattctccctgggtcctcagtccccaggcttgccatgcactaggagctcagatagtgtttgttgatcacatactacttttgtgtcccctactgttgcctagcaaagtagggcccctggtagacactcagtttataatgatcaatgcattaaactgaccacaaatctcagttcttcaggtcctaggaaaaccgtgagccacctgcaaatataggctgcttatgcccttgacaggttcagggaatccgtccttttagcactggggcggtttcactttggacttgatcagggcttagaggcctttagctttccgatcctgaggagcctccctttatccaggaagcaggggactggaccactgggaccttcatcacgggtgggcacggattccccatcccaatcagaagaatagctgtatctgtagcagtaggttattctaggccagttctttccattaaaaaaaaactaaagcccctaggttgaattaaaaaaattaaaaatttaaaagtcatgtttatttctaatatacagtttgataatacatatttattgaatataatacataaaagtacaaactacctgtaatcctcctatgggttttgtgcttccagtcttttttctaagcatgcatatgtagtaatttcctaaagcattgagattattattttattcatatttattaccatcgtctcagtgcattttatgctgctataacagaatacctgacactgggtaatttgtaaacaatagaaatttatctagctcatggctctggaggctgggaagtccaaggttgagggccctgcatctggcgagggccttcttgccatcgtggaaggtggaaagagcaagagggcatgcaggagagagccagcaactgaactcacagcctctagcccttttataatcagcactaattcattcatgagggtggagccctcatggtctaaacacctcccattactgttggtcccacctcccaacactgttacattggggattaagtttccaacacatgccttttgggagatacattcaactattattttatctgttactgttgagactattgttttattaattaaaccccatgtatttctgcaaaaagccctgacaagtttataataccaatcccctgtagccctcctgccactgataagctgaaggtaaaaatgttaagacccagatactaaaaaaagcaagtaaggcctgggagtcaaaccaaagctgaggaacttaacccagagcttcccagcagccaaggcaaaaaaataaataaataaaagggaagctcaaggggttgtggagctcttgaactaaagaagaggaagcaagccaggttgtcagaatgcacgagctttcctggtgctgacctctggagagggcacagggacgttgtataagagtgttgtgtaagggacagtttcactgaaagatgcaggaactgcctgggtttggtcacttctcatactgactcttaagaatagctgatgacaggccaggcgcgggggctcacgcctgtaatcccagcactttgggaggctgaggcaggcagatcgcgaggtcaggagatcgagaccatcctggctaacacggtgaaaccctgcctctaccaaaaaatacaaaaaattagccggatgtggtggcgggcgcctgtagtcccagctactcgggaggctgaggcaggagaatggcgtgaacctgggaggcggagcttgcagtgagccaagatcgcgccactgcactccagcctgggcaacagagtgagactctgtcaaaaaaaaaaaaaaaaaaaaacagctgatggcatgtccataacttttagttctcaaaaataaataaatacataaagaaattgtagttctgggaagacatttctttgttttgttttgttttccctaggaatcagactgagaggaaggcatatttttgtaggaatcctaagtgacgtgatctaagcatgaaacttactggtgatttcatttggtagagatttaacaaacacatattaactgtgtggcttttgtgctgttctttcatgtaaggaatctcatttaactttctcaatgaagttggaggcaagagatgattaggccattttacagatggggaaatggaggctcagggagattgacttatccagggtcatgtagtcaattaagtggcacaccaggactcgaccccaggtttacaatcttttcctctgtgttggcaccttgttggagaagcgggaagtgtctgaccttgttacatatccacggtgtattaggactgggtttttcggttttttttttttttggagacagagtcttgctctgtcacccagactggaatgccgtggtgtgatctccgctcactgcagcctccgcctcctgggttcaagtgattctcctgcctccgcctcccaagtagctgggattacaggtgcccgccaccacacctggctactttttgtatttttagtggagacggggttttgccattttggccaggctggtctcgaactcctgacctcaggtgatctgcctgcctcatcttcccaatatgctgggattacaagagtgagtcactgcccccagcctaggactaggtctttataagtaccacctcatctgttccttacagtaaatcctagagccacgtaatattagcccattttacggagaggattggcggttgtccaaggccatacagatggtaggtgttagggaggctaaccaggggttcccagccagggtttggtgatggaacttcaggatgtggaaggattcaatagaatggcacaggaacatttctgggtgagaggggagaggatggctttcacagagcctcaaaaaacccaaacaaaaataaatgagaaaaacagacccatgaactcaaggaaagaatcatagtgacagctcacataactgagtcccgacctggggccaggcacgtgtcaaggcctggatgagcttatcattcccatgagggttagggtgtatcatccccatctcacaggtcgcccagctagtaagtggccttgcatggtcactgagttttgctgcttttccatcatcacctcttgtggcttgttttttttctagcagttagtagaatttttcttcctctttcgtggagctgagaattactacaaggcagaatgatatgctgtgcttcaaaaggtcattgcctgtttccaagtcacctctgtctgttcccttgccactgggaacaagctggttaggtggtggttgggtaagagggaacaaatgaatggacgaatgaatgaatgaacaagtggatggaggaagtacctcttccttggcgttcgggatcagcatgcatggatccatttctgatgacttttattcaagggtgacaggtcactgtagtgttagagagaagtcttggggaagctgaggtcaggcccgttgttgatgaccaggcaggaccagagtgacccagaaggcctccttcctcctcagcagggagtggtgtggaagtgggccgtgccgccttccacagctctctgccgtggcacacagccctccaaggcaagtggcaagcctggcagggcctggaatggttgctacccctggaacctagtatctctagtatccctggcccacgttaaagtcccctgttttatctgctgtggtttcgtgcatcccagcccggcttatacccctagtgtagcccagccatggggtcccagttcagagcaacagcatcagcagccccattttacagctgaggacacagtctcagaggacggaagtgacctgtccaaggccacactagtgagcggtggacctgggccatgagcccagccgtgactggctccaaagccacgcatcaccacatcctcataggacccacatgacctcagggtcatatttacattgccaggaggctcctggaaggtaagccacaaactggaggcttcatcaaattcctgaggctgctccaccctcctctggctggagagctgtctctggtccagctagaccatggttgagagtttctttcctgtttagagacagcgtgggtcttcttgactgccccactctccagggcctctgctgagctgggttgaaggaacttcacaacaagcaggggccaggagctggaagctaagaggtgattctgcctgtcctgaagtttgtgacgccatccctcttcctcaaccacctgtagccctactttaagaaaaaagaggtcaggcagggtggctcacgcctgtaatcccagcactttgggaggccagggcgggtggatcacctgaggtcagatgtttgagaccagcctggccaacatggtgaaaccccatctctactaaaaacacaaacattagccaggtgtggtggcaggtgcctttaatcccagctactcaggaggctgaggcaggagaatcacttgaaccccagagatggagccaagattgtgccattgcacgctagcctgggtgacaagagcgagagtctgtctaaaaaaaaaaaaaaaaaggaaagaagaaagaaaagaaaaagcatctatgcaaagagcccggagtgggccagaaagagtgagaatgggagtgaaccagggctggaagaacctttcttttttttttttttttttttttgagacggagtctccctctattgctctattgcccaggctggagtgcagcgggtggatcacgaggtcaggaaggacctttctactgtaatcgtcctttctgcccctccactaggctgggagccccttgagggcctagacctggttgttctcccggggcctgcagcctgtcagtgtggagtaggtgtatgatgaatgaatgaatgacctgagggtttggagctctgcttccagtccaggaacaatctctgtggccttggtcagttacatccccttttttggcctcagtttctccatctgagctgatcttcaaggccctgatgttctgagccagcaaggtccagggttctggaagatggagagagcctgagacaggtgctgggattctgagaggacttggccagcttggccgggggaaggcatcctgaggttcttggctgtggagcataggaaacagggcagctggcaggtgggcaccaggcgcataggcgggagcgaggagggagggtgtgggcttggctgaagaggctgtttgctgaagcttcaggtcttcgtagcaacttagttttccttcttcagaaaatgaagcagccaagaagctcctctgggtgtcagagcctccagtgaggtttgaggcccactgggggagggggacgggctcccaaggcaggaggaggaagggctggagagcaggggcacccaggcattgggcatgggtggaccctgcccaatgggcctgtggggttcccgtctcgatggctgggcagccccactcattgtcactttgccctgtgttttctgcagatcatgattgagttctgtccagggggagccgtggacgccatcatgctgggtgagtcttacttgattcggtgcattgtcgggaccagacgactcgtttggagtcctaagcctgactgctggacagctctgtctaggactgggacctccactctcccattccatcagttcccatggcctctttgagcacctctctactatgtctgcttttgggagcagggtgtgggttctttttttctttctttctctttttgagacagagtcttgctctgttgcccaggctggaatgcagtggtgcgatctcagctcactcactgcagcctccgcctcccgggttcaaatgactctcctgcctcagcctcctgagtagcctgggattacaggtccgtgccaccacgcacggcttgtttttgtatttttagtagagatggaggggttgggttcttgaagagaacgcaggacattcgctggaagaccatcactccctgttccagaagccgtgtgtccttgaactggccactctccctcttgaggcctcttgatctaagatgggtatgatgccttctttgcgggaccccacacactctcaggaggtaaaaccgagatacccgaggaaggtctttgaaaagtggggatacccacacattcagtaaatgctctgtggggacggtgtcaggtctcaatgtcctgggcaagcttgagcaataatgacgacgatgatcacagtgaaatgttagtagtggccattcctttgtgaatagtcactatatgccagagagtgtggtaaccacgttcccatatgcggtcctcctctaatcctcaggtataaaatcaggaagagtattttatttatttatttttgagatggagtctcactctgttgcccaggctggagtgcagtggcgcaatctcagcttactgtaacctccacctcccgggttcaggtgattcttctgccccagcctcccgagtagctgggactacaggtgcccacgaccacgcccggctaatttttgtatgttagtagtgatggggtttcaccatgttggccaggctggtctcgaactcctgaccttgggtgatccacctgcctctgcctcccaaagcgctgggattacaggcaaatatcacttttatttttgattgggctgacacttgaaaggttaagggactcacccagatcacacaggagagctgtgaacccaggtctgggtgacccgctcctaaccatggaccatggcccatcctgcagcatccccggctcatgctacccttcagggcagtgagtgcagagaggctgaggagaggcctggaaggttgagtgacatgtccaggattctgggatggcccagaagaggagaggcacttaggataatgtcacaccattcaaggtattttccctgagtttacctcaggagggagccaactgtagtcctgacatagccttgaatgccataaacctgaatgttgaaatccaaaaagagcaaaatgcctaaagtctcaaatcctgtcaagtacaatcccgaaagatcaaaatcccaaaaatataatgctaaaatttttttaaaaattcttgatatttacttatattttaaaggggaatttgagaaatataaaaacttcaaggcgcttcataggccactttacacaatcaaataggcagtagtaacatacatactttgcaagcataaacagctataccaaagatggtggtacagctgtaacaattatgagcagattggctgggtgtggtggctcacgcctgtagtcccagcactttgggaggccgaggtgggcggatcacctgaggccatgagtttgaaaccagcctggccaacatggcaaaaacccatctctacaaaatatatgaaaattagctgggcgtgatggcaggcgcctgtaatcccagctacttgggaggctgaggcaggagaatcacttgaacccaggcggtagaggttgcagtgagccaaggtgatgccactgcactccagcctgggcgacagagtgagactccatctcaaaaaaaaaaaaatgaaaaaaagtcatgagcagatgacttgtacccataaagaggtaggtcaaaaagggagatgtataagtgcatatcaccaggattggtgattgtgtacacacagctttatagctgttgtctgaaatactgtaatgaacaaccaaagcctgttgacgagattgatcaaaaccctcagtgggtcactagggcatatgcagatgccgaaagagccaggatctggagaaagtttatcttccacaaatgcggatgtaccaaaaggacatccctatgtttactgaggaactttcagcatttttccatacatgcacaatgcttacacaccagcaatgctgagataatacactttcagggagtcaaatttgcaacaaacgcataaaaggaattagaactctctcaaagtctctataccatttatacctccagtattgaaaatgatgtgaagatgaaatacatagcatagtgaattgcaaaaagtaatgctatttaaaatagtgggggaaaaatatatatatatactaaagaccatttagttttttcaaatttaacatatgaccaagtgtattacagggagagattatgggcagttgcacagagaccgttcataagagttgacctcacaggatacaactatcctgtgattgagatttttaggattttagactttagggattttgatctttggggatttcaatatttgggattatggtatttgagatggtctcttttaggattatgatccaaacccatctcaggaatgtgtgaaatttacagtagtccatccccatcccgggctgtagaaatgtaggacccacaagccttcgttacagagccacttactgccccatggagttcccaggtagatgacagtagcggggaggatacatggcacatgttatatggctcttgggtgtgccttctctcagcaggcactgcctttgaagattatcatttggggggatagaatctaacagtataaaagtgatagtctggtatgaattgagactttaggttatgaggagccagaatactcaaacttttttaggtgggggaaaggtctgggatgtgggaggtggaatttatttgcacaaataactgaagacttcagggatggctagcttcaggcacagcttgttccaggagttttaaagagttatgataagagatggagtgcagcggctcaagcctgtaatcccagccctttgggaggccgaggcaggtggatcactttgagctcaggagtttgagaccagcctgggcaacagggcaaaaccccgtctctacaaaaagtacaaaagttagctgggcgttagtggtttgcacctgtaatcccagctacttgggaggctgaggctggaggattgcttgagcccaggaagaagaggttgcattgagctaagatcatgccagtgcactcagcccaggtgacagagtgagaccctgtctcaaaaaaataaaataataaagagttgtgatatggacttgatttctttctccaactcttggccccactgtcctctgtgttagccccattctcatgctggttttctgcatgcatcttgacaacaagatggtgtgggagctccagccatcacatctgaattccaagcagcagggtagacaacagggtagaataaccacccatcccacactgaagactcttttaaagagacttcagaaaagctccacatggcaccttgatttatgtctcattggctgtagcatatcacacacagctggaatggaggctggggaatgtggttttctagctgggtagccatatgtgctgatactaaaaaaagaaggggaaaatggaagccagctagcaccccctctgtgtcccctggtatgcagcttaactgaatgagcttagctggaggggagcatcagagatggaaaggcatggaagtgtactgtgtcctcgacctcattcacagctagggcgtgccctaggctacagctcagccagcagacaaacccttctctggctcccgtcccagttctcctcgtggtcctgactgctccagccctaggcagttttccccctgttggtggcagcagtgaaaggagcattttgggaatgatgatgtgcaaagagaagctgaaatggggacagctgacaagttcagagccaggtcctcgttgcagctctctgtttagtgttgaccttcctgcagatgcctgccctgcttagaggggtttctgcccctccatccatctccactttgccccgcatggctgggaagcattactggcctgagcttggggcccaggggtccattccctgaggtccattccaggtttctctttttggaggctttggggcacaggactggcccttttgtgagatggagagaatacccacgtggtatgtcactgtggggccattctatgtaacatccagggcctgttctgattggaatagatatggttggccatgccttgctggctattaaacatcttgggtcttggccgggcgcggtggctcacgcctgtaatcccagcactttgggaggccgaggcgggtggatcatgaggtcaggagatcgagaccatcctggctaacatggtgaaacctcgtctctactgaaaatacaaaaaattagccgagcatggtggcgggcgcctgtagtcccagctacttgggaggctgaggcaggagaatggcgtgaacctgggaggcggagcttgcagtgagcctagatcgtgccactgcactccagcctgggcgacagagcgagactccatctcaaaacaaaacaaaacaaataaacaaacatcttgggtctccaccctcttatcgtggaaaggatgagaggctagaattagatgtggtgtcaacggggactttgcaatgttgtagtttttttaataaggagaaggtattcatgcattgctgtgtaattgaaaactatttctaaaaatgtattggactcaaaaggctgcatattgtatgattccaattatatgacactttagaaaaaggcaagactataggcacagaaaacaaattagtgattacacagggactggaaacgggaagagtttactgcaaaggtcacaggggaatcttggaggatggtggatggattttgtatctaaattgtgatgggggttccatgactgaatatgtttatcaaaatttataaaactgtataccttaaaaaagtgaattttttatatatgtaaattatacctcaataatcctgactttaaaaagtgtatcaggccgggcatggttggtcacacctgtgatcccagcacttaggaaggctgcggcgggtggatcacaaggtcaggagttgaagaccagcctggccaagatggtgaaagcccatctctactaaaaatacaaaaattagccaggtacagtggcaggtgcccataatcccagccactcgggaggctgagaggcaggagaatcgcttgaacccaggtggcagaggttgcagtgagccaagatcacgccactgcattccagcctgggtgacagagacgtcgtctaaaaaaaaaaaaaaagtatattagctaggcatagtggcccatgcctgtaatcccaacactttgggaaaccaaggtaggagattgcttgcagctaggagtccaagattaccagcttggacaacgtagtaagactctgtctccacaaaacaaaaaattatttatttatttatttatttagagacagagttttgctcttgttccccaggctggagtgcaaccacacccggctaattttgtatttttagtagagacggggtttctccatgttgaccaggctggtcttgaactcctaacctcaggtgatctgcccacctccacctcccaaagtgctgggattacaggcgtgagccaccgcgccctgccaaaaattttttttataaactagctgagtgtggtggcacacaccggtggttccagctactcaggaggctgaggtgggaagattgcatgagcctgggagatcgaggctgcagtgggccgtgatccactgccctccagcctgagcaacagagtgggaccctgtctaaaacaaacaaacaaaaacaaacaaaaaattaggctgggcgcagtggctcatgcatataatcccagcactttgggaggccgaggcgggtggatcacctgaggtcaggagttcaagatcagcttggccaacatggtgaaaccccgtctctactaatagtacaaaaaaattagccgggcgtcgtggcacatgcctgtcatcccagctactcgggaggctgaggcaggagaattgcttgaacctaggaggtggaggttgcagtgagccgagaccacaccattgcactccagcctgggcaagagagcaagactccatctcaaaaaaaaaaaaaaggaaagaaacccaacaacaacaacaaaaaacaaaattaaagagtatctccttcccacctcactgggttactgcgaggattaaatgacagtatgcaccgtgtccttatcctcatgcctgacacattataagggctccaaaaatggtggtgattagatcataattatcttcatcatcatcattagtatttttgtcattcctatttcatttatatcagtaaattagacatgagcaagacacatttttgccattaaaaagattgcggcacatattccagccctggactcatcttagaaccaacatagcaataatccccctttattgcctattttccacactgagaactgaacatggctgatggctggagccctgcctatgtcgattataatcatcccatttcacagaccaggaaatgaagggccagagagcttgggcgacttgccagtaaccacacagctagtgagaggcagcacctgggtacggcctcggtctgtgtggtcctgaagcccatgcaggctctgatcctggcccctggctggagacacagaggttcaggatgaggccacagggacagggggcaggcagcttgcggactccagagagaagggtccctggtccaggagccctggtctggggcctggcttcccagagcagggcagttggtacctgcattcctggttggcatgtctattataccactcctgagggcctggctgggagagctgagccttgtggattcctgtccaggcaccactaggcaagccggacacagcagtgctgttgtaggcagagggaagactcggagcagtgccctttggtgaccaggcttagaagccgacagcctgggaacctggcaggccaagggaggtggctcccctggtcacaggggtcttgggtagctacgttgactcaatcaggacagtcctgtgggacgcagagcacaaggctgtcaccttggaatcttctcactcccctcctcccaccgcctccacattccgccagctccacctccctaatctgtccattgagcagctttcctcctctctgctttggtgcctatctggaccactgtgatgacctccagctgagcccctgcccctgctgcccagcaagctctttgctgtgctagagggaattatttgtttattttattttgtttattatttatttatttattttttgagacggagtctcgctctgtcgcccaggctggagtgcagtggcgggatctccgctcactgcaagctccgcctcctgggttcacgccattctcctgcctcagcctcccaagtagctgggactacaggcgcccgccacaacgcccggctaatttttttgtatttttagtagagatggggtttcaccgtgttagccaggatggtctcgatctcctgacctcgtgatcctcccacctcggcctcccaaaatgctgggattacaggcgtgagccaccgcgcctggcctattttgtttataatataataaatgctacaagcatagctgggtctcgctatgtggcccaggctggccttgaactcctggcctcaagtgattctccaacctttgcatcctaagtagctggcactacaggcattgagccactgctctcagccatgggaatttttttttaatgcaaaaatcagactgtgtctggcccactcagaacttctcgtggactacccactgcatttcaaatacaatgcagcctccacagcgtggcccgaaggtcctgcagagccaaggcctgctgacctctgacctcgagtcactttcccttcatttgccccctcccaccacacaagtctgttcccctttccaggaatattcttcctgctgcccaccttcccgctccctgcctgctcagacctactcaacctgtgaacctcagggaagaagggccctggccatctctcggtggacactgagtgatctgcagcgtgcgcacgtgggcgctgtgtctccccataaagaacaaaaggctcttggcaaccagccctccggcctctctggcccttccgcatccgcataccctggtgccaccaccaacagccagtggaaagtttaataggcaaaaaagaagagagagagaaaaagcttcctcatgctgagaaaatgggtcaccgaagagagggtctcctcagtggacactttttttttttttttttttgagactgagtctcgctctgtcacccaggctggagtgcagtggcgcgatctcggctcactgcaacctctgcctcctggggtcaagcgattctcctgcctcagcctcctgagtagctgtgatcacatgcgtgcaccaccacgcccagctagtttttgtatttttagtagagacaaggtttcatcatgttggccaggatggtcttgaactcctgacctcgtgatcccccccgcctctgcttcccaaagtgctgggattacaggcatgagccactgcgtctggccccagtggacattttggagacaccagctcatgtcagctgttgcctctgctggctccttgacctagagtgccctcgccccacctattctcttcctttaagacatagcccaaatgtcatttcctctgggcagccttccagttcccccagctataaggggttcctgcccattctgacatcccacatgcctgcacctcactctgttccaagtgtcactcaccgtttccatgtcccatctgccttcctgctccaagcacagagccagacacatagtaagtgccctctcagtgtctgcagacacaacagatctctctgtctcagtcgggcttatgtttacaaacctgaactctaaagccagaccctggtttgaatctcagatctgtgtcttcccacctgcatgaccttgagcgagtggcttaacctttccaagcctcaatttcctcatctgtaaaatggggacaataattgtgcctgcttcataggactgttatgaagacaaaatgggtcagtgcacatgatgtgcttagaaatgaatccagtacacggtgagcactccttaatattggtggctttttttttttttttttttttgagatggagtatcactgtcgcacaggctggagtgcagtggtacgatctcagctcactgcaacctctgctgcccaggttcaagcaattctcctgcctcaacctcctgagtagctgggattacagctgcctgccaccgtgcccagctaatttttgtatttttagtagaggtgggatttcaacatcttggctaggctggccttgaacccctgacctcgtaatccacctgcctcggcctctcaaagtgctgggattacaggcgtgagccaccacgcctggcctaatgttggtggcttttatatttctccctggcgtgggcctgacatttcagtttcctgtgtccagggcttactgaattgacagccgttctcctccatttccagagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctgggtaaggggctcagggtgggaaaggtggagccacagggtgtctgcctgggggtgttggcctggcctctgcaggccagtgggagtgtggacctcatgggggtgtggggtcctcacgcctacgccctcttggcatgtcagcagttctccccttcctactcttgattctttgctttttttcaattattttattttattttatttttttgaggcagtcttgctctgtcacccaggctggagtgcagtggtgcgttcttggctcactgcaacctccacctcccaggttcaagtgcttcttgtgtttcagcctcccaagtagctgggatcacaggcacctgccaccatgcctggctactttttgtacttttagtagagatgaggtttcaccatgttggccaagctggtctcgaactcctcatctcaagtgatctgcccgccttggcctcccaaaatgctgggattacaggtgtgcaccactgtgcctggccagcttctttctaatcaagagaattcgaatgagagtgatggatggagggatgacccagctccatccccagagggaaaacagtaggacattaagcacatatatcaaaaccttctttttttgttgttgtttttggacagagtctcactctgttatccaggctggagtgcagtggcgaaatctcggctcactgcaacctccacctcctcagttcaagtgattctcctgcctcagcctcctgagttgctgggactataggcacccaccaccacacctggctaatttttgtatttttagtagagaccgggtttcaccatgttggccaggctggtctcgagttcctgaccacaagtgaaccacccgcctcggcctcccaaagtgctgggattacaggtgtgaaccaccccgcccggctcaaaaccttcttctttaaatgtctcctctttgtatttttaatgtttttatttttttaaccaaaataacacatacatgtgtcatcccctcacgtgtctccttttgccatccacctgcagagacaagcgctttgagctcttctcatgtgtacttctgcatcgccaaatgatatggctacaatgcattttttaaagtaatgattttcggccaggcatggtggctcacgcctgtaatcccagcactttgggaggccgaggtgggtggatcacctgaggtcaggagttcaggaccagcctggccaacatggcgaaaccccaatctctactaaaaatacaaaaattagccgggcgtggtggcacacgcctgtattcccagctactcaggaggctgagacaggagaatcgcttgaacccaggaggcagagtttgcagtgagctgagattgcaccactgtactccggtctgggcaacagagtaagaccctgtttcacgaaaacaaaaacaaaaacaaaaacaaaaaaacaaacaacacatagttggtgctcaataaacagtcacttccagcatgaccaccactttagcctatggttagttacttcagcatccccaactcccaacccccatgccccgcccaatgtgctggagacttggcaggtggaccagtcaggaagccaactgcccatctctcactgctgccttcacccagcccagcattgctatttcctgctaccagcaggctgggggcctggttctttcactagagctaccatgcactgagccagcatctgatatgtgttaactcattccattctcaaaagccactgatatcatcttgcaggatggatttgggacctagcaagactgacttatccaaggtcacattgccgataagaggaacaactggggttcaaaccaaggcagctgggtccagagcctacgtgcttaaccactaccctcttgtcgcctctcttagtggcaaatgataaaaacccacttcctaagagttaaggcagacaggaaaatgtgtacatcatggagccaaattggagaagaaatacagctgggtgggccttaaagttagttgaaacctggaacataaacgctgccaggaccgtatccctggcccttaacgctgccaggaccgtatccctggcccttggctttctgtgcatgtaggttcggctcccagaccaaccctctccaccaagctcaggataccatctagtttcacatttcccggcatcatctgctgctgcctgaacccgaactcaccattggaggctttggcatcaataatcccaggggagggctctgactggccccgtttggcccagatagtaatccttggaccaatcagtgaggcccaggcaggagggggtctcccacaggcccggcttgtcttcagtctctggcacggagggtggggtcacgtgacaacacggaagtagccctcgcccccgcaatgaggcagtgtggtgggtggggagatggtttttcagaggaagggaggattcggactggccagaaaaaaaaattgcggtctacctaccctgcccagcctgtgagaatcacacaggcccagcagaggggaagtaagtgaggcagaagcttgagggatgggaagcaacaagaaagggctgggttggcggtgagtgcgtggagggtgtcaggaagacagtgcagtgtgttgcgaggaggagagtcagtgaaggccgaaggtggggggtcaaaccggaagacgaagcccttatcaaatgggcacgcgtctctaggttcctaaaaaacggaagaaaataaaaataaccggccgggtgcggtggctcacgcctgtaatcccagcactttgggaggccgaggcgggcggatcacgaggtcaggagatcaagaccatcctggctaacacggtgaaatcccatctctactaaaaatacaaaaaaattagccaggcatggtggcgggcgcctgtagtcccagctactcgggaggctgaggtaggagaatggcgtgaatccgggaggcggagcttgcagtgagccgagattgcgccactgcactccagcctgggcgacagagtgagactccgtctcaaaaaaaaaaaaaaaaaaaaaaaaatatatatatatatatatatatatatatataattttaatatacataaatttggagctatacacagcaaacccgtaaatgtttagttgtcagtattatagtttttaatctgaaaaataatgagtttttaataagcaacatgactttggtaatcagaaaacacacacacacacacacacacacacacacacacgagagtagctagagtcctgtacacaatttggaataagacccacaaaaaggagaattaaggtccttcctaatcctgccagaataaaccaccactctccgtgggcttccctccaagtctttttttgtctgcagaaaagtcggatcagatagtgggaaagagcacagctgggtgaccttctgtgcattacttagtctttcttaagttaagcttccttatctgtaaaatgggagtcataattttccctgccttaaagggtcatagatataaacgatgtgtgtaggaatagatatgcagatgatatgcataagtttctttgcacagtgctatgcatatggtaagttctcagtaaatattagtttttcttttttttttttttgagatggagttttgcttttgttgcccaggctggagtgcaatggcacgatcttagctctccacaaccgctgcctcctgggttcaagcgattctcttgcatcagcctcctgagcagctgggattacaggcatgtgccaccacgcctggctaatttcgtatttttagtagagaggggatttttccatgttggtttttgtctcgaactcctgacctcaggtgatctgcctgcctcagcctcccaaagtgctgggattacaggcatgagccaccgtgtccggtgacaatattagtttttataagataaactaggattattatatatatatacagtttcctagtctggtttttaacattgaatatcagcgtattcctccatatccttaaagattcctcagaaacatgattattttcgtgtttttcttgtacccatcacaggcacaaaatgtaatttacctatcagagccctgaggaaagccctgaattggatacttgggtttctcatgaggtttatcatctttacgaaatcatgcagtgatgagtgtgcttgttcatggatctttgcgtctctttctgtaacataccttgaagaggaattctcagaagcagagtgctgggtgtgtgcagtgagttggggttttgttcatcctgcagccggcatgccctccgtgctggtcataccagttgacaccccccccagtgcagtgtgcagttctcttttcaccacatcctggtccctactgggttttacttaatagagaaaaaacaaaaaaacccacaaaaccaaaaaactttgctacatatgcatttcagttttttaaaccatagaaacaatacactctatcaaaaacattttaaagaacaaaagtgggtcgggcgcgttggctcatgcctgtaatcctagcactttgggaggccgaggcaggtggatcacctgaggtcgggattttgagaccagcctgaccaacatgatgaaaccccccgtctctactaaaaatacaaaattagccgggcgtggtggcgcatgcctgtaatcccagctgcttgggaggctgaggcaggagaattgcttgaacccggaaggtggaggttgcagtgagccgagatcgtgccattgcactccagcctgggcaacaagaatgaaactccatctgaaaaaaaaagaataaaagtgtgtaaagtgaaaaatgtagggtcctggccgggtgcagtggctcacacctgtaatcccagcactttgggaggccgaggtgggcggatcatgaggtcaggagatcgagaccatcctggctaacatggtgaaaccccgtctctactaaaaaaaaaaaaattagccgggcatggtggcaggtgcctgtagtgccagctacttgggaggctgaggcaggagaatggcgtgaacccaggaggtggagcttgcagtgagcgaagatcacaccactgcactccagcctgggtgacatgcgagactctgtctcaaaaaaaaaaaaaaaaaaaaaaagtaaggtcccttctgtgcactgcccccaccaaaatcccacttccagggagatgaacattaagtttgatgtgcagacttccagaccggtgtgtgtgtgtgtgtatgcacatgcgtgcagacatgtacacacaagatgcatatattattcctttaaagataatcttctactggagtacctgcacttggatcatttctggaatcatgctacacattttataagactcatcagtcagtcagcaacatgtttgggacatgtattaatgtattagagatacacttccaagttagtccatacaaatacagcctcattctttttaagagctgcatgttatttcatagctggggtgaaccacaacttatctaaccattcagcaatgaagctccagcaacactttggatgatttccaattttccattctttttggctgttgcttttataagcatccatatatattatagatctggttttagagatggatttctacaaatagaattgctggcaaacaagtttttaaaacccagttttattttttacatatatgagtaaaggcattttagcaaattctgtctctttatttatttatgagcatgctcattcgataaacctgttgagtgcttcctgctccagataacgtgccagggatacaactgtggccacagcagaaatgatctctttctttatggaaattacagcggagaaagggagatttcccttatctccgccgcccttgtctctaatacattttaaaatgggaggagaagggggagtgttttcatcagaagagactgcatggtgaaaatcccttttgaattgctcaagggcagccatcagctatcaagggacactcccttataaactctgcggagggagcaaacaggctcagttctctgggctgcaaggtggggctgccccactctcccatctgggccccatcgtgtggggcagaaggggaagtagcagctacccaaagagctggctggtgcgtgcctgagggaggccctggggacctacggtgtgtcattgcacgttggtggtttctgtttctcgtctctcttctcaggaagggatcggcagggcctgtggtcggggagtggccaccttttgggatcctcaccctgggcctgagaggcagtcactgttcccaaaaggtttcctgggatgggatgatgtgccagcccttagtggtgtttgcgagggagccaggcccacaggggggcctggctgacccagcaggaaggtggggccagcttcccattcttaccctggaggcccaggggagccgcctgccagagtcatcagcagagccaggctctacctgggtttcctgcttctgcacctcacttgcagcacctgttggtcccacttcaggaggctgagggccccctgtcccctcttgctggccagactgtcccctgatatagcaactgctgtccagttagcactaaccggggctcagaagccagctttcctgaccactcccaggaggtgccggggggtcttagttcagcctcagccttgccccagcctgaaaaaggctggactggctcatgggccggtgaaagaatcaccatcttctcgcttttgccacgagtggaccttgcatcacagtgctttgcgtttgtcatttaatcctcaggaaaacctgcgcaatggttctgtgctatcacccccgtgtcacagatggggaaactgaggctcagaggctttgtaactgccctgcccgtctcctgccttatctgcttccacccccggccccctccttccggccaggctgtgtcctgtccccgctggtccctccagcctgctgtttcctgcctcccagtctgtttgcagttttctctgcctggaaatacctcccccagatcctgagtttgtgtctaaagtagctccccaccctgcaccccagcactgtgttcttctccctgccttctcagccctgggcccttctcgctgccaggcattccgggggttttgccaggtgcctgtcgccaccacgggaataacatgtggcatgtcaggcaggacttggttgctttcatctctgtgcctagaacagtgtcgggcacataatagatgtgcagttagtgtatgctgaataaaactgtccttcctccaaagcccccagccctccctccatgaccgtcccctcgaggtcacaccccctactgtgcactcttgagtagccccggtcctgtcttcccaacactttccatgttaggagtagatgtttgtttatttgcttactctctgctcccccaactaaactgtggattccccgagggtcctcattgtattctctgatcccggctagtgtctcgctcctgatggagcctggtgagcacctgaatgaatgggtgagtggacagtgaagcagaagagcagaggctggaaccaagttctcccgtattcaggcccagcctcttggcattgtgctgcctccttgtttcacgttgcaagtctgaaaggagctcctggatacagctcatttcaagaccaggcactggtgcccggggtggcctgaagttgtcataatgctgcagcttcttgggatgaatcgtccaaaggcagccatcatctagcaggggacacccctcataaattccattcagggagtttcaaatggagcatcccgggttctctcaaagtgttgtttcatcctgaatctatttttcagtcaagatgaaacttcaccacagaaggcaggagccctggagaaaatttctcttggtagcgctgaattcttctcttagcagcgggtgtgtgaggaaagactgagagtgttggaatgcatgtaaagatacatcttattggccggtcctggtgcctcacgcctgtaatcctagcactttcggaggccaaggcaggaggattgcttgagcccagggttcaagaccagcctgggcaacatagagactccatctctacaaaaaatacaaaaattagccgggtgtggtggcatacacctgtagtctcagctactcgggaggattgcttgagcctgggaggttgaggctgcagtgagccatgattgtgccactgcactccagcttgggtgacagagtggactctgtcatgaaaaaaaaaaaaaagtgttcatttatttttgctagtcctgcaaataatacactttatcatagcaaaggtgtggaagtctcaccacccacacacagccatttaagtagtgtggtatatttcctccaagtcagttcagtgtgtatttttcccctttttggagtgagaggggcatgattctgaccagacagtatattcaactgtgtatcccccttctccccacttaaccttttacagtaatataaatagtaatcagtaaggccgggcgcagtggctcacgcctataatcccagcactttggaaggccaaggctggtggaccacctgaggttaggagttcaagacaagcctgggcaacgtggtgaaactccatctctactaaaaatacaaaaattagctgggcatgtcggcacatgcctgtaatgtcatctacttgggaggctgaggcacaagaatcgctggaacccgggaggtggaggttacagtgagccaagattgcgccactgcactccagcctgggtgacagagcaagactccatctcaaaaaaataataataaattaataaatagtaataaataccgcccaggttggagtgcagtggcacaatcctggctcactgcagcctctgcctcctgggttcaagtgattctcccacctcagcctcccaagtaattgggactgcagggacatgccaccacacctggctaattttttttttttttttttttttgagacagtctcactctattgcctgggctggagcgcagtggtgcgattgcagctccctgcagcctccacctcccgggttcaagcgatttttgtgcctcagccccccaagtatctgggattacaggcgtccaccaccacacctggctaatttttgtatttttagtagagactgggttttgccacgttggccaggttgatctccaactcccagcctcaagcgatctgcctgtttcagcctcccaaagtactgggattacaggcgtgagccaccctgcctggcctccatttttcttaatctatataaaaagttttaaaatcactgcctgatagccaagcaattatggttgtttttagtgtgtcactattattataattttataatggcactgttattataatgggattttgattaacatcattatgcatttttttaaatttaagactgtttcattagggcagagtcctggatttggaattactggattaaaatggtatgggtattttaaaggttcttgctatttattgccaaattgctttcctgaaggctgctgccagtgcaggctctcgttagtagagaggaaagtgttcatctcggtacttcctctcagcagcagatagtcttacatttttaatgctttctaatttgctagatagaaaatggcatctgttagtcgacttggaatgtgtacccctgagtccacatccccggcttttaccccagggctatgggtggaaaacgctagctgagattttgtcttgcagctgactttggtgtgtctgccaagaatctgaagactctacagaaacgagattccttcatcggcacgccttactggtgagtcgtgtagcttctggaaatggaatggactggatgtaaaaactctccaaggtgaccaccaggcgctttagacagagaggggccggaagacaagggctacacgccctgcctcgtggcttactagctgtgtgaccttggacaagctgtttagctttcccgtgcgtcagtttcttcatccataaaattagggatataatggcccctacttaataaggctactgtgagaatgaaatgaaatggtgcacatagaaggcactccattaataactgaactagaatccataaaacaggattcagttcgtgatttattcgccacgtatgtattgagggccggggatggggaccgtgaaggtgaacagtacaagttcaattcctaccgtcatgtgaagtctccctggacttctgtagtctgtcgtgtttccttcttttccagaactattactttaaaagcaaaacactgtcactcaatttcacgcctgactactctctgtttgccgtgtttccaattttttcatgtgcattacttgccattgtgtagtttgggctcctttcttgcttgcttgttactcacccttgctctctctctccccccttttatacctgtttctcctctctgtgctggtgtcttctcgcccacccacctccacgcccctttttttttgctccgcaccttcccctccgctcccacccgccccctccccaggactctgtgttccgggttgctgctgccatctcgcggtaggcatcggaactgcagcaggacgtggcggggagccgcgtggaggcgtttttctgtggaagagcgtcctaaggaagacagtgggatgcaaagtcacgcagatcatgattcgggagtgctgccaaccccgacagtggctcgtggtggcccttgaccctgaatgtccaagaagcacctgtaaaggccagattcttagccctatgttgtcccttggttggttcaggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcagaccctcccacgctgctcacgccctccaagtggtgaggggcaggggcagggccacctgccggggtgcctgcgccgggattagggctggaatatgtggtggacggggctggggaggtgcagtggtagcgttctcctggtgctgctagctccaaaggagaggttggggcctgggggtcttcaggcgtttctgagccccccgggcccttcgtgcctctttttccctttgtgttcctttttttttttttttttttttctgagatagggtctcactcttttgcccaggctggagtacagtggtgcagtcatagctcactgcaacctcgacctcctaggctcaagagatcctcacacctcagcctcccttgtagctgagagtacaggcacccaccaccatgcctggctaattttctgtagagacaaggtctcctatgttgcccaggctggtcttgaactcctggcctcaagggatccgtctgcctcggcctcccaaagtgctggaattacaggcgtgagctaccgtgctgcctctgtgcacttgacatgagatcttcaccagagcaaaccaagtcacccaaataagctggctcccactggggaacaggagccccagctgagccgcaggagccacatggcacaccctgggcgggacatcgggggcctgggttcaaatcccggcactgctgagtctcctcactgcgtggcctgggcacgtccctgctcctcgccgatgtctgggtccccatctggacagtggtgtccatgatgaaaagggcgtcgtgtaggccctgtcactgttttagcttgtgaaagtttcctctgtcctttgaggggcatgattgggacagtggagtctgtgacgtggggggcttctctctgctcttgcctcctccatgcttacctctgacgcctgtcctcccaggtctgtagagttccgtgacttcctgaagatagccctggataagaacccagaaacccgacccagtgccgcgcagctgctggaggtgagtggattcccctcccactctgctccctgaagggtggagcctaatgaactcaccagtgacctggacgctgggcatgttctcaccccgcccagggaacagcatggacagctgtttgtccatcagcgggtattccccaggcacctcctgaatgccagctctgtgttgggagtgccttggggaacgaagccacccagaccttgtcctcatggagcgtgtgttccagtggggatacaggtggcaaataagcaagtatgtgtgcatggcagggggtggccagtgccacagaaggagatccacagtgcaggggtggggcgcctgggatcggctgttgtcttgtaagggaggataaggaagggttctctgggtgagcagatgtccataggaagggaaggagcaaggccagtggcccagagggagaggaggcaaatgcctgggacagcagcatgttccacacatgctgggaagagccagggggtgggggtgggaggtgggggagcaggagcacaggggccaggggaggggagacgagagcggagaggcactggggcgtctgtcccaaggctcgatggttccctaggagaacacctggcctcagcatattctctccccacaggagacttaggacagcaaaagcacagagagaactcagcccaaggaggaggtgcgtgggaaaaggtcttgggagccaggtgcaagcttccagggccctctcccagtacagtcaccaggacagcttaattctctgtgctgtccaccacggaagccccttagggtttttagtgggtagtggtcacataagcaccccctgcctggcacagaccagagttccagactctagaaggaaaggaggtattccacctaagccatattgtttgcagaacagtttaggcagagcgggccactcttattagttaatggtgggagccgtctcctagtttgcagagaccagctgaggatccaaccttgttagcggccctttctgaagcttgctgtgctattttctgcacacagggtcctgcagggccttgcaagccagagccaggtcctgggctttatctgtgcattaggggagacacagcatcgacatccatttacaagggtcttcctgccttctggctgctgtatgcgggatcaggagactctgagcatctcattagctggctgtactgccttagaatgggcaggtggataatggtttcccttgaagctttttgaactattggagggagctgtgagccactctttgcctgggcccatgcctcgagttagggcgtcatggctggaggctgggtgaggtcggtgtgtccacagcagtgttctgagggctgtgcacagcacttgcccggtcatttgcaaatctgccgaccagtgtccccatgtcactgccactgatggaagagggggaggaatgggcctgggtgatgcaacagggctgccctttcactgccgtgtcggctccggtcctgccctcagcatgacagccttagaggtgcagtggcaggaaggggaggaaggcgccacaccaggcacttgagtctttgtattcacccagcttttcccagcttcctactgtgtgccatgcacctgggcctgtggtcggcattggtgagcctctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttaccaggtgccttggttctagagtctacagccagcactcttaactgcatgctactttgcctcctatgattagtaaacccttaacgccccactcaagacctcttaaaagtacagagcagccagaatgacatctctaaagggtagtagtgaatatcactgctgcactgcagcctgttggtggcttgtgaggacagtctctgtggctcacctgcacacacggcccatccttcctctgcatcctgtgtgtcccaccatcctgcccgtctcatggctcctgccgcccaacaagctcagtccagtctcagggccttctttgtaccagctgctccctctgcctggaattctctgtgcccagatctttcccttgggtctcagcttgaatttgaccttgaatgaggcccctctgcctgcagactttagtctccaccaccctcagctatacaagatctggaattctcttgtttatcatttgagccaccgcgcccggccaaatgaactgttttaaatgaacaaacagataagaatgatttgtgatgaacatatacgttctgaatgtgttttccaggtgctagaaatttgttttttagtcgtttaaatacttccccagcaatcttgttgacacttcctccccggataaattgtctgagagtaaaaacagtgaatttcatcagagccttcctgtatattgtaaatgagcaaattctagcttcatgatgcctcccaccccaccccatcattcctttcccagtggccttcggtgagcgtggtgggttgaggaatcccacatccctggctatacccgggtgccctcactcaggatacctcacactgacttaatatcgctgagaccttttgctttggcgttttgcaaggtccgtaaaagaacattcacttttaaataagactctgacatttgtataaaaacctagaatagaacatacaccactctgcctcaagatcttgtatttcctttcttaaaaccaaacacatatgtccacccaaagacatatacgagaatgtctcttgcagctttattcatagttgccaaaaatgggaaacagcccagatgtccagcagcagcaggatgaataaacaaactgtgccgtagtcatacagtgagaccctgcacagaaataaaacaggaacagtttactgaaataggcgacaatgtaggtgaatctcacagtcatgacgctgagtaaaggaagccaacgcgaaagactgcacacacgatgctctgtttctaggaagctgaggagcaggctcccgaggctggcggcgtgggagtggggttgcctgccaagggagacgggagccttccccggtgatggaaatgttctgtatcttgagctgggtggcagttacggtgcgtgcatatatatgtaaaaagtcattgaggctgggcacagtggctcacgcctgtaatcccagcactttgggaggctgaggcgggtggatcacttaaggtcaggagtttgagaccagcctggccaacatggtgaaaccccgtctctactaaaaatataaaaaattagcctggcgtggtggcacatgcctgtaatcccagctacttgggaggctgaggcaggagaatcccttgaacctggtaggtggaggttgcagtgagccaagattgcgcaactgccttccagcctgggcaacaagagtgaaactctgtctcaaaaaagtcattgagctttacaacctgtgaactttgctgtaggaatgttattcctcaacaaaatgtatgtagcatattttataaaactatatattaaaaccttttaaaaaggaaaatagacaccctcccttgcaaacacggcttgagcccctactttgggctaagcattttcaagtgcatgatctcatttaatccgcatgacctccctgtgggttcattgttaacgtgtccacttgagagatgaggagcctgtggctcagagaggttaagtgacatgctcaaggtcacacagccgctgagagacacagctgggatctgccctctttccaacacacttgggactttccaggctgtctctgggtctccaagttcatgtgcacattttgctcaggaatgaggctggccttttctgccccgggggtgagctcccccagcctcttccaccccaccgtgaccccagagtggttctaatctgggtgcatcttgccccctcagcatcccttcgtcagcagcatcaccagtaacaaggctctgcgggagctggtggctgaggccaaggccgaggtgatggaagagatcgaagacggccgggatgagggggaagaggaggacgccgtggatgccgcctccgtaaggccagggagagtggggcttagcgggggctgggaggacaggatctcagctggccctgctggtgtgggaggggcagggaaggccaggactctggctcaggcaatttattgccagctcagaggttgcagactcccacgctgcaggtaacgtaagatggcatgtgggccggggtgaggcagcagggggtgttggccagatcccgatcctgtgagttttcaggagataccagagatctagattttcacatgaaatcttccaatttttaaaagttggtaactgattcatggcttcccatcctttgttcctgtcacagctcacataccaaatgagactgtttttagctcattttgggataaatatgggaggctgcatatggccacaggcaacaccctggcccccctctagctgccctcagtgccaaggggacccatgtctgggcacatttggaactcttttgcagcttcagtgcttgctggatttagattgaaattaaagctaatttaaatttgtaaaaaccctgtgagccaaggaaaacatgtctgtgggctggattctggcccaagctgttgctccgtaatccctggccttacttggggaggcctcttcccagggatagggtggccatcccggtggctccctgtgcctagagaagcaggggctggacttacccatcaggggatggagctggcccacatccttgtgctgtggacggcactgcagcttcctcaaatttaattcagtcctgggtggagcctgaggctggcgcagaccctcaccagggtgaagaaggaaagcccgaagggcagggcaagcggaatcatcacaaccacccccgccatgcatggagcccctggtggctgccgggccctctacagctctgacacagggtaaccaagctccagcttacagacaggaaaactgagatcgatacagtgaagtggctggctgagccgatagatggcagggccaggggtggatttggagtaggagaacctcagtggggcctggctccaggaggaggtagaaagcgctcacacctggcctcattgtctgcatgcaggaggctgatctttgtcctgtgggtattgggagccccgaagggtttcaggcagggactgggtattggggtggaggtgacagaatcagatctgcgtttttgagccatcactctgggtgttgactagaaggtagattggagttgcttccaccagctgccatagctgaggttaaaaaccggtggctggcaagacccaaaggaatacttatagtataaatccattcataccacgtttataagcaggcacagctcatctgtagcacttagagaccataggacagtgactatgtcaagaggtgggagagcattgccactgagaaggacggggcggcaggggatggccctctggggcaaagcaatgtcccctcctgacctggaaagtggctacatggatactcactctattcaccaagttggatgtttatgttttatacacaggaagaatgttctgtttcaccttagcatagcaacatttccagtactttccacccaacaaagactctaaaaaacaaaaatgaagctgaaaacttagtggccacaagggctgaatccagtccccagacaggcttggcttggcctttatatgattttttaaaaaatatgagttagttgccacctaaaaattaagagatgtccattaaaaacctagatttcaaacttgtcttaaaaaattggaaggtttggctgggtgcggtggcacacacctctaatcccagcactttgggaggccgaggcgggcagatcacttgagtccaggagtttgagaccagcctgggtgacatactgaaaccctgtccctactaaaaaatgcaaaaattagctgggtgtggtggcatgcacctgtagtcccagctactcgggaggctcctcgggaggctgaggtgggaggaccactcccaggtgggaacccaggaggtggaggttgcattgagccaagatggcaccactacactccagcctgggtgacagagcaagaccctgtctcaaaaaaatagataaataaataaaataaaaaattaaaattaaaaaactgggaaggtttggccacaggggagccattttcccacattgtcacaattggctggaatggagcggccactgacccctccctgtgggccatgagctggccagctggccacagctgcctcctagcaggaataacagctattacattcagctgagattagagatagtgaggagattgccatgcctcaaaataagtagtaattgtattacggttaggcaatagggagtgctgaagactggctagggagatatctgctctcctttcttggcgctggcccacttcatcttgagggtgtctgactttctccactgcatctctgactcttgccttgaacatacagcagcatggcctttaatatatatatatatatttttctagaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16631 - DNA, 42479 bp, Human
gtttgttaaagaagtgattaataagactgccacagacctactgtttcagaatctctggggaatgaggtacaggaatctgtatgttaaaaaaaaaaaacccaaaaccagatggttcttttggaaactaacacttgagaatcagtgctttattccaactcaagatttttaaatgctttcatctgttgaatattttaggttttgtctgttcatctatcaagtatagcaaacagtatgcttagtatgaactcattacagaatatttgtgtgtatgtacataggaaaaatatctggaagtatagatgtgggtgtgtgtatatatgtgtgtaaatatatataataatgttaatagtaggaatacagatgatctctatttttccgctttatccttctgttttatttctctcatttttttcttcctgtgtttaaaaaagatgcttcttgtttctgagctcaattcccccacctgagaacagggtgctgtaactaggtgaatttcaagatcatgtcttgttccgatggtccgtgactccatactaccccctaggttccctcgtccatctcacagcatgaactgcataggtaacaacagtgtttggagaataagcatgtattatttttgtatgtattacgtttgagatgcctagcaaccgtttttgtgcccgcaaaatttttctcttctttgtcaaggagccaaaacggaaatagtctactatctacggccctcaaaagttcctcctctctccttagccttagaaaataccgtccgccataggcatgggcaaagacctcatggctaaaacaccaaaagcaatcgcaacaaaagtcaaaattgacaaatgggatctaattaaaagaacttctgcacagcaaaagaaattagcattagcgtgaacaggcaacctgcagaatgggagaaaatttttgcaatctacccatctgacaaaggtctaatatccagaatctacaaggaccttaaacaaatttacaagaaaaaaacaaccccatcaaaaagtgggcaaaggatatgaccagacacttctcaaaaaaagacatttatgcagcaacaaacatgaaaaaaagctcattatcactgatcattagagaaaggcaaatcaaaaccacaatgagataccatctcacgccagtcagaatggtgattattaaaaaatcaggaaacaatagatgctggcgaggctgaggaaaaataggaatgcttttacactgttggtgggagtgtaaattagttcaactattgtggcagacagtgtggcgattcctcaaaaatctagaaccagaaataccatttgacgcatgcacacgtatgtttattgcagcactatttacaatagcaaagacttggaaccaacccaaatgcccatcaatgatagactagataaagaaaacgtggcacatatatgccatggaatactatgcagccataaaaaaatgagatcatgtcctttgcagggacatggatgaagctggaagccatcatccttagcaaactaacacaggaacagaaaacaaaacactgcatgttctcactcataagtgggagttgaacaatgagaacacatggacacagggaggggaacaacacacacgggggcctgtcaaggggtgggggccaaggggagggagagcattaggagaaatacctaatgcatgtggggcttaaaacctagatgacgggttgataggtgcagtaaaccaccatggcacatgtatacctatgtaacaaagctgcacattctgcacatgtatcccagaacttaaagtaaaattaaaaaaaaaaaaaaaaaagaaagaaaaagaaaaagaaaatgccgtccgcgcatatctctcaggagcataggaagggctgtgaaccaaaaagccagggcgtggtcgccccgcccaccggccgctacatcaccacccctctcgccgctttcaagcgcggagattggctgtaagcaagaaagagccccgcccctagtcttatgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggtgagttgtcgggccctcccgattagtctgtccgcctgggcccggggcaccagttcaaagctacaacctgaaagactggtccgagggggagggggttgagaggctcagcagctaacactgggcggcggcggttggcccggggaggcaagcggtgacctagagaaggcctgaccgacggatggcggggaagaagggcccaggagagtaagaaggggccggtaacggggggtggacgccgagggagtaggctgggaggagtgaagcgtggagagggtcagcgtggaaagagtaacttggggaaaacactgaggagtgagcgtaggagggtggtacatgcagattttgggcgccagagacaattaggagagtcttggtttgctgagatcagggaagagttttgaagatggtggaaaaactatggggtgagataggaaattaagagagaagaccatgcctgcctggagtagcttgggagaagtgtgtgggtgggggacagatgggacagataggacagtagagcctgaggggcaggggcagtgacagggttgggcattttgaaggttggaatttgagactgtgaagaaaggatgattcaagagattaggagtgatgctgggtttgagtttggtagtcatagttttaagggcgaaggaacctaaggtagctggggcaatttccaggaaagaaaacttggacccaacctctggagactaaggggttcagggggaactttgatggggagtgcacatctgacttggaggtattgaggatgtcgattttctcccagttttgctacttcctcccagccagacgctgacaaaaaaatccccagacgtttcagttaggagggcctcccagatgtgaggttttgggggtggagtatttgagtttggtagactacctctttgccttcagagtttcttcttttctttcttccccatcacacagctagcctattacctcatattttgggggtgcagggagcaggtagacaaacttgctaaggattgggttgttaccagggcctaagaatggctggatggggccgggcgtggtggctcatgcctgtaatcccagcactttgggaggccgaggtgggtgtatcacctgaggtcaggaattcaagaccagcctggccaacatggtgaaaccccgtctctactaaaaatacaaaaattagccgggcgtcgtggcacatgcctgtaatcccagctgcttgggcggctgaggcaggagaatcgcttgaacccagaaggcggaggttgcagtgagccaagattgcgccattgcactccagcctgggcgacaagagtgaaactctgtctcaaaaaataaaaataaataaatcaataaataaatggctgggtgaatgttcgctgattgtgttgtgccctaataggcagtgggtcgctaacaactttaatgcctaaaagtgaactttgactaaagtgtctcttcctgactttgattcatgctgtgcttgttgctacccacctgctcttgctatttgtgacttaataaaataacataaagaacagacccagatgggagtggggaagaaatagacatattaggggtctgagaaagcagtgagaggtatacattttgtaattcacatttcagtagaatgaaatcaacaccctggaatagtgattctcaaccaggggacatttggcaacatctggagacatttttggttgtaacaactgggggattgcttttagcatctagtgggtagaggccaaggatgctgctaaacatcctaactaagcacagggcagcccctgacaacaaagaatcatctccctgaaaatgtcaatggtgccaacattgataaatcctgctcgaaaaccatagtattggaagggttcttgattatctaattcagtgactctcgaggaccttttcatgcgtctgtgaaatcaaaacttcggaataaggttaagaaggtatttgtccttttctgctgggcacagtggctcacgcctgtaatcccagcactttgggaggctgaggcgggcggatcacctgagatcaggagttcaagaccagcctgaccaacatggtgaaacccagtctctactaaaaatagaaaaattagccggtgtcgtggcacatgcctgtaatcccagctacttgggaggccgaggcaggagaatcgcttgaacccaggaggcggaggttgcggtgagccaagattgcgccactgcattccagcctgggcaacatgagcgaaactctgtctcaaaaaaaaaaaaaaaaaaagaagttatttgtcctttgtccttttcactctcatcctctcaccagtgtacagcagagttttccagtggctacgtaacatgtgatgacctcaccactctgatgttcttatattttattcatttctcagttttaatttctaatactgtaaataccaatacatatgactcacataaacctctgtgaagtcctcagtggataagaaagtaaaggggtcctgacaccaaaactttgggaatccctgatgtagtccaactgttcacagcgcgcaggaaactcttctgtagcacttctgaaaggcggccttgaggcaggctttgcttgaatacttaattggaagccttaactgtaccttggagcacttactgagggccaactgaccctaagaaaggattgtttacaatggaaagtaccttatcagtgactagaacacatctgaccaaggcatctgttaatcagtagttccctgccaattgaatctgtgcacaaatacaacactgttattgttttgggaaagtgaaaaaaataatagttgtcctacttgttggctttcatgtcattaaatttttttttgttttttaatgaaagcttttttgttttgtttttacaaaagcaatgcttactcactgcagaaaataaacatgcaaaaagaagcacataaaagaacccatcagctcatctgctagtttgccatttattgatcaggactaactagattcttcctcttggaaaatttccaagattgattccctccgcctccaagttcagagcaggatttggaaaagtaaatattaataatgtacctagatctgatttttaagaggttccaggatgaaatagaaaccatttttctatacagctgcattttctgatggctcttggttcagtgtggagcccaaagtcctcccatatagctttttctgtcaagaatttagcagttgcttggtgggttttgcacaagttacttttctatatcaaaatggataccaataataggtttttgaaaacttaataaatatttgtaaagtacctaatatgtagctaaatcaataaatatttgtaaagtacctactatgtagctagaactgtgcctgggtactgtacggagtgccaatgaaggaggacctgtcctaaatttatagtcttattagcattagtgctctagctgtgccagtttgactttgtaactttataactctatcccagcttcacccataaccttttaaaaacagcagctttagaataagtacagaaaaggattcttagaggctatatattggtctttttcatagagattaaattatgctggtgtttatttggatgaattgtaactgaccagacaactttccgaagagaagctatatgatttagaggtgttataaagtggatagtgggtgaaaatcctttctttatataattgcctaattatggtccttttgtgatatcatagatttcaggattcttctgtggttattgattcttataactagcttgacttctgttttttggtttgtttgtttttttagggttcagaattttttttttttaggtttgaggcttttctgggtgggaaaaacctcacagaaatattcttagtgtatgttactggtaggagcctctcccttccacacgtttactgaatgcctattgtgtcccagccactatattaggtgaaagggacagaggaatggataagacagatgaggttcctgctctcatggagcttacattttaatgggagaagaaagctcaacagataaataatataatgtcagatagtgataaacactatgaagaggccgggcatggtggctcacgcctgtaatcccagcactttgggaggtcaaggtgggcaaatcacctgaggtcaggagttcgagaccagcctagccaacatggtgaaaccccatctctactaaaaatacaagggcatggtggccagcacctgtagtcccagctactcgggaggctgaggcaggagaattgcttgaatccaggaggtggaagttgcagtgagccgagatcatgccactgtcctccagcctgggggacaagagcaaaactctgtctcaaaacaaaacaaaacaaaaacactatgaagaaaattacacaggtaatgagaaaggagaatgagtagatgataggaatgggtgatggtggatgatccttctttatattatgtggtcagagggccttccgttatcgggtgacatttgggcagagacctgggtgttggcaggaggccagccatgtgaccatctggggaaataggaataaatcttatcatttgcaaaatcttaggttactagcctattttccacgcttttttgtttccccctagttttagtcaagtctctcctatggtagcagtctctaagagcagagacgatcttatgtactgttacttcccattgcctacctagcatagggtctggtacatggttaacccgtagtgaatttttgttgaagatattcattggtgggcactagggatatggtggtaaactagactcatttagtctcctttttcttccatgaattttaaatgatgttttgcaagaagttcttttggattgaaaacttcaagatcagtgctaagcagtacggataattatacagtaatttactaatgtataatcccatataataatgctagtttcttacctgtactccttcagatatacctccgtagtctcgaagggggtaatatggagaattaggagttccttggtgaggagagttaggttttcacaaagttaggttttctctgagagaaaacaagcactaagatttttctataggcttaacacatttcatttaactgataactttgatttcgaggttctgccaaattattctagttataatagagatactgtaaaggactgaaaaattctgaaccctaaaaaaaaacaaaaaaaaaacgaaaaacagaagtcaagctagaagataagaaaggacaggcttgttagtttgttagtcattgattatcacatctgatagggttatagatattcaaatatgtcccaaataccagattagtttgttagtcattgattatcatatctgatagggttatagatattcaaatatgtcccaaatatcagattgtcacatctgatagggttatagatactcaaatatgtcccaaaagaacagctttcttcccctatatctttgggtagattttgtctataaccaagcattatttcgtagcactggagctgatttaaatgacccttgatgcaggaaggctgctcttctttctgtagtgcaaaagtattctgatcataatttcttattaaagtgatcagagatcccctcagacccaaaagtatactttataagtacttgttggtatcctgctgtgcattgtgaaagaattctggaggtgtgccaaacactgctcaacaataagcactttccattagttgagtagtgttgaatcttgtttccttacccactctttggccttaacaaattaagtcattttatagcttaaaaacatatttttattaacttttaatactctttttcatgtgttcaacattcttactttaaaatcatattgcttttctcctttaagaaacttaccaaaagcaagggtataaagtaactgaatgcaatgagtgtacctattattaggaattataaaggagaaacagttaatctgacttaaacttgtaggaaaaccatcactctgaatagaaaacaaagataaataggtaccgtatgcctctgtgtcctgtattttaaaaagaccttttgctcaacatcattctaaattcatgagtttgaggacaagagtccagaatttaatatgatgaaagtaaacataaagctaaaacttgggaaggttccctttaggtgctgtgtttactaaaaaggagacttgtaaattggtatctaacttgtttggcaaatttcttttagctctgaagggtttatatgctttcaaagaacctattggagaaatatgcactataattctaaacaagggtaacttgcccaaagtctcacagctaggaagttggactgccagatttgagttctagctcttccactccaggaatggggactcttaatcacttcattatataatcaatccattgtatcttggatcattgtttggtttctttttattggttttgttttattgctagcattatgttcttcccccacccctaattttgtgtgtttatgttttcagctatactttgggtcaaatagacttgcaaaaacctagccactttttgcagtgtcatacacttggggaagtaaggtctgtgttctctgtgagaggtttttttttttttttttgacagggtcttgttccattcccccagctggagtgcagtggagtgatcttggctcactgcaacctctgcctcatgggctcaagcgatcctcccatgtcagcctcccgagtagttgagaccacaggcatgcaccatcacacccagctattcttttgtatttttagtatagatggggtcttgccatgttgcccaggctggtcttgaactcttgagctcaagtgatctgccccccttggcctcccaaagtgctaggattactggtgtgagccactgcccggtcaaggtctgcattctaaaagaatttacaaatgacctttttggaaaacaggattgagaggatatttgactttgagaacggttgattttgaggcatacctttttcttttatttagagaataaactctcagctctaaaattacacactctagaatatattcatctatggttttttaatgtcataaagccttttaaaaattgggtattgtaaaatcaaacacagcaataaggatggaaattgcttgctagatactttttaataaagtgtaaatatttcaactgtaaacttaccttttgggaaaagctctgttcctagcttgacatccatgtcaaaatttattgaagtgaaacccaacatggggtttgagggaatatccagaagactgatatgttcaagatttggaagagctaaaggactggcctctctgtaattagattaagctatgttttgggtccctattgcagtgtgttttcaccttgatataattaatcagtatttattgaaaatctaatatgcattcagcactacttggaatgataggagatagaggaaaagtaatacacatggtgtcccctaccatgacactcatgatagatgacattcatataaaagacacactgctaggggttgtgggatacatcagatcatctgatcaagggagcatactggagttcaaacgagtgacagaaatgttatctaaagggaatcttgaatctatccatatatatcattcattcacagacttggtactttttttattagtaacaaattacttactgtatactataatttaccatggcacaccagtttgttatgaagtgacagttgaaaactgctgtgttggagcttatgacagtaggagggacaggatttactgctataaaataactgaataattcaggataatgtaaaatatactgaaatgggatgtgcattattactgctccttgagggcttttatagtcagggaaagctttgtggagaaaatggctactgaaaaaacagatagcatatcagcccaggttcttaattgcaaggaagagaaatacaatctgattgattttaagcagaaaagaatttattaaaaagaactgggatataatgcataccctttggccccacagtttcattcctagatatacagccaacatacacgcatacatgtgtttactaatatgtgcaagaatgtttgcagcagtgtttgtaatagaatcacactggaaactaaatgcccattaaaggtagcatagataagtagtttttttgtttgtttgtttttgtttttttttgagacagagtttcattcttgttgcccaggctggtggagtgcattggcatgatcttggctcactgcaacctctgcctcccgggttcaaacgattctcctgtatcagcctcctgagtagctgagattacaggcatgtgccaccatgcccagctaatttttatattttcagtagaggtgggatttggccatggtggccaggctggtctcgaactcctgacctcaagtgatccaccctccttggcctcccaaagtgctgggattacaggcgtgaaccaccccacctggcctgtattcacctgatcatagaaggttatacagcagtgagcacagactgcaattatgcataacatgggtgaatctcacaaaacctaaaattgaggaaagaaagcagacacaaaagagagcatagtgaatgattttatttatatcaagttgaaaaatggataaaattaatctatagtgtcagaaatcaggataatggttacccttgggaagggaatagtaacccttgggaagggaaagggaaataaggagggctttggaagtgtagttgacccttgaacaacacaagtttgaactgtgtgtggatctacttatacatgagtttatttcacctctaccaccctgaagacagcaagaccaacccctcctcttcctcctcctcgttatgattttttttttttgagacggagtctctatctgttgcccaggctggagtgcagtggcgcgatctcagctcactgcaacctctacctcacaggttcaagcgattctcctgcctcagcctcccaagtagctaggattataggtgaccaccaccaagcccagcaaatttttagtggagatggggtttcaccatgttggccaggctggtctcgaactcctgacctcaagtgatccgtctgcctcagcctcccaaagtgctgggattataggtgtgagccaccatgcccagccctccttatgattttcttaacattttcttttctctagctttattttcaaaacacagtatgtaacacatatataacatacaaaatatgtgtgaatcgactgtttatgttgttggtaatgcttccagtcaacagtaggatattagtagttaagttttgggggagtcaaaaataatatgcagattttcaactgtgcagtgggtcaacacctgttaatgttctgtttcttgacacaggtggttttggtttgtgaaattatttgagctgtagacttaatgttacgtgcacttttcccttacatctgttatactgtgcctgtttctgtacatatgttacatatcaaatgtttattaaaggggtatattgggtaactcagaatttctggtgctcctggctatatataccaaatcccagttcaggattcaacaacccagatcatgctgctgaactgcactaccactgccaagtgtgaaattgaagcttgctctgctggccttgttgcctgggagcttgatcctgcttctgttactccacacctgtctccctccctgttccattcctggctccatttgcagccctcctttcaaagtgtggggtggatacctttgttaggcagagcctagcacaagtggtcctccttactgcaagggagtctgggaaagcaagtatccagtgttttcagcttttatagtgggtggtgatttctgccagaaattgtaacaaggggacaaggggtgtttcagatttggggcagccaaaaagcgagcaaaatccatctttgaggtgagcatttaggccaatagaagaaagtagatttcaagtgttaggaacaatagaagcccagggtagaggttgaatagagtatggcatttgagcccagtggaaacaagtttaactggattaaagggtgtgctctgggaaaatagtttgagaaaagttgaaggaataggatgggacaagattaaagattactttgaaagtcaggcagaggaatttaaatttcatatgggaatgttggagccagtaaaagtttttgaacaagaaagtgtcctaaaaggaaatggtacttaaggattattaatctggcagcacttctaggggtatctaggcattttctgtcataatttaggtgtggggtgatagattgggagtagaaataaaaggcaaagattgtatttaagagaagatttgaaggaaaaaaatcaataggacttcttgaagagaaagaagtagaggctatttctgaaactgagcttgagtgactgatcccactcttcatttagagctagcaaagctgaggagggacccagtttggaggaagcagaagaatgaattttagtttgggaattgctgagtttgaggtgagagatattgagtaaaagtggtccctgtgcagttagagttggggaccaagaagtggaaagaattgcactcaggcagaaaggctgtgaagggaatggaacagagtgtgccagaaccctcagggtgtttctcagctcttgtttacgggccaccaggtatactatcttgaatttaattttaagtgatacgtttgaaccacaacctctaccttttgtttcataaaacgtcagttctcacaccctaagacacattgatgcaagctatcgatgctattactattttacatggtcttcttcctgttattctaatatatttggaaagaaaatgattaatacatgtgaggcttttcttggtaattttcaatacttttgaatgttttgaatacaaggagaataatatactaaagctagagaccttaaacaagaccgagaaaagactgcatataaaaagcaaacctccagttcattaaaattgtaagttggagctcttggctccatggcagggagccttggatcagtaagtataacagctcccttccgtattgtacttagaaaagaatgatcataaaacctacttaggcctcacaaggtctttttgagccttagccaatgcatttagtcactgtcagtaaccacaagctttagtataatattctggcttgcaaagcagccaggtctccagagcatgacgataggctcttctatacaacttgaaagctgttgctgaggcataccttcttgatattcctcttagcacttttctctagtctatagcaagtctgtacctgtagatgacagtggattgctcagatattattaaagagtatgcaagtatcttaacaggaaacagcttaccctttgggtaatgtgtgatacagtgaagaaaatcccttaaatggttgcccaatatttatgctgctggcatgtttgctgggatattttttctcctctgaattagtattttgagtccttgggctcttcagtttaatagataatgtttctatgtttaagtgtagaagatccaccatgttagctgaaaagttccaaggcttttctgtctctgtaacatttctctgcctaaagaggtagcaggttgaaaatttaggaaataactttgcgtcaaaaaattcatcagcctttctaatcaattcgattttaaagtgaaacagtgatgaactttgcatttatcagaattcatgtttttctcatggatttaacagccctttgcaactctgcttccttggttacatgatagaaagagtatctgatcacatcagaataaaatcgtttgggaagacatccgtgtgtcatagattatgtagcttgcaacaggatttaaagcaaaaagatggtagaatatcggatctatcattatttttgcagtgaatgtttcaccagctggtttgagagaagttttacacccctaccaggcttcctcttacctcatttaccgcaaaaaccacaagtcctaacaggcaaactgtaattgcctaaaacaaaactagtaaggtataaatgcatgtggaaatgattatttgaaggcaaaaggcaaataaatgtcaccagtctgagccatgacctaagcatcctaggtctagtaaccattcttttggtaagggataatgccaacttttttatcaataggattctgttaaaaatacaaagaaaaacagtcagcaggatactgtatctatacacatacatatatgtatatacacatatatgtatatatatgtatgtgtatatatagatataaaatacttttgtttcattttagagctggttgaacttcagtggtgggtagagcttgtttttaatttatataatttttgtagtacaattttaaaatattatttttttaaatgaatccaggagctgtgcggtcttatgcattggaacttaatttgacagattcagaaaatgccacttgcctttatgcaaaatggcagatgaatttcacagtacgctatgaaactacaaataaaacttatgtaagtatatattttaatttttctttgagttttatagtaggaatttaattgactttatcctttagatacacgtatacaaatgaaattccacgttgactgacttaatgctgaaactctgggattttttttaagcatacacactcagaagttattctgtttagtgttagaatgaatatttcttctgattcattggttcttgggagtttttgtaggacttgattaagggcaaatgatctgaagacgactatatggtgttcaggtctaagtatttctgtaaagtgtttaaaatgtactagcaccaaagcttgcccttttaaaaagcagcttcccatctgggcatggtggctcatgcctgtgatcccagcattttggaaggccaaagcaggaggattgcttgaacccagcccgggcaacatggtgagacctcatctctacaaaaaaactttaaaaattagccaggcatggtggcacacacatgtacctccagccactcgctgggccgaggctggaggattgcttgagctcaggaggttgagtctgcagtgagccatgattgtgctactgcactccagcctgggcaacagagcgagactctatctcaaaaaaaaaaaaaatcgcttacttaggttggtacaaaagtaattgccattaaaggaacaaaccacaattacttttgcaccaacctaagtaagcgattttttttttttggcacaaactgcaattacttttgcaccaacctaacactaaaatctccccctttttgacatctcctcttaattcctttgccttcttattttctttttgttaaggtcctcactacttacaacctaattttttaaaaaatcagtttaagaacagcagctcaagccagttttccttttctttttagacatacacgaatttatccagaggagtggtatgtagcagaagaatcagggactggtttacacagcaaaccaggcaaagggcaacctggccatggagaatgtatgatttaggctgaagtggcatgccctacataaatgcttggtgttccttgctgcctgtttgtttctcacccccaaatttctatttcttttagaaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggtaaccttaagaatggatttgtgttatgttctcttgctttttattaatgataaaaatgtaaacaattttaaaattgttatgaatgtctgtcttcctaactagcatggaaacttcatgtctttataaccctcccactgaccccatgcatggcacatatgacaccatccaacatactgatgatatttgctgtcattgcttgagtgacttactgtataccaggtattatcctagtatacagtaagtcaccttactatatatatcctagtatacatatatatgtgtatatatatacatatatatgtatatcctagtatatatgtatatatatatatacacatatatcctagtatatatatacacacatatcctagtatatatgtatatatatatcctagtgtgtgtgtatatatatatatatatatcctagtgtgtgtgtgtgtgtatatatatatatatatctcctagtatacagtaacacacctagtgtgttacctgcagcatctcacttaattcttaacagcaaccctgggaagtagatgttgtttcatttttacaggtaaaggaaatgaggcttgataagattaaatgacttttccaaacatcacacagtctggtaagtgggcgagctggtgtttgaagcagtctattgacctgcagaattcatatacttaactattattgatttcattcagtagtgtgcatgaaacaaaggtttgatgaatgagaaaatgctttactaatagctactttattttcaagatcgggggttggggggggtgtctcactatgttgcctaggctggttttgaactcctggattcaagcgatcctcatgcctcacagcctcctgaatagctgggactacaggcatgcaccactgtgcctggctactaatagctattttaaatgtgtaaaagttaagtaacctgagactaggagaaatgcctcttgttcaaatctttttatcatttaggttggattttgattgaaaagtaaatgatgattagttaaaggtgtagtagtccctcattacactcagggggtatcattctaagatctccagtagatgcctaaaactgcagttactactaaaccctatacaggaaatgctatgttttttttttttttttgatctgataactgacatggctactaagtgactaacggatggatagtgtagacaacgttgatatactggacaaagggatgattcatgttcctggttgtgcagagcgggacagcaagagatttaatcatgctactcagaatggcgtacattttaaaacctatgaattgattacttttggaattctccattgaatattttcagagctcaattgaccatgggtaactgaaaccagggaaagcaaaaaccgtggataaggggagactaaagtcaacatttgctgttattttaagacaatttcaggtcaaaatgaacttgggaagcattggcaattaggccattctagtaattcccagaactgaaatgcgtgttaaaatattttgaagatatagagtgtagagattttattttattttattattttgagctggagtctcgctctgtcgcccaggctggagtgcagtggcctgatctcggcttactgcaacctccgcctcccaggttcaagcaattctcctgcctcagcctcctgagtaactgagattacaggtgcgtgccaccacgcccggctaatctttgtatttttagtagagacagggtttctccatgttggccaggatggtctcgaaatcctgacctcacgatccacccacctcagcctcccaaagtgctgggattacaggcgtgagccaccgcacgtggtcgagattttaattttgttagggatataattctcttctttctccccctgcccgttgagattgagttaatgtggtatttgtagtagcttagctctttgcagatagtgtttcattctgaccccagaaacaggtagatgggctttagttgcctagacctggggattaataactcatttggacttaaggatgtcaaaagatcctattcgaaagaaccagaagtaaataagctcacgtaaaatttgggaggtattgcagaatgagacttggaaatcaaatcctagtgttctttttactaatctcttagtttgagagtataactaaagcaaatggttattggctatcttatcagtttatctttgtgccctgttttgcctttcagagctagtataagatatgcccctcactttcaagtagcctaagaatgagctggggagacaaagctaaatgctattcccgagttacatggaaaaattggaaaacattgagctcagtctgattttgttgttgttgtttgcgtttttgtttgagggagtagagggttcataaatctcttctgacagtgtgaggaaaactttagactccctctcaaaaaagaaaaagtacacagtaaactttgcatatggaacatagtccctgaacccatatgtagatccctgtggttaagagtgcctgatttaggtcgagaatggtagctcatgcctgtaatcccagcactttgggtggccgaggcaggctgatcacttgagccagggagttcaagactagcctgggcaacatattaagactttgtctctacaaaaaaaaaaaaaaaaaaaaagccaggtgtggtggcgtgtgcctgtggtcccagctacctgggtggctagggtggaggatcgcttgagcccaggaggttgaggctccagtgagctgtgatcccaccactacactcagcctgggtgacagagagagaccctgtctcaaaaaaaaaagaaaagaaaaagaaaagactggctgatttaaaagtgttcccgtgttcccacaagtggtcctgattaggaggagtgataaaggaaggctcagtgtgtgttagagtagtgagaaagcttggtagagaagtaggacctgagctgaaactcagctaatggtagaatttgagtaagcggaggattttgagcaggatgtttccagcagggggaagcatagcatatgcggcagtaattggagagctgcctgattaaatcaggctgtgtgtgtagcagaaggaaaataaagttggctaaatgaagtgggcctaaattatagggggccttggaagccaaggaaagacatttagcttgatggggcaggcactggggaatcattttaggtttttaaagcaggagaatgatataacaaaagcagagacagtagcttataaagaatattctgcaggattagttgagaagtgaggaggctacaagcagagatgctggcttaagaagctgttatagtaatcaagggctgatgtaataaatgcctggactacaggggcatcagttgttagcagttattaggaggaggtgtttaatctgacatatttggatagaaaaactatggaccctgaaatgttaacacttctctctttccccttttatttaaaacaaagggaggattactttttaaattactaccttctatataataatatttgaaactatttggaatgttaaatggcttcctgaaatggactattaataattgtttttgatatagttcagtgtttcaagaatactaatttatggctgggcgcagtggctcacacctgtaatcccagcactttgggaggctgaggctggtggatcattggaggtcaggagattgagaccagcctggccaacatggtgaaaccctgtctctactaaaaatacaaaaattagccgggtggtagtggtgcgtgcctgtaatcccagctactcaggaggctaaagcaggagaatcgctttaacctgggaggcggaggttgcggtgagccaagattacgccactgcactctagcctgggcaacagagggagacccttccttacccacccccaacaacaacaaaaaaaactaatttaggccaggtgcagtgactcaacgcctgtaatcccaacactttggaaggccaggcagatcgcttgagctcaggagtgtgagactagcctgggcaacatagcgacattctgtctcaaaaaataaaaataaaaaactactaatttatttttaggcatctgataactgaagtaacattgaagctgcttttttcttttttaaatttttttcgtgattaaaatatagaaatgtactggccaggtgtggtggctcgtgcctgtaatcccagcattttgggaggccaaggcaggcagatcacctgaggtcagaagttcgagaccaacatggtgaaaccccatctctactaaaaatacgaaaattagctgggcgtggtggcgtgcacctgtaattccagctacttgggaggttgaggcatgagaatcgtttgaacctaggaggtggaggttgcagtgagctcatatcatgccactgcactccaacctgggcaacagagcaagactccatctcaaaaaaaaattatatatatataagttacgtatataataagggttttttaaaaggctctacatatacatatatatatataaagattatatatctataaagattatatatgtatacagagaataatatagcagacccatatgtacccattatccagaattaataaatgctgtttttttaatgtttgtgttacttttttgattaaaaagataaaacgttgacaatacagttgatatttcctttgtcttcattccccagacccattttccttcttgcctgctaagaggcaaacactttcacaaatttggggtataaccttcctgtctttatgtttgtcttttactatataagtacgtgttcataaacaatacatagtttaaaaaaagctattcatagtataactccaatatgcctgcaagttgtttttttgctgatttgcttttgaagtccatctatatacagccagtcacgtatctattcatttttgttaacggtgagaagcaattctgggaaaaatgttctagttcattggttttttgttttgttttgttttttaattcctatggccattagggggtgccaaggcagcattatatggctgcttgctacatgatggagaggcacagaaggcagcctatattaaggaccttggatactttcctttcttgctacttctccaaaagaagccaaaccacttgggtgatcatcgtcttttgaagtttcactatacacaggctaataaaaactatatgaaatggctgtaacttactgctttcatactctgaagattccctgaaatggaatcatctttaaatgtaatccaggaagcggttctataagctcattggagttaatataacttacttgggactagtaaaacaaaaataaggatttactatacaaatgtatgattaatccatctctcttgcttctttagttatagtcactaagtcctgatgattctaccatagataagtgttttcagtttggcttctttgctctctttctactgccccacaccatcttagtttaggcaaccctcccttacccttcaccttaaccagaccatcaccctctggtttccctcttaagtggcttccctgaaaagtttttccccctgcttatcccctacaaatttgctatcttccttaaaataaattatatatgtgttattttctgctttaaaaactgaggctagccctcgactgctaaaaagaaaagcccaaacaggccttagatcatagaagatgcttcaaagtatgatcacctgcaacttgtctttccttcttaacccccatttcttttccttttttctttctttttctttttttcttgagacagagttttgctcttgtcatccaggctgtagtgcagtgggcgatcttggctcactgcaacctccgcctcccgggttcaagcaattctcctgccttagcctcccaagtaactgggattacaggcacctgccaccatgcccagctaattattatctttttagtagagacgaggtttcaccatgttggtcaggctggtctcaaactcctgacctcaggtgatccacccacctcggcctcccaaagtgctgggattacaggcatgggccactgtgcccagcccctaacccccatttcttcttcccccttactccttatgttttagccacagtgaactagtcatgcccttaagcatgctatatcctttgtcactttgtgcctggggtagggcaggcagagagaagaagaaagcctatacaaatatatttatattatcacttttctcctaccttcttggaaatagccattgttaatcttgttttataggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatggtgagtaaagtatatatttctctacttggatcctaatttaagagtagagtataccaggtagctttcattgaagtcattatctgaaagcatttatatattaaggtttattcatagcttctactaggctataaagtttttgtaaataatagcaattcttatttttgtgtatcttacaatttaaagtttttgatgtacatgttgtggaatggtattttaaaagacactacctatactgttctcagctgataaaacctaatcattgtttgaacagatcctcagatagcttgattatcagcttttttagcggttccaagaccaaagcttagaaatcagattcatattctaatcttgaatttttaaagttgattttataatttttatatagctttatggaaaggtaataatttctcattcaccagttctggaaaactatgaacacttcccaagaagaggttgaaatgcctatgatttgccatagggctaatgcaaataaatggttcatttgtatttaagtcctttgatgatttctaagcttttttctagtaaacagtatccttccttatggtgattgtatgtgggaataaagaaccaaaaaatttaagacttaactctctgaatttcgtatcagaggcaggcaaagttctttgggaataaaaagatttaagggtctgaaaaagacgagtatgtggccatgtgggagcagataaagcatagggatgtgtcctgagtttgctgtgtcataactcatgtagatattctgtatatgaagcagcagtttaagaacctctgcctaatttagtttcaaatatactaacaagatattctcttcccctaatataacccttttggacttctattatgagaattttttttggttttccctggccttatgaattaagaaaatgtccgctttggtttcttttgtcccttttcgcttgttttagagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggtataggtgtctatctttatcaatacatcctttttgcatttcatttcaaatattgcgtatcctaccttcagcccaaaggtagtgttactagaatgattccgttttctttttgtttgtttgtttgtttttttgagatggagtcacgctctgtcccccaggctggagtgcagtggtgcgatctcagctcactgcaaactccgcctcccgggttcacgccattctcctgcctcagcctcccgagttgctgggactacaggcgcctgccaccatgcccggctaattttttgtatttttttagtagagatagggttttaccgtgttagccaggacggtctcgatctcctgaccttgtgctccgcccgtctcggcctcccaaagtgctgggattacaggcgtgagccaccacacccaggtttttctttcttttttttctgagatggagtgtcacactgtcgcccaggctggagtgcagtggcatgatcttggctcactgcaacctccgcctccagggtttaagtgattcttctgcctcagcctcccgagtagctggggttacaggcgtgcactgccatgcacaactaatttttttgtatttttagtagaaatgggtttttaccatcttggccaggctggtcttgaactcctgacctcaagtgatccacccgcctcagcctctcaaagtgctggaattacaggcgtgagccaccgcgcccagcctgattcagttttaaatggagatttcatgttggcttgttgagctttgattagttaggagttactataaccatgatgtgttaatgtcactttcaggtgttgtgttggccggcagaaaacctagcagtttaaagtactcttgggggtttagattctatttgccatcagtggatcagagtacaaacaattggcctttatttcagtcagtttaaaatataactccttcacactttgatctgaaatgcactgtaggttggcgtacaggagtggcacagctatccgtttctccagctatttgattactcggatcgtgtagacatgcccgagtacatgatggcacttctagttgcaatgttccactcaggctgtagagggattgccaagaaacaaatccgatttccaggatcttgtgacttaaacaagcgaggcagatggctcttgtgctccataaaaatgtgtgttttcatttggctcattactgtagaagcttccctcttgtttttttttttaagttgtctgagtcatagcttgaggacccatgccaactttgtttgaaagtgaagacaccatgaattttaagtatccagacaaaagattttttgttctacgctgaagttgattttgtttggtagagtgtaaggctttgctggccacttttatagctaacctgtaccttttccctttcttcttctcctgaaggttgcttcagttattaacatcaaccccaatacaactcactccacaggcagctgccgttctcacactgctctacttagactcaatagcagcaccattaagtatctagactttgtctttgctgtggtgagtaacagattttttaaagttaggttcattctcttagaaacacatctgaaagtctaaatagttgcatggggggaggggggtatttagctttattttccagttctacagtactcaattataaagtgtagtccattcatccctgttcatccctcagagtctgtgcaatggtctgtggactggactcttgcattaatgttcaccaagagtggccattttaccattagagagactctagggtagaagcaagaattaactcacatcaaaaaaaagaaaaaaacgaaacccacaattgtctaatctatccatacataagtaatttccatgataattttttctctgttattggttaggtagtgctcatgtttttctgtgatactatttgaagccatttggaggctatattatttgtgatagtgtcagtaataaaaataggtaacatctattgagtacttactatgtacaaagctctgtgttaagtgtgtatatgaattcattaaatcaggacaatttataatggcagcattcaggtttttgttgttgatcaagagctgaaacctaaacagaaggttttgggttaagcatacctgttctacttcttgctagcataaattaatcatcggggatctttatttccaccttctcagaagcaactattattcccataatttctgtgaagggatgtatgtgtgaacatgttgtggcaaatgagactggtggaatagaagatagctgtaagtgagggaaaatgttgaaccaccaactattctcaaactaaaaatattgtataattagataaaaaccagttctgtttttaaatcagattactgtgtttggggatggggaaataatctcaacatctgatatataaaaagtaggtatgttgttatttcatatgtgatcttggtattttgagtctaaagcacatttttctctttagaatatatgccgagtaattgaggattacattaggcacttgtattttggaaaggtttacaaaaatgttcctttttccagcattcaaataattcctctgttaaagtaccatgtgaccagtgaattactattgaaaatgtctaattgaatttgtcctctccagtatggtaaaagcaagcctcaggcacattctcttttaaagttacctaataggggttatggtcaataagaacaaggaaagtagtattttgggtttattccctttcaagtgattgagtttgatctttctagctgtggtagactcctaaaaggaacatgatttctcttgactcttatacggcaatgtttagtatttaagaattacaatatttaatttacccagcaggctatcttaaaacgtaatccaaaatagtgacattttaatcatgctacaggcactctgaaaaatcaagagacacctgcaatgtccccagagttcagtggggcccatttttgccttcaaccctgtcatgatagatgctccttaggagaatttatagaattcgagtgcgttatgtgcaggctgctatggtgggttatggagaagaaagccagtattcttaaagtgcccacagtttagtggtaatgggagaaatctgcaaataattaccatttttgtgaaaggcctacatgccatgccaaggcttttgaactcgattctgtaggcagtagagtactgtggaaggtgtatatgaaatgggatgagtgccagaccagagaatagtacaaagtgctgcaggagaatggaggagggagaggttaattccggctggaggagagtcaggaaggtttaatggcagagatggcatttgagctgggccttcaaggatgggtctgatttgtattggtagggagataaggagagtaagtgggaaagtgcaggttatccctggataaagggcataatcaagaccagctgggagaatgaggagtgttatatgtttagtgaaaatgtggaaaagtcattgggacaaattgtggagtcttgaatgcaaagccaagatgtagcctaagtcgaggagggatgtgatgaaggtgtgaagtcctccattatgcttcttcctgaaatttctctgaagtctgtctcctagcttttactccccattgcctttgctctgggtccagtccacattacctcttgcctggaccattcaaacagctcctgcctgattgctcctcttcctcaccttctccattgttctacatcaacttaaccttcctaaagcacatctctccatcagtgtttctctctttcttttctttctttctttcttttcttttttcttttcttttctttccttccttccttccttccttctttcttcttttccttcttttcttttctttctttgacagagtctcgctttgtcgcccaggctggagtgcagtagcgagacctcagctcactacaacctccgcctcccagattcaagcgattctcctgcctcagctgcccaaatagctggaactacaggcatgtgccaccacgcctggctaattttttgtatttttaatagagacgggatttcaccgtgttagccaggatggtctcgatctcctgacctcatggtctgcctgcctcacaatgtttctcttttgccaacaaggtaacatctaaagtccatggctgggtagttcaagccttcttttctcccatgcaatgcagcctgcattttcagccttcactccctctttatgaaccttatgtttcctttagttccttcagggtgcttccctcatcctgtcctctgtgcacttcttgtgaggtaggagaacatagtaataataattacatagactccgcagccatactcccaaaatggggatgataacagcacctattgcataggagtgttgtacttactcagcgaagcatcatatgtaaagttttaagaacagtgctgggcacttagtaagtgctcaaatgctagcataaaaatttgagattatgcttattttctaactaccgttatttatactcttgctctctcaaataccccttttcccacttgtttcctaagagaatcctgcccggttcaaaatgccccatccctaagctggcattactttttctcctcccttatttggaagtgatttctctcctattttcatgacttctcactttcttttttgtaatatggttgtttatgtgtttatcttaccttccctggcagattgcaaacagggtgaaggcaggattgaagtgtggttcattttggtagctcctggagtacttgcactctgaaattattagaatgactggctgatcagatgagtacttcagaaagataatagcagtgaaaaggaaagattaggactggaggggctgaaaggcagggagcccacttaagaggctgctgtgatccaggctagaggtggtgagggctcagcaagtgacaggaggaataaaattgaggccataaatcttcaagtgtctgagatccacatgactacacctgtgctccaaaagttggaaacaaaatacagaggaaagggatttctgtcagattatgagttctcttttacttagttgcagtttattctaccgcatgatttcttcttctgtgtaatagtgttagattgcttttcttctgtgggtattaaccgtatctgttatctgtagacagttgtgaaatgttaattaactggaagctctttttcaaacagaaaaatgaaaaccgattttatctgaaggaagtgaacatcagcatgtatttggttaatggctccggtaagcaaagcactggcctggggaaaaagactgtggattaccctgaaggattagaaattacaatggtcttattaccaaatagtgccttatttaatgaaacagaagatgctatgtaaaaagtgtaccttgatcataccttaaaatcagtaacttagaactatgatgttctgtctttttctgtatcccattttttcaaagtagagtagataataattaaggatatgactgatttttagactatagaaacatctatagaaagataagggaacctagttatggtaagaattgctttttgtgggttgatcttgtcccccaggccttcactgaaaaaccctgaggactgttcctttttttttttttttttttttttgagacagggtctcgctctatgcccaggccagattgcaggggtgtgaccacagctcaatcccaggttcaagccaactacccacctcagcctcctaggtagctgggactacaggtgtgcaccatcatgcccagctaatttttttttgtattttttgtagagacagggtttcaccatgttgcccaggctggtcttgatctcctgggctcacgtgatctgcccaccttggcttcccaaagtgctggaattacaggcgtgagccactgtgcctggccaactttcccatttttgatgttgataggataagaagttactaacctgtttcttttctttgaagttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacaggtaagaatcaagcaaacttcattaataatttatgttcttatgttgacaggtggcttttcctttgaatcatagacatttaaacgttgaaatagaggaatatgaattcatagccttgaccaaattgtgcaactctatatttggctcatcattttgctcaaccgagatgtttttgtgatcttaaaatcatttgcaaaaaaagttcttaaagctaaaactgatagaagctttaagtgagctttatttgaggtatgggttttagtttgtagggaagatggcacttgggagcagcagctttgagcatcttgcatctgcttcctgaggccgtcttctcactggaaacattttcatacctgaatgaaagcagtttggtctgattttgttaagacaaaagataaagagcggtagcaaagcctcaaatatcatgaactatgtttttaccagccaaaacgatctggagagttttcaaagcatgtgccagtgtgaatgacgctttttgaagatcactcagggataatggtggtatttattagatttttaatgaaacccttttgaagggctcattataatgtgttcatacgaatatgaaagacatatttggcattacaagattaaaatttgcatgaagaaaaaaagcacataaaattccttaattgacttgtccttttaagcctattacctaaaattgggggtttgtggatcacaactctgttgagcagagctagctattccaggcatccacatccttttcaaccattaattctatggtttggaaggaaatgtggaagctgtgtttaaaagcgaatatactgtgagccattcgactacttttgcagtggtgttgaatacctagtctgacttggttaggccacaataaattgggctctccaccctaccattcttgcgattaaagacgttagttacactttaaaaatattttcaagaattcattttcccttttgtctgttttgcttatgtacttcaattattttgatcctttagtagctttatttttggactttttatctggctccccttcattattcccctaattttaagtccagatttgtgtttacagtttaaaatcgtttgcagtattagtatcatcacttcaagactgtttatctagtcacctgtaatagagatgagctgtgctctttctcttactttgaaactttggtttttatgtacatagaattaaaaatatcacccaaagagatatacagcatttaatactgatattgaatgtataatctatttgtggaactaggttcttggctgtgggtacctataaatacaacacataggtaatatttgactgtatggggaaagaaatagaattgcaataaggcagaagagtgttgattggattttactggatcagaccactttctagaagtagaaaaaaatagcccccttaggctgccaaccctgaccagataagaaatgcagtaagcacgctcaaattagtaagaggtcccagttttcttgactttgcagccactaaaattgtatgtactaagtcacgatctgcaaactttaaagttccaaacagtgagtgttttaggctttggtgccatatggtctctgtcacaactatttgaccctgctattgtagcacgaaaacagcaacacataaacagatgactgtggctgggttccaataaaaccttatttatggacactggaatttgaattttatatgctctcatgtgtcacaaaatatttttttcaaccatttaaaaatgtaaaggccatttttagctcttggaccagatctggcccatgggctacagcttgctgacccctgaccctaaagacagagccagcctggctattctcatcacatgataccttcctgatcctgtttccactttcccaaaagacattcactctaccactgagaggctaatctggctatgtaaaagtgggctagattagctccctttatttctgataaagtaatatgcctattttggaaaggacttggaatataaacaaacatatatgtgtgtatgtatatgtatatgcacacatatatatcacatataaaatatatatcatatatataatgtgtgcattatatatcatatataatgtgcatatattatatatatgcacacatatacaatgtgcatataatatatgcacattacaatatgagctgtgtttatagatgtaaatgaatatacatgtattcatatatatgaatatctgcatatatacacataaacaaatgaaaggacaaagaaagtcttagaattttaattctagaacagttctccattttctatagctttatcataaaaatatacctgtcttagttacttgaagttgatcttgtaagaacatttctgacttttaaatcaacatctttgacttcgagacattcttttgtgattatactcattatttattacacactttttctcacctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatctttttttaaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcattatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaatttgcttaccttttttcccgttggttaaagtcaagattttgtatactacataatggcaatttctttcaaatggaaaaactttagaaatgtttagaagtagaactgaattatttgcaaaatgttctgatgttctgtctgtatattaccatctggaagaatagtcccatacataggcctcgattgatgctaggcaggctacagaataagattaacctgggaagcgttttataaaaatagattccaggctgcatccttagaggatttaacgtagtaggtctaatgaggagacagagagagagagagacagagagagagagagagagagagagagagtgtgtgtgtgtgtgtgtgtgtgtgtgtgtgtgtgtgtgtaagctcccctgctgaacctgatgcatagtcagttagggaaccagtgatctagaatatttatttcataataaaagctgcggagtatctctttgtacacttttctcaattcctaagttgaggttgatattcaatatctctacatagtagctttacattgcagccatacatattgagctattgatctgaaccaacgtaggattgtgtgcagtctctctcttacttagatcaccctaaaatacttgagccttccagtttccatatacggatagttacctagtcaccttactatatcacataagaaaacttagcaatgtagctggtaacttttctctgaattacccagttaagccatgtgaatgccagttagtcatcacggctgcaaactctgcagttaactaccattgtctttggccaagttgtttaacttctagtgtctcaatttcttcatccagtgggtggggtctttaaaatcctgctactcatttctttgagtgataatttgcatttcagaggaatgcatcatagtatttcatacatcttagtattttagaaggaatctgataagctacttgttacgtatcaagaacatactataagttcagtgtaaaatgtaccacttaagtttcctgcagtttttcaggaggaattcttataagacttggacatttttaagatgatagtatttcatctgtttatttaggtagataatgttaaattgtcttgggctcatcttccacccatctccttttcttttaccctggtagctaactttctgcgttaataatcaccatttcttgtatttgaaactggtatagatattcatgaatgatattgagtagcttcacgaatcttttcagatgcatgtgatttacttaacacagtttgattatagatataaaatgtatataacaaaatatcacctaagaatgtgcttcttaatgtggatccttccaaaaagaagttttgactcgtttgtttgtttgttttgttttgtttgagatggagtctcgctctgttgcccaggcttgggtgtgtatagtggtgcgatctcagctcactgcaacctccgcctcccaggttcaagcaattcttatgcctcagcctcccaagtagctgggattacagacgagtgccaccacacctggctacctttttatttttttagtagagatggggttttgccatgttggccaggctggtctcgaattcctgacctcaagtgatctgcctacctcgacctcctgaactgctgttattataggcatgaaacgctgtgcctggcctcaactggtttttaagagaagttttattagtttttgttgtaaatgtatacctcagctttccagttcttgtgttgaaaattgtgtttgaaaaatgtctgaactggcagaaaattgaagattaacagcatttttaatctacatgaaacttcttactgaaattttagtggccatggaactttttaatctttaaaaatctttattgcttctgtggctattaaattcttctgcaaatacacttctcttttccccagaagcattttcaatacagcgttaagtatacattaggcaagtagatcagatcaaaatgacttataggatgagattttcttttcttcagaatgtgatcccattaaagttactgttttaccaacattttttccattaaataatttttaaaagttgaattcatacaatcaatagttattataaattaatatttcacatactaattgagagcattttaagtaaatgacagtatctagaaagatctttgtattagcggaattgcctttttgagctactctgagaatatttgtcttacatgaaagccttattggcagtatttatgaaagtcgtttcagtactaggtcaaatacccaatttgggaaagagagaactatgagtctgttgccagaataagaaattaatctactaatgaatttttaaaaaaccaagttatattaaacccacggcataatactttatggtacatgtcacctaatagtttatgggctgggtggtaatttgggaaattgtaggggaggtgctaactggggattcttaacaccatctattcacaggtcacatctggcagcctcagctctctggattcttaacagaaccaagaagcaagtaaaacaaataattgaactggcagcccaagtcaatgtcagaaaagtttataaactccagggttgcattttgttcctagttattgccccagaggctagtgggggcggcggggaaagcttggcacatttcttgaatgcaagcacaatcagaattgccatgcagcctatttgtcctatctttgatacaattctaataagcttagttatctgatttatcagtccctggtagactgcaagctaggcagagaactagggcaacaagacacaggaaatgggaaatagaaatagcagttaacttctttcctgcaagtgtatccatctgtagcattccttcctcctctccagtctcagagtaggttttcttttcctggttaaactgaggcaaacagttatgtcatcaaggcccatttatatctcttttcccattactaagtgaccccagattgttatgtattgagttcttaatgtcttacgcttttggaattcaatctcttaacttgtaggagaacttgtaccattcagcatcttctgtcaattgctaatggctgtttccctcatcctatttaagttcttctaaccttaagctatcctttcttgtccctatgtcccccttctaattacctcccttttgtcctgccttaatcattctaaacttctcaaaatgagtattgtatttgttaccctgcccaagttcttgatgtcctaaccaatcacttcccattccctcttaaacctgcagcaattttactcatatctcccacccttcatattgctagaggcaatggacatgtttcaaagctttctactattatttgctgtctttccaccctaattgaaacgttccatccttagcttctctggcgccattttctatctgcccttttacatctttttcctactccattgtctatcccacaggtattggtgttcccaagggtttttgtctctgatcctctttttattctacttccccttactgagaaatgttcttgcccatgttttaactaccacttaggttcatatagccacttggttaggacatagtgattttttttttttttttgagatgggttctcgatatgctgcccaggctggtcttgaactcctgggctcaaacagttctcccatctcagcttcccaagtagctaggactacaggcgtaagctaccatgctcaactaaggacacagatatcttaaactcacatatctaaaactgagcatctctctcttccacgtatcctttttaccacctgttccatataactacaaaaaactgaaatgcatatattcttcctcttttatagaatggcaccagcatctacataatcagtcaagtgtggaattggaaaccattctattatctcctcctcgtacaccccctacatccgtttggtcaattttgccttctaatttgatctccagtctgtgccttctgcttttcttctgcacttcattaatccagctcaggacaatattattggttacctggactctagtgataaagatatgtcctaccttactacctccatctgccataacttctgaaatgaaatcctgcttaatatcctgctgctgaatttttttttcatcaggataaggccagactacctaagagcatatagtacctttgtgacctgggtccctgcacactttttctgccttctatccagccaaaaataccttttgatccattgttctagctctgccaacctgcttgcgtttcccttgaagtgctatgtctttttactctccatatttttgtctgtgctatttcttatacctggaatgcccttcccccattacttgcatcattaattcctattcattcttaaaatctcagctcaagtgtcaccttttcaaagtgtgtcttatgtaataaggctgaacttgagtgtgcctctgaaatttttccatggcactttgtgttgcctactcctaccacaacacattttgaaattataaccactgatttttcttgtctgactctaacactagactgagcatcttgaggcaaacagttatgtcatcagggcccacttatatctcttatatctcttttcccattagtaaatgatcccagattgtaatgtattgagttcttatgtctgctttgtatagttgttcattcagtgagttaatacttaacagcaatatttgaagcattgtgcttcttcgacatcataacagtttgcctctgaaagctcacggcctgatcatcaaggcaaggctaattagatttgttcattatgttctgtttaagaaatctgggaactatgtgaccatgttatacatttttcatccaaaatgactgcatttttacttggtacttaaaagtgtattatttggttatttggaaaatcacttttgtggaacatctcatttgctgataatgaaatgccaatgacttgttaccttggtataaaaaaccaaaatatgcgtgttaggaagtgctgtcattttactcaaaatacacagatttgaaagtttgtcactgtttctgttctcaattgtcctttctccacatctagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgacgtatgccttgaacttattaacatggccattataagaataaaatatgtagttgtgtcttaatggaattaataaatgtcatttcactactggtgttctgtttcaatgtataaggactatagtgatttaaactcatcaatgtgcctttgcataaagttcattaaataaatattgatgtggtataaatgcccgtcagatatgcttaaacttggttttcagttgaatgaagtagagaatgtcctcaggaccatcagcattttaaaggttatgtgacttttgctgatttctctgagttcaagttaagcatgaagttagtacctcaagcctgtgatttttccctagggatgatacagacccaagaggctacaacagaacttaaactggcttcgtaattagagtttttaagataattgtttgtttttcagcaatatagactgaaaagatccaagcatatttagccacttgcttttttgtttcttgttttgttcttctttggatgcctgattagtattgaaagatagaaatattctatgaactaattaggacagattgtgttgtgtttctctacctcatcttgttgatctctggagcattaaaatctatttagtgttgtcatcagtgtggtacttatgaaatgtaagctaacagcaatctcagaagggaggcagtgaagcatagcaactaggctcttgtttcttcaagatggcccctgtggggcagtgcatagatgggggtgtaaagagaagctgttggcattaaaatgagctagataatcagcccttgttgaagcatattccatggtataagagtagcacagacatgaaacatagataaagaaggaaggcttaatagactagaagacttccacattgaagtattattaacccattgtatgtatataggggcatgatcagagtctctataacttcctgattaacaatacagtgtatcttgttacccagctgtcagtctttgagagctttcagtaaaatatagtaaattctttcagcataggctaatgtgtggttactgagatgagtgttgtgtactcagaaccgtagcaacatttttatgaatggtaaaagtacaagaggaggaaaagttaaaattagaagaaaagtacaagttattgcttaatcataaatcacaccagataacacattttgttaatttcattagctattactggaaaggaccttaacgattatttacagaaaggggagtgaaattcattgaggttccatatcaagtgggcaacaaaactattactagcattttgataaaaattgcccctaatgaaatctagtcactcaacagtaaaacaacagctggtttacacttgaaattatgagatcagaattgggcactttgggcttccgtactatgttttgcttaagttttttttttaatactaatatgggctttttcagtagtaatataccaaaacacttctattttaatctctgtttgctacttcaaaacctaatcctcctcagatgggatcatgagcataagaggaaaagagaagagaatgaatacttgttgacctcttgatgtgtatcagatgctttagaaatgtaattgtatttaatcctcaaataccttataggtattattatccccttcttacagatgaggaaagtgaggcccagtttaaataacttgcccaaggtcctttggctagtactggaaggagtcaagatttaaacacagttctgtctgaatccagaactcaaaatctacattgcacatgttgctttcctggtggttcggtggaatggactgcaacgcattagatactgctgttattcttccaggccaccgctcagctaaaaataattgtgtgtgtgtgtatatatatatatatgtacacacacacacatatatatacacacacacatatatatacacatatacatatatatacacatatatatacacacacatatatatgtatatatatactacattcttgatcctaagtcttttttaacttaaattttattacttatacagaattcttatttatactttaattataggtgtgacgaagagaaagagagtagggaaatacacaggcagtggttttaagtgtagatgatggctccttaacccagtgtcattagataatcaaacctaaagtcttcccatattaggcaagcgcaattctctattttggacccttcccattcttcccttacct

SEQ ID NO: 16632 - DNA, 42479 bp, Human; identical to SEQ ID NO: 16631

SEQ ID NO: 16633 - DNA, 39251 bp, Human
taaaaagtccttttcttcctatcttagctcgttttcttctcctttcctatcttaacatagggacattcctctccagcagcgggcataatggcatgattatgttttcctctatttagggttactcccctagccttgcaaccactccttattctttcatctctttcaaagtttctattctcccggacccttacgttttattccgtccctccctctctcctcctcttcctcctcctccgttttcccagctagctcactccgcccctcgccgtcactaccttccctcccccgaggctccttcccgctcctcccgccaccccccccaccccctcgccttcagaaagctccaatcaggagctccgaaggtgtctcgaaggcccgccccctcctcctatccacttttcttccccccaatttctccctccccccttcccccccccactcaagtcctgcggacctgggggcttcgggatctgggcgctatgaaaagtgtctgcccagtcacttccggtaagggcgctgcggcgcgaagcttcccgcgggaccgttaaggagggagtgggagttcccggtgggccagggaaggaaggcgctgccaggaaaggggatcgcgaaggggagcgggagcaggagcgaactagcgcgagcgtctggggcactttagccgcccctttccagccgccccctcacgcgcgagctcccccgccccccgggcggctgcagcgcttccctcacccccactccctgaggttgacaccgcccctccctcggcgccgcgtgaccggaaatggcgccatctttagcctcttgtgctattgacaataacaagccctggttctttccccctccccctttcccccaaccacagcctctcccctcccagggagagggagaaaaggaggaggagctgcagcctcacagactcgctgagtcgctcctgcagaaagggggggagagagatcgaaaagcaggggagggggacggcacggccgtttacctgtctgcctcctcattcgctctcccccctcgttctgctcactcctggtgtcagcctatccgccttcccaaaccctcccattcccccggtgtagccccccccttcactttccttctcgtcctctgtgtttctcctctcttctttcttcccttccccctctagcattgctaccttctctcctacacgcacgcaggcatataaacgtaggtttttgatgctcctctgcctgttgaccccgctattttcatgtttccaacaggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaaggtaaccaaggccaaaatccataatcacctaataaggatttgacactcgaggggtcacgtgctctatttatgttaatatattaaacagtttggaggtggcctaatgttttatgcataatcaatgaggtggaggggaggtccttttttggtggagggttcattttccgggggtggttaggatccttgtgctgaagcatacaccgggtgtttctgtgcagtattttgaggtctttttcaacctattgtatttaatctgttattccttataacactgacaatcggtatgattgatccggattttgcaggtgagaaatttgtattctaaagaggtttatttatttcaggtgcatagcgagccttggcattgctgggatttttatttttatgcttcagtaggccacattatccaatgcctagaaatgcaggtagcaatagtgatctttttatgctcaaataagatttataattagatttatactgtattcatgaaactcatttggaaggaatatttgaagaaaaatttatgttctctgcatttctttccaaaggtagggtttgaaagtgaaaaacattgtgtatacacagaagtagtaactctgtgtaccactagtctaaagataggaacaattactacatctattttttccatcactaaaatggattttaaagtatcgacctgcagcttttaggaaaatttgttcagaccgtgtttgagatatgtgaggagagtattatgaatacattgaggcaaatataaaatcagcaatttttaaaaatgtatttgagctgaattaatttttatttgttgaatgtgtttctgtttttctgacttactttttcaacacccgtaactgccaggtaatcagtgctacagtgtttattaaatagagaagtaaatgaatgaacttaagtaatatttatgagataagtgctttgtggctgaatattagtattgagaagattaggttctctatgcttgtgtttttaacattgtgtggaaatcaggagtatgctctattttgtctcaagcagagggctatggtgttgtctatttttaaccctttcttttttatatcactaccttcccatacccaggctctcagtttctgatttaatagtagagctttctgaagtcaatatgaattgtaattgagtaacgttttcattatttcacttaaaaatatatggattttgtagctaaagatttttaaatgagttatgatcctggttgcattttcaaattggtttcagagatttttttctctccctcctaaaataaaagcatattattaaggcatttggatattctaattaaaacttttttccccacactcattgctagtcagtgaagtttaaagcctagagtaagatgtttctttctattctgaaaatgcaacatggtttctggagtcatttctttcagtctttaaaaatttcactctgctcgtaaatgtagtttaaaacctgagttaagatgtttccatttctatagatgctgcataaatgtgggggtcaaacagacctgaattagaatcccagctttgccattgactagctatgatgaccttgggcaagcttactaaatgagttccagcctcagtttcctcggttgtaaaatagattcctcagggtattgttgggaagattaagaggcttataaagtaccttgcacatagacagtactttaaatctcaggttaaaaattcatgtcgacttaggttttacacatgatgaaataagatcaggattgttattttttatggtcattcttgaatttttatttttttgaagcaatacaatcaataggagaaaaacctcaccttcaattttaataggtgagtcaaaatgacttaaacagtattatggcatttcaaattttattctttatattaagcttaaatacagtggttactttaatgattaggtgtaatagttataaagatcacaatttaccctaaaattagtaatgctattatattttatgaatctttggttactgtatctgacatggtattctgatgccaaccttttacatatcatctagataagcctaaattaccagaaaactacacagatgaaacctggcaaaaactgaaagaagcagtggaagctattcagaatagtacttcaattaagtacaatttagaagaactctaccaggtatgtattaatatgcataaccagatttgattaacataaattgaggtgggatgtatatggattttgctttctgaaataggttcttaagtagacttttggttcccttctaattttagtttctccattaattgatgaactctataattagaccacgtattctcacataaaccatgggtacagtcataccagtataagttgtgcttatatttgaccctcctgataagaaattacagttacgtgtaccttggtgtaatagaagttctacctataatgtaatcctatagcatgaatcccaaagatgatttctggtgacatgtcattctattgtgataattgtttcttagttgtgttacctacccataggaaaggcctcaagacatgcagatattattcatatcctttattctacctccttcttaatagtagactttgccatttctttttcttgctctttacatttttctaatacctgggctacaagacgcaccttagcccagaaatgagtagcagtttgtagtccagcagcttagtctgaggttcagattctttacttagcaaatgggtccttacacttaaatataattttaagggcagttcctaagggcaatcccttgctaccaagaaatttttccctactgtgtatttgacacacaaccaattcaagaagttactttcattagagtgtcagggatttggtgttaaaagatacttcaggccgggcacggtggctcacacctgtaatcccagcactttgggaggccaaggctggcagatcacctgaggtcaggagttcgagaccagcctgaccaacatggagaaaccccgtctctactaaaaatacaaaattagccaggcaatgtggtgcatgcctgtaatcccagctactcaggaggctgaggcaggagaatcgcttgaacccaggaggtagaggttgcggtgagccgagattgcaccattgcactccagcctgggcaacaagagtgaaactccatctcaaaaaaaaaaaaaaatatatatatacttcagagtacaatagcttgaatttttgtattgatgagtaccttgtaagaaattatgttggttttatttatcagtatttgtatattttagttgcagagctagtatggtgatgggtaaacctggattaggagtcagaagatgggtttgggatctagttttgactgctgttaccctcataatcttgggccaggtactaaagccctctcagttttttttcctgtttttttaagagataggggtcttgctatgttgcccaggctggtcttgaactccagggctacagcagtcttgtcacctcaacctcccaaggtgctgagattacaggcatgagctaccaaacccagccgtcactctcaatttaaatttcctcctctctaaagtagaggaaataatagtttgccctacctgtctcacaaggttgctgataagaatcaaataagatatttgtggaaaacgcctccaggcactataatcttacaaatataagatggtatcacgagtcaaacttttttacaagccacattatagcttcttcacttgtagtatgacaattgagatcaccagtttctgttgctgtgaaaattagtacacgcaaaatactcaaatcagtgcacaacacatagtaataatgccgtgtaacattataagcattataatgctatgcaaatgtcggctagtagttgtagtactaagctattacttaagaataagcccatttcatatggctcttttggcgtattatatatgcgtctcttaaaatgtacaacaataaaagccaaaatatgaaactgacttggaaaggccttaagagagcatgtggtccaatattttttctttgtggtgtccatgacagcctgcaaaggggattcatctcgtattatctcatataagcattatggaaaccctttctggggtacgtagggtagtagttactatccccacttttttttttttttttttttgagatggagtcttgctatgtcactcaggctggagtgcagtggcgtgatctcggctcactgcaacctccacctcccgggctcaagtgatcctcttgcctcagcttcccaagtaggtggaattacaggcgcctgccaccacgccctgctagtttttgtatttttagtagagacagggtttcaccatgttggccgggctgatctcgaactcctgacctcaagtgatccacccgcctccacctcccaaggtgctgggattacaggtgtgagccaccgcgcctggcctatccccactttattgatgaggagactgagtctcagagaagttgaataacctgcccagagtcacatattggcagagcaggggcaactcaaactgagatgctggatttctagttcattgcacttttactcctgtaccacctcactaatataccctggtactttgaataccactgtagtgcagtgtttgaaacaattaaattgttttactttagggaaaaagctctttataattttagtagtatttttatctgtgcatgcataagtggtgtttatttggatagtatatggtgtttatttggatatgctggtatacagcatatttaatttcaataatattttatatattccatatttgtaacaaatgtttattgtggttattaattaaccctatttactttaccttgaatatttttccagagcttttgatttgaaaatacttttcctgatacattgattctgttaaatctttttctttcaagagcatagagcttgcatctcttgtttttgttttcttgtacttcgtaagttttacctgctgttgttcagttgcatttctttagcctagtcacaagtcttataacttcactgtttgcatttttcataataccttactgcttttgctataatgaattcaaaagcattggtttttagctcttttactgtttttgaccttaattttataaatgttcctttggattgttctcagaaagattattttgagatgttcaagttcaaacaggaggataaaggaggtaaagctatttcatataatctggacttcaggtgcttgtttgattttgactcattgaaacgtaattagaagtactctctcaatctacctgagtgggaaataaaaacataagaaaaagtactcttctaaaattgaaataatgtggaaatatgtagttatacaaaagttctccaaacccctgtcccaccctctttctctgaggtaaacacttactggcatatatctgcttagaacttacttctgcatgaaaaaacattttgctttaaagctttaagtatggaagtccctagtgtgggttgcatgtactgcctactaagtttttaatttctataaaagaacatgctgttctaagtacacttgcagtaagcaaacattgtctttttaaagtaattttaaattagaattggacctgagttttaaaattatctttccttgacaaccttgagatcctgtgggtgtgaggcagtgattaatgttttcatttgactgttttgtttgtttgcgtgcttgtttttaattgactgcaaataagactgattaaatgcactgacttttgagctgtccagcctgccttaggttacaaatctgtcactcatcatataactttgggcgagttacttctctaagtcttggtttcctcatttacaagatggtgagactaacggctacctatatggtagggttttttagacgtaaatgaaatattgcaaaaaagtaattatcacagttcctgctatatattggtatgtgtcatcaatgatagtagatatttgagtctttagaaaagaaatctttattttaaaattacattttattttagagctctgaagccacacgattttaaattctaaatctacactgggccagagcagctgtctgataaatagattacattccaaatgtgcttcagtagacaccattagcgaaattgaaaaaataatagaaaaagacaggaactctctaggaacagtgtccctctacgcttaaaaagaatgtgtcttgttttcacatgtggtatcatacagttggaattttggttttggtgtgagtttttttactattaataagtaatattttaaataggattattttcataatcctattatgagctcatgttctcaacttttgtatgagtagccgcagtgttttgttttgttttgtttaaatagagatatgggggtcttgctatgttgcccaggctgttctcgaactcctggcctcaagcagtcatcccgccttggcctcccaaagtgccaggcttacaggcatgaaccaccatgtctggcctactacagtgtttaagatcagctaccttttttggagatgctggaagtttgtacaggagcgtgtaacatttatctttcctataaatctctagctatttttaaagtcaagcctaggccatacttcaattctgatgaaaataattttatttattattaataatgggaactgtagttacctttttgtgaaataaaccttaaatgatgaacctttctattaacgattcatttatagagtagatgaccacaggactagaatcaaatagtataggttattatcaattgtaaaatctggttgcttaagcagtcagtgattattaagaaagcagttagattcttagcattgttgatgactagctgttggagtctgtgtaacttttgtcaccctgttgatgtcttaaagcttagtctattatgtattatgtatttctctttttactgaatcgttaatcagtactattgttgctgttttttaaaatgtacaactaaaattctactctttgttattttgaaatatacaatagattattaaataataaaaaattttaaaatgtgcacttacaaattcttagtccttgataattttcagtcttatttaagtcctgtttactggaagtaaaaagaaaaggagtttaggtttcattgtatagttggtttcctttaaacagattcttagtttttgaatacttagagtatcttagccatatttacttgacataaaaagagagataatgtagatcttattgctatatcagttgttgaattttttgttatgtgctttacttactatctgtaaacatagctcgaaaactaagactccactccttagaccagtgaccagagttcaacaccctggtggaaattcagtatcttttttattgtctgttgttcagtaaatatttgcatatgtcatttgctacacgtttatatatattttttgactgtgtttttttttcagacacttttttttagctcatccttgtgaagaaagacacattttttatgtatcctgtggattttggaggggaagggctgggatttggaagaataagggttagaagcttgctagaatgcctgtattttatacctaagtaccttcaaaggatttaaggcagcatatttactggtaattagtgggagcttaaataaaaagatagttttattaaaaagacttgtaaggctgggtgcggtggctgacgcctgaaatcccaacactttgggaggccaaggtgggcggatcacctgaggtcaggcattcaagaccagcttggccaacatggtgaaacccagtctctaccaaaaatacaaaattcagccaggtgtggtggcacgtgtctgtaatccgagctactgggaaggctaaggcatgagaatcggttgaacccaggaggcagaggttgcagttatctagaatctgtttattacaaatagttgtttgtgaggcaagaggttacttccagagattcccaaagtgttttattagtgtaaataataaatacgtaatgcataatatgtaaaaatacataaataatacataatatttaaataaaacaatgcataatatgtaaaaatacataaataataaatacataatatttaaaagaatatatttgtaaaagtgcttttcaaagatctagagtaaaatagagcttatctcaaacaccttcttattcctgtttccatcccagcatgtaataggatgaagagtacttagtaaacagtcattccttgttcaatccatgactgcttactgtgtccaaaactggactgataccttggggttatggaaagcacttagtactagtaagagagcataagtacctaccctaagttacttatgttctaataggttcatgaaattaatagttcgtgaccagcattttttaaaaagaaatgaaatagcaaatatcagaatgcatcacatagagtaatgatgtgtaggttcgtgaagattttattttagttacataaatttatgtatgatggattgtgacattagatttcctactgtggctttgggtcaaaacattttggaagccactgttttacagacaccactccaaatcttgcctaaaggtgagaaaagtagagtacttggatcaaaggatgtgtgaaaggttataatcgggtggccaaggtggctcatgcatgtaatccagcactttgggaggctgaggtgaacagttcacttgaagtcaggagttcgagactagcctggccaacatggtaaaaccccatctctactaaaaatgcaaaaaaacctagctgagtgtggcggcgcatgcttgtaatcccagctacttgagaggctgaaacaggagaaccactggaacctggaggcagaggttgcactgagccaagattgcaccccaatctgggcgacagagcaagactccatctaaaaaaaaaagaaaaaagaaaagttataatcagacatgagatgaaagtggtaagatttgccttgaacaccatgctaaaaagtatggtggtggggaagttagaaaggcttttattggggaaggcaagtatttaagttttttgaatacctgatatattcctctggttcaaagccccgaaagtattgcagagcatgtagtgagaagtctcacttccaccccatcctccagtcccctagttagttctctttgtgacagacattattagttttttgggtatctttccagagatgttttatatacgtaaaacgactgtgtatgtttttattttgttccttttttacataaatgatagcagaccatgtaccggatagttctttttgtttgtttatttatacctattacgagattgctccatcacagtacaggaaaagcttgatggaaggttgttgaggaaggaaaatgactagatccggtctataggttaagcagtcaaggctaaattagaaaaacagaatgttccctccgaacttgacctcaaaactcaccttagatgctcctgcctttcttgccttaaagttcttaaaccaccctccagccaaacacaggtgagactctgtgctgtaaagcccagcttaattctcgatttctcactatttccactaactttttatctgtttccctgtgggtctttgggactctgtccctttacctcttcccaggaaggcttttctgacttgccctcccctaaatgctgggttaggggcctcatctctctgcttatcctcatcatagcatctagcacactcaatcgtaattacacgttttctggcaacttttctcatactagaagccctttctatgtgcaggacacattgctagagttttttttgaatacttcatgtattcacttggttcaaagctcaaaaagtattaaagaacttatagatagatgaacacacaatgtctttctgtcattaaggagtcagagagacaagatatacacataaaaagataagtagttttgtgtaagaagtgtccagtggttgggagataaatagtgttgactcaatgactaagtcagtgtggtatgatgggtgcgagtgccatgtgagtcactggtagctgagtcaattaagaagaacttattggaagaagtgggacctaattgagtagtaagggaatatggtatcttgtgtgagaagataagtagatgtgccgagaactgttttatttgagaagggaacatagcagaaggaaatgggataaataggacttagagaagtaccggaagtgcacaatgtggaaagatgaagtacgcactaagtcatatgacagaatctaagcaaagcgataagaaatgctgagaaaacagtcattcagaaggaacggtgagatacaatgagaggaatactaaaggtggaagggggacagtccacaaaggacctgtgtgaacagagaggcacatgaaataaatgtaaattcccttaagcatttgtggcctagccccaggtcacgtgaaaagtgggcaggccagcagggtctcagccttcttattcctccatagctgctcaatctaattggcctgctgtttcctgatgaggtgtggtgacttgtctcgtggtgtaagaggtttcctttaagctctgctctgctctgctcttctcttcttttttcttctcttctcgagacagagtctcacactgttgcctgggctggaatgcaatggcacattctcggctcactgcaacctccaccgcccgggttgatgagattctcctgcctcagcctcccgagtagctggtgcacaccaccacacccggctaatttttgtatttttagtagagacagggtttcactatgttggtcagagtggtctcgaactccagacctcatgatctgcccgcctcggcctcccaaagtgctgggattacaggcgtgagccaccgcgctctgccaagctttcttttcatttgctgatttatttactggacctgcatattgggaatgtgacttctaactacatatttttaaaattccactccaacccacagaacttggatgcccccctagagttcattttaatggaatttttttcttctgttgtggtgagaaaggaattctggtgttacatttaagtcattaccacttggaattatagattatatcagagttttcccaaagagttttagcatgcctgttgttttaaatttgaaagtcttttatatatgcataacaggaaacttacggaaatctgaaggtcatccttctggaatctgagtataaaagaagaccaattcagttattaaagtgaagtaaaaatgcagttctttcttttgtaattggcgttaattcagttgtacaaattttatttattttttattttattcctttttgagatggagtctctctctgttgcccaggctggagtgcactggtgtgatctcggctcactgcaccctccacctcctgggttcaagcgattctcctgcctcagcctcctgagtagctgggattacaggcgtgcaccaccatgtccggctaatttttgtatttttagtggagacggggtttcactatgttggccaggctgattttgaactcctgacctcaagtgatccacccgcctcagcctcctaaaccgctgggattacaagcatgagccactgcgcccagccacagattttaaaatctatatttaactattcttaaactgaaatgttggagaaaattccttggtattatatcatactcattatcatactactagcaataatttctgctttgttctgttcaggaaaatccaagaacgtttaagtaaattttaattcaattgtagtaggactgcccaacccatctgatacataaacaacaggtgaaattcttttttaaacccaaaatgaagctctgcttgtgaaaatgattaacattttaaacaagacagcttttttatttttgagacaaggtctcactttgtccccaggctagagtgcagtggcgtagtcatggttcacttcaaccttgaactcttgggctcaagtgatcctcctgcctcagcctcctaaatagctggaactacaggtacacaccactgggcccagctaatttttaaattttttgtagagatggggtcttgctttgtttctgtattagtcagggttttcttagagggacagaactacagaactagtaggagatatatataaaggggagtttattaagtgttaagttacacgatcacaaggtcccacaataggctgtctgcaagctgaggagtaaggagagccaggttgattcccaaaactgaagaacttggagtctgatgttcgagggcaggaagcatccagcatgggagaaagatgtaggctgggaggctaggcccttctctccttttcactttttttggcctgctttatattcactggaagctgattagattgtgcccaccaggttaaggatggatctgccttccccagcccactgactcaaatgttaatctcttttggcaacaccctcacagacacacccaggatcaatactttgtatccttcaatccaatcaagttgacactcagtagtaaccatcacagttgcctaggctgttctagcctggcatcaagcaatcctctcaccttggccccccaaaatgttgggattacaggcatgaaccactgtacccagcccaagtaggattttctttgagcagcatgttggcactcaaaaagtttcagatttttgagctttttggatttcagatttttagattaaagatgctaaacctgtaatttgttcttttttgatacagtgcattggttatgagaaagtttgccacccacattgatatattttgttgttttaccttgtgtcttaagtggatgaataaccctttttaataagctgatgtggtagaaatatcaaattaataagaatctgatgtaaatagttgagaaatccttcatcctctccttaagaaagtattttaaccttgcaggctgtagaaaatctctgttcttacaagatttctgcaaacttgtacaaacagctgagacagatctgcgaagatcacatcaaagcacagattcatcaattcagagaatatcctttttaaaacaaaaaatcgtgaatagttttgtcttcctctctgtccctacccctcactgtttaacccagcttgaagtagaatgcctgtattttgtaggtttgtcattttttgtgccttgtgtttctcgagaaagaaacacattttgacttttcagccttaattcgtgtccaggactacgtgtggtattcatgtaaataagatgtccttatgtctttatcctttttgccctatcagatttccacttgaggaaaaataatctcctaagggaaatagtaaactgaaaacacgatgttcagttatgtctaagacttgtttttaaaggtgttttttagtataaactatgttttttttttcttttacaaattaggaaatagcactttggtgcataatcaagtgccatttagtttcacttagtgtgcaaggtattcatgtttaagactaatatgctctctgtcacatggcacatatgacttgtaccaaacgctttaaaatatccttaacatatgtttcagggattcattggatagcgttctttttttaaagaagattgatagatgctggcaaaaccattgcagacaaatggtaagctggaaaaagtattgtatttcggctaaacattgtattaatagttaaaaacatttcttcaaatacaggaatgttagtttttaaaacttagcaatagggagattgcttcaatatctattccttttctttttttttctttttttaaaaatttatttattttttattttcccgtaagttattggggtacaggtgacatttggttacatgagtaagttccttagtggtgatttgtaagattttggtgcacccttcaccagagcagtatacattgcaccattgtagtcttttatccctcgcccccctcccactcttcctcccaagttccttttctgaattggaaactagttttggttgagttttctattttaaaaccacaagttacaggtaaacctgcatttcagaatgtcttgcaccttaggttcatttttatttttgtcacacttaccaaaaatgtatttatctcattcattaaaaagctacatttcgtctgtcactcttatttttttttctctcttgatgattatcctgtccactatttgattacctgtgaaggtgcctgatggtcctgtgttttagtttattcagataacaaccttttccatttttcttaatctggtttataccttatattctacagattaaaatcttaaaatccatcacccctccccacccccaccccctgccaataaaaaccctcacatgtgcaatgtaaggcagcttcattccctagcactgtggcgcaggaagaattatatgagcgtccccttgatttttcagttacttctcaagcagtaaatcagagggccattttaagtgtcttttttctagaaaacacaaaaaggattgactgttgagtaataaaaactatatgggcatattctcagatagatgtgtttatctgcatgtttgatcttagtaatgtaatatatatacagacaaactcttcagttttattcttattgaaagcaaatatttcagcttcacaacatacaaaacttgtttgatttctttttttttcattggcagatcatgatcaggagcatttttttgtttctggatagaacttacgttcttcagaattcaatgctaccctccatttggtaaggatgccagaaaaatatgaaaagattgttccaaatcatactcaaatcttaattacactaatgaaagtgtataagctatactgtgaatattctaaaaattcacatttggttctagactttcctttgtagcagttttatcttcctaataatatgttgcctatgctaatattgaagatagctaacattccctgggcatatattaatttatgaagaagttttttgttagccgaggggactaaagtttgctctggaatgtctatgattgtgattcattttgctgctgaccatcaagagttcactcatttaacattatgcaaaagtccatgtatacacgaaaatagaatagtatcatgaactcttccccctcccatgtacctatcatctgcctacagcaatgatcagaattcactgattcttcagtattgaaaccagttgataaataaccaaataagctttcaataccagtacagtgaaaactgttttatgtcttagaactaattttgtctgttgatttgagcaaagaagaaatccacaaaaagaaataatacaacaaaacttagttatggaggaaaataggaatttagcttcaattctcagtaaaggcaaaatgagtttcctgtgttctttaatctaataatgttattcaaaattaaatgtgtggattttattttttgacaattgctgcttcaaagccctggagccctaattagcatgggaacatgtggtaagaagttaagcaaacctcttcagaagtggtattgtcaattaatttaggttatatgtgttttttattttagggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaagtaagttaactactacacctactatacagagctgattgctatcctagttttttttccccccacatcagacaggtaatgtgctgatgtcataacaaggtttgaaggaagcacatctcatatatgagcataaaaacccaatcatcatgcttctcaactacaaaaggatcctagcttgatgtttaaaaaccaaattcataatgctgtttacatagacatagaggacatttagtaaatatttgctaaataaatgatctccttcattttgttccccctccagatttatcaagattcttttgaacaacgatttttggaagaaactaaccggctctatgcagctgaaggccaaaaattaatgcaagaaagagaggtatttaaaaatcatgactaataaattctcactgtctctcacaatagaccttactttgtagaatataagcttccctttgcatttatcttcccaacattgtgatgctcttctctcacttaggtgctcctttcttttctctcttcttaaaggccagaattctggatcataaactctacctataaatttttacatatgattctaccctgtcacatttgacagggccacttccaggatcttttggacttgacattttctgaatgatttatggggaggaaaacaataatgtaaaaaactatctttgtaggttcctgaatatctacatcatgttaacaaacgtctagaagaagaagcagacagacttattacttacttagatcagaccacccagtaagtaccacatgctgaatttaatagtcttaaactgtcgttaaatcacttgcagcactttagccatcctaaacatgttagtaactgttttcaggtgtgatttgaagtgttaacagttgttttcataatacaaacttcaagttattcttttccctagttaattagttttcatccaaggattcgattattaggggtgtgtgtgtgtgtgtgtgtgtgtgtgtgtgttagaaggtaatttagaaataatactagaggctgatgtgacctttaaactcttcaggccaattaaaattcagtggattcccctatttctgtgctttcctaagtattaatattgccagtcgaggggcctctgtatgtagtacttctttaccttcctaataaaagtagcaaaacttggaaaaagccgactacagcaaggtcttggagatatttatttcgttatgtaaaccaaattctaaaatatgcagtgtttttttaaaatttttgcctgtcagttcctttatgtctttttcttttaggcataaagtatagtaactctgagcaccaataaatttatacataggataggaatcttgaaatcaacataaaatgagctatttgatttttttcccccctcaggagaggctttacattttctggaagtcaaacgtcaataatactaacctttttttttttccttgtaggaagtcattaattgctactgtagaaaaacaacttctaggtgaacacttaacagcaattcttcagaaaggtaattggcaatttgtaaataagagattgctttttaaatggtagtggcaaactagtagggaatttttaaagatgttgcccttttaaaagtttgatagcatgtggctgcatttctgaggatggacacaatccttattaatcacagtaaacttcctggaggtgccagttttcttatctgaaagatacaggaactagaagagagggatccacaaataccaataaaaaaacagtggttgatatgtgcctgtagtatcagctacttgagaggctgaggcaggaggattgcttcagcccaggagtttgaggtcagcctgggcaacatagtgagactctcgtctctttaaataaaataaaagaaaaaaagtgggaaattcttgacttaatatgtaagctttcagtaaggaaaggtattcctttttacactaaagcggtgagggttttttgttgttcatggcatgtcaaaccaagcacttctaatcccaagtgaatttagagtataccctacattttactttgagaatgccgcaaataggtaaaagccttacctttctccccaataatattttcttttgtataaaaatttatatatttagaaatttaatgcagttatactgttatttcatcctggaaatcaaatatttattagagcctcatttaaatttgacctatttatgcatggcttttgatatatcacaggctatatccagtattctgaaatataactatgtacataatatggctactacatatatgaggtatttataatgtatatttatgtaagccagtttttataagtttgtttttgcctctaatctatcatgctaaatggcacaaaccattatggagttaaccatttttctttttctttttaatttttttaactttttgaattaaaatagagagggggagggggtcttactgttgtgcccaggctggtcttgacctcctggcttcaattgatcctcctgcctcagcctcccaaagtgctgggattacaggtgtgagccaccgtgcctggcctgtttttatttttatagcgactaaagtctctatatttagtttttacccagaaagatggttgggtttaattcaaaggaaatcttacattacaactcacatacagactagtcatagttcaaaccagtatcacaataatgattataactcaaattttattaaaatgtctgataatcttgttcacttttttgttcactatattttaatgccaaaatgttttaaaatacaggtttaaataacctccttgatgaaaaccgaattcaagatttgtctcttctgtatcagctcttcagtagagttcgaggtggagttcaggttcttttgcagcagtggatcgaatatatcaaggtattaacaatttacctgtgatttttctctcttatggcttatctacacatcaagagtgcatattggcaagcatttcttgtttgatccaatttttttttttttgagacagagttttgctctcgtcacccaggctggagtgcggtggcacgatcttagctcgctgcaacctctgcctcccaggttcaagtgattctcctgcctcagcctcccaagtagctaggattacaggcatgcaccaccatgcctggctaattttgtatttttagtagagacggggtttcaccatgttggtcaggctggccttgaactcctgaactcaaatgatccacccgccttggcctcccaaagtgctgggattacaggcgtgagccaccacacccggacttgatccagttcttttaagggaattttaaatttgtttaaaaagtaatgggaattttgagaacagtcaacctgagaatggtagctgtgtggcatatcagctataaaacctgattgatggctgacataatttctgtctctaccacttaaagcagtaaatgtagaaaaagactttgaaccccaaatttctttcctttcttcaatcttacactaaagccagattgccattttaaggaagttgaaagctgacttctttaaaaataaggaaaagatcccagaggcttctaataataccctgttatgatatcatatgcccagtgatcattgcttactatttttgtgattatagatgagtggttaacagtgtggatatttagcactttatttttttgtcctcatttcactatcagctttattttgccaggtgcagtggtacatgcctgtaactccagctacttgggaggctgaggcaggaggatcctttcagcctaggagtttcagactagcctgggcaacatagcaagattccatcttaaaaatagctttatcttactttttaaagatctttaaatatatatgccacttaaaatatgatttggggattgttttcattgtagacaattcgattacagtaaaaagtggtaattttttgttttaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttataggtatgttttccagtcctttttccagttgtttaatgatgttctttgagtcataaaatctcaatctgaaatttttaccaggttgtagtattactaattcctgatttgtttgaggttgcttagctggtatatcaagtttgaagagtgtttctaaaaacctggatgtaagtactgaaagcccacatgtcaaacataatgtgctttctttcaaagacagtacgttggacactatttacctttattgataataagctaatctgttttcctagcctaatgatttaaaaatgaggcagggtgttatttcaagctacaaaaaagggcagcatgaaattacagttgtcagtgaaaaagaaaaaagtccagggcaaaaataaacctaataatctgggcccatttagcataaggatgtgatatacactacagtgcttctcaggtttttccacccaagtacccttagtgtcagaggaggaggtaacctgagaaggtctagggtcctctgccaaaaggatgaaattttgttgcaacctatctactatgtatccgtaaacatgtagcaaattttaccttctactctacgatgtatctggtttattttaatagaaaagtaatgtttaagattgcttactattcctataaaatggatactccagaagattcctcatgtcttttcgtggcttggattacatgatgccctcacagggctacatgagacctcccccacaggatatccgtatcctattttcataaacatcagtatagtgggaagtacatttgatctggagtcagaacacttgggtttgtgttcaggccctgatgttattagctctatggcactgaacaagtcagttgatcttcctgactttggagacttttaaaaatgcatataaatttctgaagtattgaaaaactcagtgtatcatactcctctttgggtatatatagtgcccagtacctcgtgtattccccggttattaaacaacaaacttttcccccattttagctaagtatgtagattcaaaacttcgtgcaggcaacaaagaagctacagatgaagaacttgagaaaatgttggataaaattatgatcatatttagatttatctatggtaagtatttactaatgttttaatatttttcttttaaaatagcactcaacagagaagctagcaagtatattcaaactggagggaatatttatttggaaattacagatttaaaattgtgtttaattcattggggggatacgtgaggaatgttacctgattgtcctatgctttggctcttctagtattaagtgccttgatttttgctacttggcttaatctcttaaatattggcaccaaagctaccagtccacaaaagcttttctgaagaaaagttaatgcaatcaagacagttacatgcaaaaaagttttacaataaagacttcgaaatgtctggcacaaaaatggatctctactgtttcttgcatttaacaaacttaaataaaatgtgtaaagtaaaataacttggaataatggtgtgctttattaaagcactttaaagcagttttgtcagtactttttattggaatattataaattttgcatttctttttacataggcaaggatgtttttgaggccttctataagaaagatttagccaagcgcctgttagtcggaaagagtgcatctgtagatgctgaaaaatcaatgctgtccaaacttaaacatggtaggtttctcattctttctgttccttttctttgattcctgaaggagaatgttagctttttaccctttcaatcgatttcctcttttgtcactcatgtctatgtatatatgatgaaaacataaattgagcaagctcctgaggtttccaacttattgtacataatatccagagttgttttttttaagataaagcattgttcttggttttattatttgtataaaaatttcccatttattttatacctaaatagtagataaggttactacaggattaaagagtttgactctgaattaatggggcatacactttggggtaaggatttctttttattcttatgaaagttacagatcatacttcatactaaagttttgtatttcgtgtttcccacttttaaacctcttttgtttttaccactttaaaatattatacatgtacaaacatctttaatagaatgcggagctgctttcaccagcaaacttgaaggaatgtttaaagacatggaactttctaaagacatcatgattcagttcaaacaggtaaaagtgagttaaactcttaattcctcaaacttagttgtatttagttatctgcttgctatgatttgtactaaagaggataaatagaaacgtgtttgttgtaattcatggcaactgaggtgatattcacagtagaaaaaaaaattggtgaaatataagtatatttgacctactttaggatttatttttgacaaacacccagaataacacaaaaataaaaataaaatgtattgaactgaagtcagtacaagaagagctatagtgggaaaagggctttcctcagcatcttatcgtttggtaatttgcatgttcagagcttgcaatggggagagaggagaagtgataatgcagctgtataaaagcctttggggacattggggatagaaagctagatccacagttttgaagatgtaggtagaaagtagttttgaaatgtttaagatcataggtgataatgatggcaaattagattttcctcttttgggttttagtagtgacttctttaccccacagtgttgctaaggtgggaagtggaagtgaaagaattaagaaaaaatcagggtcagtaagattatggattctatagtagctacagaatagggcttatctgctttgcccttttcccctctttttccttccctactccaggtcactccctgcagacaggcagtggagcaagtgaaaaactggagacttgggctggctggggggtgaggaatgggggttgctgcaaggtgtttaagccacataggggtattcaaaggtggggactgcaggtggtattggggaaaagaatggagaagagatcctataacggcccagctgtatgtgagaaattatttaagttgataacgcctgtaatgaggtcatgtgatccttgtatgcctttgtatcaaaatgttaacctctgtacttgcctagtgcattttgtgtaggtttcatttaaagtcttcttaatagttgccttttattttaaggatggtcagtgtttgcatgtaatttcataacagggaacttcttaaataggttattatgatatgaaatgtatgcagttttaagatctcagtgtgtgttttgatcttcttatagtatatgcagaatcagaatgttccgggaaatattgagttaactgtgaatatcctgacaatgggctattggccgacatatgtgcctatggaagttcatttaccaccagaggtaagagttactgtttagaactgagttataggcatagaaatcatagcatttccattttgcttgtcatttaaaaatagatacttagaaaaaaatagagacccagggtctcgctgtattgctcaggctggtcttgaactcttgggctcaagtgatcccccccgcctcagccttccgaagtgctgggattacaggtgtaagtcaccaggcttggcatggatacttttaaaagtgtatgtcagtaagcgcaccaacaccaaataccaactgctttaatgttttacttttgtacttagaagtccagttaagcacatagctaataatgccaaatttctgggttcagggtcaatttccctggctcttcttccatcttcccaggttatacccctcactctacctagctattaagaattcttgcacatatttcacccataggtgggattgctaaatgatgggtccttgattaaatctatcctgactcctggtaaactgtctagtccaggactgaagcccataaaagggattaaggctagacagatagatattgagaatcctccatggagatgattatgaaggcccagggagtagatttctctcaaagaggaagaaaaaacagcagaggcagaactttagaaaaggctcacatttggcagatggtagaaagaggaacctgtgaaggaaaccaatgcagaagcaacagtgaaataaaggaagcagcatagtgcagaggcacaaaagctgctgcaggtgaatgtttcaaaagaggggatgattaaatgttcagagagagcaaaaggtataaatcctaataaatcccatttgatttggtggttgggagatcattgtttttcatcaaagtgattggtggacctactggatatagtcttaaaattttccagaaactatatcacatgaggtaagtataaaaatggtaaatgtggtattggatacagagcttaaataaagccttattttatttactttagatggtaaaacttcaggagattttcaagacattttacctaggcaaacatagtggcaggaaacttcagtggcagtcaaccctaggacactgtgtgttaaaagcagaatttaaagaggtaagtggatgttcccaaaacttttagttttcatctttatctttaatgtttaggtcatccttcttaactgaaagtttaggctattgttttttgttttcttcttttttttttttttttttttttttgagacagagtctcactctgtcaccagagtggagtgcagtggcgctatcttggctcaccgcaacctctgcctcctgggttcaggtgattctcctgcctcagcctcccgagtggctgggactacaggcgtgcgccaccatacccagctaattttttttgtatttttagtggagacggggtttcaccatgttggccaggatggtctctgtctcttgaccttgtgatccacgcgcctcggcctcctaaagtgctgggattacaggtgtgaaccaccgcatctggccagtttaagctgttgttttataattgtatcctagatatccgcatgatgacagtgatagtttgtcatagctttatgtatttttaagtaattttaggtgtgtggtctttccacgattgatttggcccttctgcaaaatgaaaagcagtgaactttccccctaccctttcctcacctgtggatgaaaactgtacactgccacttcctatttttatttatttgtttatttttagagatagggtcccactctgtcacccaggcaggagtacagtggcacaatcatagttcactgtaacctcaaactcatgggctcaagctatccccctgcctccgcttcctaaagtgctgggattacaggcatgagcaactacacttagtctaacactgccacttcttgacagaaatcttgttgctgggagctacgaatagagtgggagttaagggaaacagtgtgcaatatctaatctcaaaaaactttagcttttcatgactaatctgagccaaacaaatcaaaaatacatttgaaatagtgatttcttgctgcttgtgatgaatatctagaatgacacataaggctgattaattttcattactgtattctatttataaggcttaaaaaaaaactgttaaaaggtcagctaatccttccccctattttaggtagggtcacacctaaacctcacactgaaatactgtattaccacgtcaagtggctttgctggataatgctaatcatgtttctaaatccactaattgaaaaatgcttttcctataagagatgattaatttttcatgtgtttttaaaaaagtgatgactaaacacttttatttcttcaacagggtaaaaaggaactccaggtctctctttttcaaacactggtgctgctaatgtttaatgagggagaggagttcagtttagaagagatcaagcaggcaactggaataggtttgtagcaaacattaattgttcactatgtgcacaccactatgttaagaggtctgggggacatatttataggaataattccttgcctcagaactgttttgagttttttttttctttttttttaatgagacagggtctcactctgtcacccaggctggggtccagtggtacaatcatggctcaggctcaagtgattctcctgcctcagcctgccaagcagatgggactacaagtgcatgccaccgtgcctggctaatttttaaaatttttttttgtagagacagggtctcactatgttgcttagcctggtctcaaactcctgggctcaaggggtcttcctgcctcagcctccctaagtactgcaattacaggcatgagcccctgcagccagccagaactctttttttttcccctcaagacggaatcttgctctgtcacccaggctggagtgcagtggcgcgatctcggctcactgcaacctctgcctcctgtgttcaagcaattctcctgcctctgcctcccgagtagctgggattacaggcgcctgccaccacacctggctaatgtttgtatttttagtagagacggggtttcaccatgttggccaggctggtctcgaactcctgacctcgtgatccgcctgcctcggcctaccaaagtgctgggattacaggtgtgagccaccgcgcctggccagaactctttatataaccatagggaaagggggaaatgacacttgaaataatgtcaaaacccataagtactggcttgtggtactgactataagtgtggtaagagtgcaacaaagcaagagatcaccgtggactggcacaattgggaaagctgtcatgaagcaagtggcatttgagctgggccttcaagttttggtcagggagaaggcatatacagcaaggggaaatattttgagatgaggttgggaggtaggaatgggcacagtataggcccatgaagagcttaattgtagcatagaatcatgaagaatcatgaagagcttaattgtaacatagaatagtgagttaaaaaattaggtaagatgagtagggcctgattgtggagaacctgataagtctagcaaatgaaacctacactgtagtgtctcaactatgtggcatggtggaagtaattatttggaccacttactgaaatcaatctacagggcaactggaaggatcaagggattccagtttagatgctattgggatgattcaggcataaagtagaagggacttagactagaatgagaccatgaaaatggagaaaactcatctctgcggaagcagcggctagctattatgttgaggatgaaggagaaggaaaagttaaaagatgattttagggtttcccaactgagaaggttagtggtatcaccactgacaattggaaagaggacacagttatatggagatgatgaatcaaattttggacgtaactacagttgatagtaaaacagccaggcggaattgccctttaaacgtgcaactggagagaagtgaaatgtcattttggaatatttggtagttgcccacatggtatgataattgacgtctttaaaagaggactaggggccgggcgtggtggctcacatctgtaatcccagcactttgggaggccaaggcgggtggatcacttgagctcaggagtttgagaccagcctgggcaacatggtgaaaccccgcctctattttttttaaaaaagaagaggactaggaaaaaagccattggctagaacaaagaaaagttgttggtgacctttgggaaaaaatgaaatagttttaatagggggatggagtggaagctagattgaggtagaatgtcgtagttgttcatgctggtaacaaataactaaacctctgtttcttcttcagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggtatttctttcactttctcttagtcctaacacactggaattatacatgttaataatcaaaatatataaagatttttatacctgtaatactgccaataccattaatattttttgtgtctatgtccagctaaatatgtttcctgatttgattttgggtgtttgggagagtggttgtacaggattgagatgatactcaacatagtttcatatcttactttgtttatttagtattcaatctttagaatttttccatgccattaaatagcttcgaaaaatggcagatggcagtgtaatatttttacatggctcttatagtttgttcaaccactgttcattttggggcaattaaattcatgacttattagtattataaataagattgcaagaaacctctttgaaactaaattttaatctctgatatatgataaatttgtggaagtagatttttttgggttaaagggtatgaacattttaggagtcttagtacataatgtcatattgtgttccggaaaggctggaccagtttatactctgtccagcagcatatgagagcctgtcttactatgtcccccagcactaaagattatattttcttttgccaacttgcttggtgaaaaatctgaattgatttattcactatttatttgattaacagtgaaggtgggccaggtacggtggttcacacctgtaatcccagtaccttgggaggccgaggcgggcagatcacctgaggtcaggagttcaaaaccagcttggccaacatggcgataccctgtctctactaaaaatacaaaaatcagctgggcgtggtggtgcgtgcttgtagtcccagctacttgggaggctgaggcatgagaatcacctgaacccgggatgtggaggttgcagtgagctgagatcgcgccactgcactgcagcctgggtgacagtgagactctgtttaaaaaaaagaaaaaaaaaacaaaaacagggaaggtgaatattttgtttgtttttgccatttgaatttgtaagagacttccaactgcagcatcctgaaactgatggtttcagttccaataaggtttaatgcaatatttgaaaaaaaaaaaattttttttttgaggtggagtctcactctgtcacccaggctggagtcagtggcacgatcttggctcactgcagcctccgccttccaggttcaagcgattatcctgcctcagcctcctgagtagctgggactacatgcgtgagcgaccatgcccggctaatttttgtattttaagtagagatgggttttcaccatattgaccaggcaggtcttgaactcctgacctcatgatccgcccatctcggcctcccaaagtgctggaattataggtgtgagccactgagcccgactgaaaaaattttaatgtaggacagcgaccagtatctccaaacaagttcctgtcattttcacatacacatcaaagacaggatattttcttaaaggattaccatgtccttacttttaaaacatttatgctgtaccaggaagaaactgctgcaaaaaggccaaactgtttttttggtttaattactaaagatgaacatttttactttagcatcaagattggtaaaccgcctcctaaatacctacatttctgtaagtcttgaaggattgtaagcactaatggcatgcatgtctgatttatatattacaaaataaaaattaattttcaaagaggttgactcttaactagtttgcttaaccagttaataccatgccttgagtcagagatcagacagagtcaccttatagacaagctattgtcatagagaaatctggttaacaatccattgaaactgatacacacatttagaagatatatcaaagacagagtaaaaaaacaaaatggtaaattccacatcagctatctctacttctagaaaagcaattcaaagatgatgtttttctattaactaatattagcattacttcattggtatagggcaatataatcagaacagaaaggagttatgtttgtaggatttttctctgtcagcatctatatttataagaccccatttagataattcagtacctttaaagcaataacaatgtcatgtccctaaaatgcacaatttatgtaaatagtcaggttttgcttctggtataattcctaggtttaaaacttttttgttaggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaaggtaggtacttctgtgttttcctattgagcgtgttataaataaaagaaagtacattagattttcagacacaaatcttgcaaacataaagcgtcatgaccatttagagagagaaaagttttaatttcccatgttgatgcatatgatttccaaaaaaaaaaaactttgttggcatatgtgggcagcagtgacaaaagggaaaaataacagaaaagcctggatacctgaaagtttaactgctaaatgagtgtttgaaattttcaagtttattcactatatttcttttgaacttcttggttggttatttacttcttttcctcttgaaataccatggtatttattgaaataccatggtatttgacagatttagttattgtggattgagttaaatctcctgtttagttagcttatataagagatcatctgttaaaaaccatacagataactagtcatgattaagcatctttttgaaaagtgtagtgatagttctggtaaactgaaattggtcattaaatggaaacgttccattgtgaatgaccaataataaagtcacttaatgtgatgttgtactggccttttttccaagttttaggaggtagatagccaaacccttggatgataaacattgatagagtttgaatagactgctagctattagggttcttatgagctttggactttcataaatcacttcaccatgctgatcttgtttcctcttttgtaaaactgagataataatagtacttaccttgtaggattattgtgaggtttaagtgagatcatgaatgtaaaaatcttagcactggacctggtacataataagcactcggtagctcttagttctaataaggtaagcattttcttttctccaaacctaatatcgcactcctcattaccaccctctcaccctcatgctctgcttaatagtcatttcacctcaagccagagagatcactgatgctggggaaattaggggatcgctgtagttaatattgtgctgatattctaggtctttcaccataattaagagaagtcatctgatttcccaaccttgggattactggataaaattttcactgctgtatcagactacttcccctcttttcccctcttgaacaagtggtcattttacttatcctgaaaaactttctattagcaaacaagattatattatatttacagactagatacataagatatatagtggaattttgtcatccaggagcttagaatgcaatcatgaagataaagctacaagctttcttgattacttttaaatcacaggatgcagaaatccaagtcacttagatgcactaaaccagaaatatgaagatctaaattatgaggtacttcatttatcaagccatttcatgtagtttttttttgagatggagtctcgctctgtcatccaggctggagtgcagtggcatgatcttggctcactgcagcgtctgcctcccgggttcaagcaattcttttgcctcagcctctcgagtagctgggaccacaggtgcgcacaatcacgcctggctaatttttgtgtttttagtagagacggggttttaccatattggtcaggctggtctcgaactcctgacctcatgatctgcccacagcctcccaaagtgctgggattacaggcatgagccactgcacctgtccagtattcttttaaatagtgattttttttttttttgagatggagtcttcttgctctgtcacccaggttggagtgcagtggcgcgatcacgtttcactacaacctccacctcccgggttcaagcaattctcctgcctcagtctccctggtagctgagactacaggcgcccaccaccacacctggctaattcttgtatttttagtacagatggggttttgccatgttagccagtctggtctcaaacttctgacctcaggtgatccacccatcttagcctcccaaagtgctgggattacaggcatgagccaccacacccggtctaaatagtgatttcatcagtacgttttaaatcttaatttataaaaatgaagccaactaactcttgcccaaagtaaaggtgtgcttcatgaactatcttgacaaaactagtattctgtgtccttaaactaccttacagtgctcatgtgaagttacaataaatgtagtcttttgtatttaaccacgcgaagggtagctgcttctggcatgacctctttaaaatagaaaagtaatagaaagtattccgtaacaatatgacaaggatgtgacagtttaatgtatgtatagtatatagtacaggttgaacacctttaatgagaatccaaaatctgaaatgctctaaaattggaaactttgaatgccaacatgatgccacaggtggaaaattccacactttacctcatttgacaggttgcagtcaaaactttgtttcatgcacaaaaggtataaaattatcttcaggctatgtaaggtatgtatgaaacatagatgaattttgtgtttagacttgggtcccatctccatggtatctcactatgtatatgcaaatataccaaaatgaaaaagtcaggaccaggcatggtagctcacacctgtgagtactgggattccagtactttgggaggctgaggctggggggattactccagaacaagagtttaaggtcagcctgggcgacatagcaagaccctgtctattaaaaaaattaaaagctccaaaaaaaaatcaaaaatcaaaaacacttttggcgttaaagaatcttcaacatacctgggcacggtggctcatccctgtaatcccagcactttgggaggctgaggcaggtggatcacctgaggtcaggagttcaagaccagcctggccaatatggtgacaccccatctctaccaaaaatacaaaaattagccaggcgtggtggcttgtgtctagtcccagctactcgggaagctgaggcagaagaatcacttgaacccaggaggtggaggttgcagtgagccaaagtggtgccactgcagtccagcctgggtgacagagcgagactccgtctcaaaaaaaaaaaaaaagaatcttcaacgtgtataaaacattttttaacctggtttattttcatgatacttttctctaaaaaagagatttaaataaataaaaattttaaaaaaggagattaaattcatgagccgaaactgttgtctttttaatggggtattaactaaatgggcttgagccaatgataatgaactttacattgaaaatttgccttctcttacagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgtttttaaaaaacattatttggaaacaagttttcaagtagggggacagttgcttacataatatcttgtatattcacatcctaaaaattttcatttatgagtatgggatgtgtatatatgacttagccccaagttaactgtgctgattaacaagtacttataaaaatagctaaaatagaaaattaatgatcagttgtactagaggaacatcatagaagagaaaaatccaactctttatattaaaaatgaatacaataagaaaactgcaaaagagaccaaaatgaacgtgttttgtaaattgttacaggagcaaaaacttctcaactagttttcaacatactttagatttaaatgttgtttggacagttttgtcttcaacttggaccagttgtagattgttacaggcttcctaggatttagcattcctattttctctaccaaagtttttttagaagcatcccaactcttctctttgttgataaataagcctttcctgtcatcttcattttaacttgctaaaaccctagatacaaaagtcctccctcatttttcccacgcagcccctgtttgggaatttgagattctgggtcatgctggtgttcctttcagaagtgcttgaaattgagttctcttagccactggacacctagttttcagaagaatgtcccaagattgtttatatatacaaaatggcaaaattactgtttttcgaattgataattcaagcaaaaggcttctctttaccatcactggttttttttgtttttgttttgtttccttgtttctatttccttgaagctttgaagggaggagaagcagaaaattttgtttttgttttttaaaaatcagaactacttaatgctttttgccacagcatatttccttgcctgttggagctgttaggaagattacccatgtcctaatcttcaacctgagaagatttttgactcttgtgtctactgttgattattttcttgagttctcaaagacctgtggccaggtattttaaaaagtcatctgtttctttctagttgcatcaacttgcacactggtgtctacctatatgtggtattcggaacttataattcttattgagcagccattgcctatattttctcagctcctcactgacttctttatatgagctcagctgacaagcgaatacagctattttggttgccctctcttcatactggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaaaaaaagtttctagagaagatctttaaaattcaagtattgtaagaaagttataaaatcacaggacttaaaatcttcctaacaacttctaatgaactcacatttgttgattttgttatttttaaactttttaaaaattttgtaatggttttgtggtaatgctataagagtatgggggagggcatggttaacagggtgaggaaaattcccaggaatcctcaaggtggataattattcttaaacatgcggatacaagtataaacattgcttcattcaaatcctcagtgtcaaattgtttcataaagtcaatatgaaatgagtctagatttgagttcaggggagaagaaaagattactcttagttatggcatttgctctgccttttctgttaatagttttttgagttctgggccagatactctcagagtaagatgttcctcaaagtttttgaacccagttcctgagtctgcttgaatggtcttaatatgatgtctagccatactcttgaaatttttgctgtgtatgtgagtgtacagttcagaaaaccagtttatctgggcatctggatctaaagatttgagaagtttgttttttaatctggatattcataaatcttttaaaatgagctggtctttgttttcatgaccactctgtttaatgctgtgaatggcaggagtgttgtgagcgtgttctattctcttatttacataaaattgccaaaacaaattgttcattaaaaagaaaagagcagtactgatgaaaatttgcataattatgctttgtaaaatgatatcttgctaatgcttcattaatgaatatttttcagtgtcctacaaaaaaacacctgctttacatttgaatactgaagtttgttcacctgcaaacacttggttgaaatcaaacactttgctcaattattttcctttttccccttgctattataaaaaagggtatttcttcttttgaatggacacataatgtacctttatgtttaacaatccttagaagtcatctctagcatagtgaaaaagactctgacctttcttttgtaaaaccgtttctattggatgtaaaatataagaatgtgctgcactggcatgttagaacttaatagttttgccagctataacaacaacagatcctcttcatttgttctctaatttcaaaacttttctttaatttttaaattttttattgtggtaaagtacacacaaaatttaccattctaaccatgataaagtatacaattctgacatttagtacattcacaatattgtgcagtcaccattatgtagttccagaacattttcatcaactctaaaggaaacttggcaccaataagcagtcatttcccattccccatttcacccagcctctggaaaccactgctttctgtctctatggatttgcctattctggatatttcctatcaatggaatcattatgtgactttttgtatctggtttctttcacttagcatgatgttttcaaggttcctccacgtcatatgtattgatacttcattcctttttatgtctgaataatagcacgttggacatttgtgttgtacaaggtgttggacatttgtatggtttccaccttctggctgttgtgcgtagtgctgctatgaagatttgtttacaattatctgttcaagtccctgttttaaaatcttttgggaatatacctaggagtgaaattgctgggttatatgatagttctgtgcttaacttctcgacgaaccactaaacttttccacagcagctacaccattttctgttcccaccagcaatgtatttctccaatttctccacatcctcaacacttgctgttttctggttttcaggtattatcataatcatcttagtgtgaagtggtagttcattgtgattttgaatctcatttctttaatgactaataatgttgaccatctttttatgtggctattggccatttgtatattttctttggagaaatgtctattcacattttttggctgttt

SEQ ID NO: 16634 - DNA, 11792 bp, Human
gcaaagacccgtgttccagaagagatgggaaagagcggcttcgggaaggagggagtggccagtcaaatccatggaggatggcctcagcttcagtcttaggtggagctggagaccttgtcctgaggggctttttggcagaggaggcagggaggggtgaggacggaggagaggagaacaggtgagagcacccagcccggtggcctcgatcttctgaggccccagaaagcggattaccctgcaaagcccctcgagctgacttcccaaatccctaattgtgcttctctgtcacagggagggttaaccccacttacataagggccaggccccgccccctgtccccttaactccatgatccttctggaagcttcacgctccgcccgcttccccttggggtctaaggctggaccaaccccaccccagctcatcctgaggtgagctctggtctgctggggacaagtggtcccctccaggacaacatgggctttcagctctgtcccgggcagggagggggctggcaagtgggcctgggggtggaggagcaggcaagaaaaggctgctgagtgtgaccttctcagtaaccccaagaatataacaatatcagctgcacacaccatttattaggttcttactgagtaccaggctctgaaacacatttcctgaaccattgtctttagttccccaactacaccataggacaggtgctcttctcatcctgttttacaggtgaggaactgaagtttggacagattgagtcactttctcagggacacatggctggccggtgatggagaaggtacttgaacctgggtctgcctctgctctctccacactcccttgcgggggcccggggcttactataaggcaaggatgtaagacaagttcctccttccctctccttcccacaggagcagaggcatcgctgggctggaggtgggaaggatggacctgggagcagcgcaggggctggtgtggcaagaggcaggcggagctgtgaggccgagttcggggggaaggggaggactcctgagagcccgtggccaggctcaaggtggctgtgtcctcactggctctagtcctgcaggcctggctctccagaggagcctgccagctcctcttctgccccctcacaggcctgaaggagaccctccagatggggatccaggcctctttcctccaggccagcctcagaccctacgggggacagttctgggaacgtcctctgtgccaggtgtctggggactgctagccttctgggggggctggatcctcaaatcgtgagccccaagcagtccctttccaagggattggagtgagaacctcgtggggcagagccagatctacctaggacccaaggggagtgtctcaggcaggacccccacaggcaaagacacacacactggccacacacttgccttcggatgtgtgccaagcagctcaaaaggatttaaagtccagccaggtggggtggctcacacctgtaatcccagcactttgggaggctgaggtgggcagatcacttgaggtcatgagttcgagaccagcctggccaacatggcaaaaccccatctctactacaaatacaaaaaaaattagccgagcgtggtggcaggtgcctgtaatcccacctgattgggaggctgaggcaggataatcgcttgaacccaggaggcagaggctgcagtgagccgagaccatgctactgcactccagcctgggtggcacagcgagactccgtatcaaaacaaagaaaaagatttaaagtccttgggagaggtggagtccacacctctcttcaagatgtggcatgaaatggtgaacagctgagcacacagggcaggagggccccgggggaccttgggcagcccgggaaccagcatggggtagcaggactgaccggctcccggggcaccttggtaatgctgcaggtgtggccagttgatcccctgtggagacagtaaagattaagaggatcataaactgcgtccagcggctgccccgggagaaatctcctcaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggtatggcttctcctggaggtagggttgggtctgggcccttggggagcagggtaagggccagaggttcgcagggaccatggaaggagccagaacaactcagacccagccccgccggctgtgggcaagggtggggtagcctgtgggtaaacccagaatcctagaaacacggtggggcggggatgggggttgggggcgggcaggctgcagagccaggacaggacagcccagccgatggggaaggaaagaacagagaagcgcccttagggcttaacagcacagaggtccctagtggcgttgacaagaatgtttctgtgggatgatggagcctgaagccacccacagagaagggatgggagctgggaaagtggagctagggctcggactcttgctgaaaattggccattgagggaggagagagggcaaggaatgggggtgggggctggggtgtggatgcacagtgagggagacacttctccagatggaagagtcacgcgtgggttcgttcaaatgcgggtgagcggggcctgaggactgggaaagggacccgagggaaggaggggagcgtgcagccctgccccggcccagccctgccctggcccagccctgccccctgcccctcaggcgtgagcccctcgctccagtgccgcgtgtgcggagacagcagcagcgggaagcactatggcatctatgcctgcaacggctgcagcggcttcttcaagaggagcgtacggcggaggctcatctacaggtgagtgcggtgggccctgctgggcgtctgcccctgaggggttctggaggggtgagggggtgctcaggggaagaggggcttgggcaaaaatgtccaagcccatggctcagggcatgggagggacactgacccctggggtctcctcttcacctgcaggtgccaggtgggggcagggatgtgccccgtggacaaggcccaccgcaaccagtgccaggcctgccggctgaagaagtgcctgcaggcggggatgaaccaggacggtgaggcgggggctggcccggggggaggtgacaagaaatgggcagcgggactggcgtgtcgtcctgacccttcctgcctccccagccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatggtgagtgggagagcagctgagggcacagcagggcttggcttcccgggtcacagcagggctgcagcgccttgccttgatcctccctcccccggggctccaagtactccctgccacctcccgagaagcaggcgctaagatcacaacctcctcctccaacagctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtacctaccggcctgcctgctggggagctaggctgggctggggtcaggcggcccactcgagtcaaccagacagggcacacacatccccacgccagtatgaatgcacacagcttggatggtgatggctggggacacacatacctctgattcagcgatggctggggtgcatctcagggatggtgacggtgggggtgcatgcatctctggcacagggatgatggtcggggtgcacacctaggagatgatgatggctagggacctacagggcccagggtcttcttaagttctggaagaccctcaggccctgcagacattctgtgggtaacaagtgacctgcacaccctgaacaggctgagtggctgactctaggcccccttggagcacaagtgcctacgacttcagggcttgcattttagttcaatctctccagctctgggccatccctctcggcttctaatgggcaagcagatctttcaggaaaaccaggaggagaggcatgaggagggtttgaggccctcagccagtctgtgtgctggggtggagcaactcagaagagtcaggccacaccacttgaatacactcaacttaggacactcatgaggcatgtctctgaggctgcccaacttccaatggctctgggcgttcctaaatgtcccagctgcagctctggatggaacccagtgtctcagatggtaggcagctgagccggatggtgccaaatcccagagctctgagcctctggctgatgtcaggagagcattctcgggtcccaggacagcacttccattccttgggtgcctgagatggtggcagaggctccagactgagccagagaagctgtgtgtctgccataacaggcacccctgtctgagcacaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggaccccacggagtttgcctgcatgaaggccttggtcctcttcaagccaggtaactgagtctctgcccaaaccttgagtgggaattctggtgacttccatctgcctctcactctccctccactacccccatgtgtgcagatgtgtgtaggcctctatcctggggggtgggaggagagtggtgaggctggactcccttctccttggggccactcctggttgactgtgaggggacagggcaggctgggagcccctgggagaccctgagccccagccggagcccctggtggctcctctgggcctggcagagcccaccccacagggccccaggtccatgtctgcagccagaaccctgggccaccacttcatggccagccttataacagccgtaaacctgtgctaagctcactggtgctgcttctccccagagacgcggggcctgaaggatcctgagcacgtagaggccttgcaggaccagtcccaagtgatgctgagccagcacagcaaggcccaccaccccagccagcccgtgaggtgacctgagcatgcgcccacccactcatctgtccctgacctctaacctttctctgcctctcccacactctcccagagctcactgattagacagcacaagggtctcagttcaacagcatacagccaacatctatggtgtcccaggcacagtgccaggccccgggagtggggaccaagatgtacataagacaaagctactgccttctagagacaaccggcagtgacctcactgaagacaaaaactgccctagccaggtactgagggttgcatgaatctgcaggagacagagatccccttgcatgggaaacataaagcagaattgggagggactttgtggagacagggctggacttgaaaggaagaagaagtctaaaagaaaacatcatttgcaaagggagagaggggcaagcatgatatgttgttagaacaggagcccactttgaaggtataacaggttcctgccagtgagaaatggggagaataagccagaaaagtaccctaggaccagcccgttcaggactttgaatgccagccaaaggccacgtctgacttgggaggcagagggcagctactgcaggtttccgagcagagggtcatacacagggctggacctcacgcagactggcatggccatgggtccagaggatactactgggaaggggatggcagctactgccaccttccagatggttccatggagttctgatctttgggcatggccaggggaagcagaagggagactctaggagttgaaatgggtcagacccggtgtttgggtgaaggtaaggaatgagggaagaggagctctttgggagaagacattgttaaaaatataaaaaggaaagccaggaggaaagacggttttgagggaagatgataaggtgttttgtaggtgcactgagcatcctgtagagatgccaagcacatggatggccctggctaggtttgggggagagttgctgcaggctgagtgtggctgcgcgagggtggggcaggagccggtgctctgggactacgctgtttggcccagcacaggcagatgtcatggagcctcagcaaggttggaacatttggccttcaggcatctactggctattttagaccatgttatctgcaatctttggggctcccggcagtttctttctgaagaagcaagctaatatgggcatccttgcatcacctctaatccaagaaatgattacaaggagaaaaggtaatttccttttaagaaaagccacagtatacaaagtatatgccatatagcacaggaagatttgtgctgcttatgagcatagggagaacgctgctactactaagacttgacttagcatctgaagagtgggattcagagacattcagaaaccagcagcctttctctgccaagtttctgttggaaccaactcccagagatgtcctggcatattggttatgcgtcaaatttcaaaatgctgattaagatttcctatgtcccttttatagcggttcattgcctactacaagggaattgagcatgaagatagtggtttggggttctctaatccagcatattatttcagtttttaaaaactgcaacacccaggaagaaacacaattaccatcgccccctgatatgcacacagacaccaaagcgaagttccacgaagtaattcctacccttagcttttacaatttacctgatgtttctcttttctttttttgaaaaggctgattgtgaccccctgaatttaatttcagacccactaggtgaggcaatacctgcagtttggaaaaaacattctttaactgactttatagttatttcttcttcctcccactctaatttagatcagaaaaacagaagcagggaatgcagatgggaggggtatacgacttgctcagtgctgctcacttggcactagcaagagaaaggaaggccttaggttggcaaagcaagtccagcagatcactgagtggtggggaagtcttccccgaaattcacggtgagaggagcatgggactgcccaatgtggagtagcctccttgatgctgggtgttgaccctggccatcagacctacccagggaaggtttagttcccccatctgtctcttggggcttcaccatccgtcttttgtgttgcggactcctgtcttagcaaatacttttttttttttttttttttgagacggagtctctctctgtcacccaggctggagcgcagtggcgtgatctcggttcactgcaagctccacctcctgggttcacgccattctcctgcctcagcctcccgagtagctgggactacaggcgcccaccaccacgcccggctaattttttgtatttttagtagagacggggtttcaccgcattagccaggatggtctcgatctcctgacctcgtgttccgcccgcctcggcctcccaaagtgctgggattacaggcgtgagccaccacgctcagccagcaaatagttcttatttaaaacaataaattttttttcaatgactatctcagtcaccaaaattatccttcaacttcaggacattttcagtaatggctatcatcatcctaggtggtatacagacaggaatttgtattcttacaaacaattcttatctactaaaaactaatcatataattataatacttatatatgagattaataataatattttcatatacaggtgctccttgacttatgatggggttacatctggataaacccattgttaagttgaagctactgtaagttgaagatgaattttcatacataacccatcttaagtcaaggagcatactgaatgcttatcactttcacaccatgataaagtcgaaccatctgtatagagttaatataaacttcactttataatctttacatataataaacaatatttactcattattttcattgcactcctaaactaaatagagggtggcggctcacaatgggtcgaggtaggtggaggcaactcctctggttaatgcggcttttcttttttttttttttttttttgagacggagtcttgctctgtagccgaggctggagtgcagtagcgggatctcggctcactgtaagctccgcctcccgggttcatgccattctcctgcctcagcctcccgagtagctgggactacaggtgcccgccaccacgcccggctaattttttgtatatttagtagagacggggtttcaccatgttagccaggatggtctcgatctcctgaccttgtgatccgcccgcctcagcctcccaaagtgctgggattacgggcgtgagccaccacgcctggcctgaatgtggcttttcctcgaaattcctcctgacccactctggggacctcatctctcctctccttcctcccctccctttcctgggagggcaccgccccagggactagtgctcagaagctggtcgtaaaactgatggcgtcctctctcctgttcaggtttgggaaattgctcctgctcctcccgtctttgaggtttatcactgcggaacgcatcgagctcctctttttccgcaagaccatagggaatactccaatggagaagctcctttgtgatatgttcaaaaactagtgggggtggaggtgaaatgtttccaagcactctggaaaacaatctactgaaacgaaacatttgcctactctttgccccagcaattcctcgtaggtgtgtgtacccagcagaaatgcccaccgaaagatattgtaagaatattcatagcagctttattcataatagccccaaactgtatattgatggtaggatgaattaacaagttgtggtatattcatataatgaaaaataatttaaaaagaatgaattacggatacatgtggcaacacaggtaaacttcacagacataaaagttgaatgaaagaagccaggccgaagttccatttatgcagagttcaggaacaggcaagactaattgacaataatagaagttggaatagtggttacttctgggtggtgggggattgatacagagggggctcatgggagccctctggtgtaccagaaatgttgattttgatctgggcagtggtttcacaaatgtattcatacgtaataattcattgagctgtgcactttattttgttagacctcaataaaaaagtaaaaaaaaaaaacaaaaaaaaccagaaaaatgagtgtggtcaaggctctccctttggggacactgaaggaatgagcgcaaggtctttgagttccatctgggttccactccaagtcagagaccaggcgcaatgaattcaagcccagtggaaaatctcccatagaattcaaccacccagcttctctccagatggcatcccatcatccgcagcatctctcaacctttatctcctatctcctgcctcatctccttcctaagtaaagaacaccttccaactcaacataaggcagctacaggtacgttttgtgaaagggactcttcatcacttctcaggtccttatggaaagatacagctcagacaaacttcatcattttctttttctcttttttctttttttgagactgagttttgctcttgttgcacaggttggagtgcaatggcgcaatcttggctcacgacaacctccgcctcccgggtataagtgattctcctgcctcggcctcccgagtagctgagattacaggtatgcaccaccatacccagctaattttgtattttcagtagagacggggtttctccatgttggccaggctggtctagagctcccgacctcaggtgatccacccaccttggcctcccaaagtgctgggattacaggtgtgaacctaatcctttttgaagatagacccagatgactgtgaaaataatattttaacatgttaacatagatcaggcaatgtatatattaatagcaggcagtgagccgggcactttttaaattgccatttaatccgcagattaactctgagggaagagccaattttctccatttataagtgaaaaaactgatgcttagagaggactcaaaccttggtgtgactctacctaatgctgcttaactttggcaccgcctctttcccaacttccccttcacttttggaatgaaagactgaacaattctgttgcattttctgccttcaaaggataagtgtttgaaatcaagacagaaagggtcatgtgagaaggctgagaaatcctaggggttccctgtcctttggcttgtgtttgaattcccttagctgacagaaatgccctatctactcaggaactcagaaccgctagggctggtgccagagaggaaagagtatggcaaatgctgcccagctgaagcccttcttacttcagcccccaggctacttcagattctctccaacttttcaaagtatcagagtggcctcagttaatcggtcaactaatgtctataatgccattatacagtccaattccctatcaaaagttttatccatatgagctaagccctgagcaaagccaccttagtaagacacatggttgaaatatgacatgaccagccctgcgtatgtatcttacagtttggctttggaggacatggtaagactgcaaaggtagcctgctgaagttcacaggctagcatctgggatgtgtgagcccagcacatctacattgggaaggagatttgagggctctccaagaagtcttggagaattagaggaagtacataagctggattgtctgctgtcaatcgggcatcaataccacccctcccccacttctaagggcttttcttcactgcagagatgccaggaaggaactacatttcccagaaaccctttcccctaggatttgctaatgaaagacactcacaggagattttttcccccctaatgccaaactgattaaatttggcattaggaaaaagagaagccatttttctttggagacactgcagccctgtcgtgggaaaatagatttcatagcagcctcctggctagaattgcactagcttccaggcaagctcttgagaactcctctggaacttgtagctgagatttgcgttggctttcttgacctgtgggaatatctctgacctttgttagatcctaatttctgtattaagtccatctcacctggaatacaaagtggcctctgttctcctaacctggtacagctctcagcatgtcttacagacaagaatacaaactcctgtttgtaaaccacctaggatgatggcagccattattcaacttcttgttgtagattggctctacagaaattctgatgagtaatggcttttccattgc

SEQ ID NO: 16635 - DNA, 11792 bp, Human; identical to SEQ ID NO: 16634

SEQ ID NO: 16636 - DNA, 26587 bp, Human
  misc_feature (1)...(26587): n = A,T,C or G
gcgacattgtcaccaaattctataaagacgtcatgcaggaagtgataacgtgtgctgcgacgttctggaagtaactcgaagctaaaaaagaacaaaaaatcaatgaaaaaatgaaactaaagaaacaatgagatgctatgtcaatatccgtagttatggaatggaaaataaatcttacaaagagatgctggagttatctaagaaatttacaccatactggcctgtgtgcatcagacttttctggaggtcatttattttattcactttttttttttttatgaccaaccgaactttctaatattttgggctggagtcccactaaatgaaataccccttttgaatggcacatatgacttttagggatgcatcttagcatttttatttttttatttttattttcaaaacttcattgatgttttggagttttgtttgttttttgtttttgtgttttttggacatggcctcactctgtcgcccaggctggagtgcagaggcacgatctgggctcactgcaacttcaaactcccgggctcaggtgatcctcctgcagcaggacgagccgcagacaaaactcagacaccggattaaagaagggctgtattaggccgggaacttcggcagacttgcaaccgaggtccctgaaaaagaaattcttggcccttttaagggcttgtaactctaagggtctacgtgaaaggttagtgagagatcgagcaagcgtggggaacatgactgggggctacaggcaacagctaacagaacagaaagttttgcaatgcttcctcatacaatgtctggaatttttatttatttaatttattgatttattttttattttttttgagacggagtcttgctctgtcgcccaggctggagtgcggtggcgccatctcgctcactgcaaggtccgcctcctgggtttacaccgttctcctgcctcagcctcctgagtagctgggactacaggcgcccgccacgacgcccggctaatttttttgtagatcaggtgttctcactatgttacccaggctgctttcgatctatagcgatcctgagctcaagcgatcctcctgcctcggcctcccaaagtgttggagttacgggcgtgagccaccgcacccggctaaaaacctgtttgtttgtttgtttgtttagagacggagtcttgccctgtcacccaggctggaatgcagtggcgccatctcgctgactgcatcctccgcctcccggttgcaagtgattctcttgcctcagcctccccagtagctgggattacaggcgtgcgccacaacactcagctaatttttgtatctttagtagagacgggttttcaccaagttggccaggctggtctcgaactcctgaccccgtgatccgcctgccttggcctcccaaagtgctgggattacaggcgtgagccaccgcgcccggcaaactttttgtttaaatcggagattttattctttcagctgtcagtggaaggagcagtcacgtagggttaaacagatggaagccatgacgttaggagagtgagtgaggtcccagcccagccacttgtcactgtgtgacctcggcctggtcactgggcccccgagcttcggtgcggcagggagggtcctggtgatggaacagaaacagggtgcggggcaggggtaatgactcacgcctgtagtcccagcactttgggaggtcgagacgggaggcggggaggagtttgagacccacctgggcaacgtagcgagaccccatctctacaaaaaataaaaattagcccaagagttcaaggctgcagtgagctatgatcgcgcactgcactccagcctgggcgacagagcaagatcttgtttctttttaaaaagaaagaaaataaaggacggaaggatcatggtgtggggaggacttcagccccgggcggttgcccggcgcgcggactctagcggactagggctccccagcagcccggcccgcgagctggcaccgcccggaatcccgcttacgtccagtccggggcggcgcctggaggcggagccgcccgctgggctaaatggggcagaggccgggaggggtgggggttccccgcgccgcagccatggagcagcttcgcgccgccgcccgtctgcagattgttctgggccacctcggccgcccctcggccggggctgtcgtatcctttgggctgcgcggggctcgggctggatccggcgccggcgccgccgcctgagtggtggccccggtccgggtggaggcctcggggtcgcacgcttcgcagccccagcgcctcctcgctcagcgccgggtccccgcctgggtcgcgtctcttcccggagccggggagcggggaagaggctgcgtcccccgaggacacgcgcggccgccctggggtcggggcaattgccgcgttgccctgccctccgggatccctgggggcctctgctcctctctttgtggagacgtcgtttcaccggcggcgcgtgaccccggcagctgtccagagacccagagatgtccaatcacaggcgcacggtgcacaggcgcgcagggctgcctggaaccggcccaggcaggcagtgaccgggacctctccggaggggagaggacggtgccctcccgggcaggagctggccaggcaggcgctgcccagggcggcctccctgctggactacggcattgccactgagttatataaagacactatttggggaaggacagcgggtgaggactggcgcggcggcacacgccttgcctgttgtctcggctcttctgggggccaaggccaggagtccagggttacagtgagccgtgatggccagtgcgttccaaaagagagaaacagagagaaagaaaggataacatgttaattgatgagagtgacattccgaaagtaaccgattaagctaaagaaacaatgcaattctatgtcaactctctgcagttaccggatagaaaagagatctttaaaaggaatttctagggttttgcttttttggttttttttttttttttgaaacagggcctcactctgtcacccaggctggagtgcagtagtggtacgatctcggctcactcctgggctcaagagatcctcccacctcagcctcctaagtagttgggactacagggttgcgccacgatgccaggcgaatttatgttgttgttgttatgtggtattattattattattattattattattattttgagacggagtcttgctctgtggccaggctggagtgcagtgccgcaatgtcggcccactgcaacctccgcctcccagattcaagccattcccctgcctcagcctcccaagtgtaatttgtattattattagtagtagtagtagtagcagtagtagtagtagtagtagtagtagtagtagtagtagtagtagtggtggtagttttttttctgagatggagtctctctctgttgcccaggctggaatgcagtggcctgatctcagctcactgcaatctccacctcccaggttcaagcaattctcctgtcttagcctctccagtagctgggattacaaatgaacgccaccacgcctggctaatttttgtatttttagtagagatggggtttcaccatattggtcaggctggtctcgaaatcccgacctcaggtgatccatccgcctcggcctcccaaagtgctaggattacaaacgtgagccaccgcccccggcctaatttgtatttttagtagagatggggtttcaccatgttggccaggctggtctcgaactcctgagctcaagtaatcctcctgcctcagcctcccaaagtgctggaattacaggcatgagccaccgtgcctggccttctatattttactttatttgccttaattcacatcctaggtagctcatcccacttcagggactatttcctctgccagtttccatcctcaacaattccagtaagtagtttgagttttgattttgaaatatattatgtatataaaagtttcttgagtggtaatgaagatataccacataatatgttacctgattagaattttattatacaaatcctctgtttccaggacttattctaattagtgcacttgtggaaaattttggagaccgactaattttctgtatgtattttaagattcagaaagaaggaaaaataccagaaaatacataatccgacatttatttatttatttttaatagagacgggcccttcctatgttgcccaggctggtgttgaactcctgggctaaagcaatcctcctgccttggaaaccccgtctgtactaataatacaaaattagccgggcatggtggtgcatgcctgtaatcccagctacttgggaggctgaggcaggagaatcacttgaacctgggaggcggaggttgtggtgagccaatattgcgccattgcactccagcctgggcaacaagatcgaaactctgtcggaaaaaaaaaataaagaatacataaggggccctggaaatacaacagtttccaatgagaagtttctttctttctgccttttggacaatttagaattaaaacaccaccttccctttgctgtcaagcagnnnnnnnnnnnnnnnnnnnnccttttaaaaattcagttaaacatctcatttaaattaacttgtggccgggcaccgtggctcatgcctgtaatcccagcactttgggaggccaaggcaggtggatcacttgaggtcaggagttctagaccagcctggccaacatctctacaaaccccacctctacaaaatgaaaaaatacaaaaattagctgggcatggtggtgtgcacctataatcccagctactcaggaggctgaagtgggagaatcgcttgaaccttggaagtcaaggttgcagtgagctgagatcacgccactgaactccagcctgggtgatagagccagactccatctcaaaaaacaaaacaaaacaaaacaaattagcttgtaatttggttatatggacatattagctagcatctttggtttatcttaaatcacctttaaaggggaagatcttgaccttcctaaatattctcatacaaccacaattccaatcttaaggaataggttgggtgatttgagtttatgggtatgctgtacatttatttggattttgttactttaccttcttggaatgcatcaactggacagttaaaaatatacaatttattgaatttgtttcccatctgaaaaatcatatgtattcattacagaaacatcagagaaatagaaggaattttaaaaaatcatccctaattccatttctaaaggcaatcactgttaaaaattgctttggtgtatttctttgcaggcttttctttttttcatatagtgtcttggttttacataattgtaataatattttattataataagcattgtccatactattttttattttattatattttattatattttattttattttgagaccgagtctggctctgtcgcccaggctggagtgcagtggtgccatcttgcttcactgcaagctccgcctcccgggttcacgccattctcctgcctcagcctccccagtagctggactacaggcgccagacaccatgccgggctaattttttgcatttttagtagaggcgggtttcaccgtgttagccaggatggtcccgatctgacctcgtgatccgcccgcctcagcctcccaaagctaggattacaggcatgagccactgtgcccgccatccatactattatatggccttaatttttaatgtctgagtcatattccactgagtgaacatagtgtcactagttaatttttcttccactaatgcacttttttttttttttttttttctgagacggagccttgctctgtcacccaggctggagtgcactggtgcaatcctggctcactgcaatctccacccccacaggttctagcgattctcctgcctcatcctcttgagtagctgggattacaggcacgctaatttttgtatttttagtagagatggggtttcatcatgtgagtcaggctggtctcgaactcccgacctcaggtgatccacctgcctcagcctcccaaaaagctgggattacaggcatgagccactgtgtccggcccactaatgcacttgttttggtgaccatagttaacattttgaacataaagcgtaagttttcagattatttccttggtcttagaaatgctgaattgaagagcatgaacgtttcctaggttcttgtttttgtctttgtttttgttttttgagacggagtctggctctgtcgcccaggctggagtgcagtgccatgatcagagctcactgcaacctccgcctcccaagttcaagcgattttcctgcctcaacctcccgggtagctgggattacaggtgcccactaccatgcctggctaaactttgtgttttcagtaaacatggggtttcaccatgttggtcaggttcgtctcagactcctgacctcaggcgatccacctgcctcggcctcccaaagtgctgggattataggcatgagcccccacgcctagcctcaggttcttgatacatatttttaggatgtaatttaaattttttttttttttttgagacagggtctcactctgtcgcccatgctggagtggagtggcacaaccagtattttttgtagagacagggtttcatcatgttgcctgggctagtctcaaactcctgacctcaagtgatccacttgcctcggcccgctaaagtgctagtattagaggtgtgagccattgtgcctagcctgtaatttaaaaatgtaacttattttgggattctttttctcctttaggtatactctggataataatgttctaaccctggaacagagaaaattttatgaagaaaatgggtttctagtaatcaaaaatcttgtacctgatgccgatattcaacgctttcggtacagtaacactatttgttattttacaatagtatgtattgtgtgcatgtaatgagaatacaaggtggattcgctcctggctttacagatgttttttaatgatttggtttgttgggaagtgtttagaagcatgggctctggtgccagactggctttttattttttgtagagaaagggtctcactctgttgtgtaggctgagtgcagtggtgcgatcatagcttactgcggcctcaagttcctgggctcaagcaatcctcttgcctcagcctcctgagtagctgggaccacagttgtgcaccaccatacccagctaattttttatttctttgtttttagagacagggagtctcactatgttgcccaggctggtcttgaactcctggcctcaccctcctgagttgctgggattacagtcgggagccaccatgcctgggcttcagtctcagctccaccacttaatatcatgtgtcctggggcaatttacttcacatcccatgcctctgtttcctcatctgtaaaatggggataataatagcacttatgtcctagtgttgttattaggactaaatacggtgaaatatatggaaaccactttgaagagagctgggcacatggtaagtgttacagaaatgtttgctgttattattattacaatgtaaccaaattataaaaagacttccctactggtatgctaaactagggaataatttaattctgggaatggattctagccagacagtttctcctccctttcattggaattattctacctcaagctggaggccaacttagtgcagagaaaccacccctcaagtctgcaaccctttccacagaggagggcagggcaggtgcttggagccagcggtaacgacatcatttgcaaattaaattttctaggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgaggtcagagaccacccttgctttgcgtcggcttaattgccagtgtgtatgtctgcctgtaaaacccgctgatttggccgggcgcagtggctcactcctgtaatccgagcactgtgggaggctgaggcaggtggatcgcttgagcccaggaaccactgctcttagagctggatatggaaaggagttgaattgagtaaaatcagtgggttttattttgttttcttttctggagacagagtctcgctctgttgcccacgctggagtgcagtggtgcgatctcggctcactgcaacctcttcctcccaggttcaagtgattatcctgcctcagcctcccaagtagctaggtttacaggtgcctgccactacacctggctaatttttctatttttagtagatacagggtttcaccatcttggccaggctggtctcgaacttctgacctcgtgatccacccacctcggcctcccaaagtgctgggattacaggcatgagtcactgcgcctggccaatgtcctacatttctgaagaatgggaccagtatctggtggtctatgccatgattttaggaggtataaattattttaatagatatttatttttaaatgtattggaaaaaaactcaacagtctaccaaactcatgatttcaaaaatgttgttaattaggacaagattaaataaaaaggccaggcgaagtggcactttggaaggctgaaacaggagaatcacttgaggccaggtgttcaagaccagtctggcaacatagtgagaccattgtctatattggaaaaaaagaaaaaaacaaagattgaataagagaagtgagctaactgccgggcgcggtggctcatgcctgtaatcccagcactttgggaggccgaggtgggcagatcacgaggtcagaagtttgagaccagcctgagacacatggtgaaacccagtctctactaaaaatacaaaaattagctgggcatggtggcgggcgcctgtaatcccaactactcagtaggctgaggcaggagaatggcttaaacccgggaggcagaggttgcagtgagccgagatcatgtcattgcactctagcctgggcaacagagcgagactccatctcaaaaaaacaaaaacaaaaacaaaaaacaaaaaacaagtgagctaactaagggtagggaaatcattggctaaataacagtacaagttatgtcagaagttgtgaggatggctcttgaatggctggcatttagaaaatcccagcctagatgaatacaaaaaaataccaggctttataaaaagcaagtgtgtgcctgactgctaggcttttaataacctttccagggtttcatactcaaattgccaatattccttatacacaagagatcaaaaagtgaggaagcagtagaaggtggcttattttttggagtcttttttttgcagaatcaaaatttgaatatcatgggttgttttattttcttcttcttcttcttttttttttttttttgagacagagtctcactcttgttgcccaggctggactgcagtggtatgatctcagctcactgcaacctctgcctcctgggttcaagtgattctcctgcctcagcttcccaagtagctgggattaccgacgtgtgccaccatgcccggcgaatttttgtatttttagtagagatatggttttgccatgttggccaagctggtttcgaactcctgacctcaagtaatccgcccgcctcggccacccaaagtgctaggattacaggtgtgcgctaacgcacccgacctcagtgttgagccctttctgctttttccctctccgttgctgggttctgtacacaaggtagcggcagcccagctcccaggccccacgactaaaccagctctccctgtcacggttccccatgttagccttttcttcataatgcagtgtccctcggccactctgacccatgtcattactgggttaacatttttcatctaacgcctgggacctgctttgcttgttcactcttgcttccccatttcccgtcacctcctggttcccagatctcagtaatgagttgtcaagtgccaagcgtccccgattgtcaaatgtcctccaagccaccattctgctttcttccgggctattcatgacagctgtgaattgtatgggactcttcgtatgcagaggctccaatgaggaagaggaaactgccctcccactgagcaaccttctgttgcttgggttgacaagaaagctatattaatatctcatcggaactcctatgtttcttgtagagaaaaaatggtttcattcccagctagctcagaaaaagcccatttcattccgtgttatagatttagaatgatttccaatggctgggtttttcatgccttgtttgcaatgttgtgaaataccgcttggttcttaaactattgccttcttggttcttgtgtggatagctactgtactttgtaccagttgtcaatacttctgatttcccacaaggtttgtttttgttttttttttgctttcttagattctgaaatatgtggagtgcttcactggacctaatattatggccatgcacacaatgttgataaacaaacctccagattctggtaattgtaagggagaagaaaaaaaaatggtttcattaaaatgtgtaaggttggctgggtgcagtaactcatgcctgtaatcccagcattttaggagaccaagggaggaagatctctgaggccaggagtttgagagtggcctgggcaacatagtgaggctctgtctctaaaaataaaatttaaaaatatccaggcatggtggtatgcacctgtagtccctgctattggaaggctgaggtgggaggatcacttgagcccaggagttgaaggctgcagtgaacctataatggcatgctctccagcctgcgtgacacagtgagaccctatctctacataataaataaaacaaaacaaaacaaaataataaaatagctgatgtctaactgtaatcatgtgtacaactgtcaaactttggataaggaagtcttaaaataacttacactataacaacagtgaaatgtggtaattatttcagatattaactgtaggactgttgctgaattttcagatgactggctccccaaaaatgcagtttaaccgacataactgttcatatatcaaaggttcctgccattcgacgtctctaagcttgatcagctctttttagctgtgatagtgtggattcttgcattcctgataggaagacattattattactaacacaattaaaattgttactatgagtcacaaactatagtggtcttttttttttttttttttttttttgagacggagttttgctcttgttgcccaggctggagtgcgatagcgcgatcttggctcactgcaacccccacctcccaggttcaaacaattcctgattctcctgcctcagtctcccaagtaactgggattacaggcatgtgccaccaagcctggctaatttttgtatttttagtagagacagggtttcgccatgttggtcaggctggtctcgaactcctgacttcagatgatccacctgccttggcctcccaaagtgctgggattacaggtgtgagccaccgcgcccagcctatagttgtctttaaaatgtcttgtgcttgctaaaatgtagaatctaagacctcattggcagacagactgattgagaaatataacccaggtttctgtattttaataaccttcctcaagctgggcgtggatgtgcacctgtggtcccaactactcaggaggctgcggggggaggatcgctggagcccaggagttcaagtccagagattgtagtgcagatcacttggactacactgggaaattcctctatgcctgcagtaaaaatcagccatgagagagtcccctatcctttctgccttttcttccttctgatctgcaggaggggtttatgtgatagaaggcagcttagcattaccaggtctctccctccttgaggagagcaggtgttcgggagccacactcagggagcaaaccaggggaaaatgtcagtgtggtcatgggcactccgactggacatggaatgactatagttgtggggggtgaggacctcttagataactttttttatttttattttttttgaaatggagtcttgctctgttgcccaggctggagtgcagtggctcaatctcggcttactgcaacctctgcctctggggtttgagtgattctcctgcctcatcctcctgaatagctgggattacaggtgcccaccaccacacccagctaatttttttttttttttttttttttttggtatttttagtagagacagggtttcaccatgttggtcaggctggtctcgaactcctgacctcaggcaatctacccggctcagcctcccaaagtgctgggattaccggcgtgagccaccgtgcccgtcctgttttgtgtgtttttttttctttttcttttctttttttttttttttgagacagagtctcactctgtcgcctaggctggagtgcagtggtgcgatcttgactcactgcaacctgctgcctcctgggttcaagcgattctcctgcctcagccctcagccttccaagtagctgggagtactggtgtgcaccaccatgcccagttaatttttgtatttttgtagagacgaggtttcatcatgttggccaggctggtctcaaattcctgacctcaagagagctgcctgcctcagcctcccaaggtgctgggattacaggtgtgagccactacacgtggcttagaactttttttgacatcagccacttcgaaggggatttcaaacttgactccatatcactctcttcaatgtaattaatgcaactggtttttgaacatgcattactgcatgctaggtactgtgcccaatccagggtcacaaaagaataaagcacaaggccgggcgtggtggctcacgcctggaatcccagcactttgggaggccgaggcgggcggatcacgaggtcaggagatcaagaccatcctggctaacacagtgaaaccccgtctctactaaaaatacaaaaaattagccgggcgtggtggcgggcgcctgtagtcccagctactcgggaggctgaggcaggagaatggcgtgaacctgggaggcggagcttgcagtgagccgagatcgcgtcactgcactccagcctgggcagcagaacaagactccgtctcaaaaaacaataacaacaaagaataaagcacaacagagatgaggatgttataccgcttgctggaaaatagtgtgcataagtacttagctaccagcaacccggaagaagggagtgcgggatttgaagatgtggagccagtgtgttgatttccaatttggtgtttatctctccggggctgattttctctagcattatttcatttgtttggttcttctggggacaggtcattgttttttcaggcaaaggataagaattctgagaccagcttttttttttttttttttttttttggttgggggtgggggacagggactcgctctctgtcacccaggctgtaatgcagcagtgcaatcatagctcactgcagcctcgacctccaggctcaggtgatcctcccacctcagcctcccaagtagctgtgactacaggtgcatgccaccacacccggctagttgtttttgttgttttgttttgttttgttgttttgttttctgtagaaacggagtctcactgtgtttcccgggatggttttgaactcccaggctcaagccatccatctgcctcagcctcccactttgggatatatttttatatcccaaagtgctggggttacaggcgtgagccactgcactcggcctcgagtatcctttagtagcaggttttcttttcaggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggtaggtctgcccggcggctgagtcttgatccgaatctccttcgcagtttctgtttcacatcagtacctctaaagagtttacaaatgagatggcatttcctttctgagcaaaacattgtcctaagatttgcagtgaggatcagagaaagttcaaggatgtcagagaaaacattcatcacacctattttcaacactttttttgtttgtttgtttttgagacagggtcttgctcaactcactgcaacctccaactcccaggttcaagccatcctcccgcctcagtcgccctagtagctgggactacgggtgtgcaccaccacgcccggctaatttttgtggttttagtaaagacagggttttgccatgttggccaggctggtcttgaactcctgacctcaggtgatctgttcacctcggcctccctaagtgctgggattaaaggcatgagccactgtacctgcccttaacacgtgtttgaaagccagccaaggtggggagcttgggtaggtactgtataggatccgagattgtaagtcctagctgcagaggtaagacataaacccttcgaccccagatgtgtgtggtagacaccaagtcagtcttactcactaactgatggctctcagagtaaggaaggagagattgtctccttgcaactgcagagaccagcaaaggatctggggaggctggtgtctgacctgagccttgcaggacagtgtacaatgtcccatagggaagagtcgatataggaaggcacaaggtcaagggcaagcctgaacttgaccaaagaacaggaaagacccagggagcttgcagtctagatgggctgggcgctgggggtgtattttggggagcagcagaggaggtgagcccaaaaatgtacattaggaccagattagaaaagactgttttactaacaagtctgcagtttatttgggggaagaatgggaactttttagttcaaacttttaggaagatcgaagaccctttttgtttttttgttgtgttttgttttgttttgtttttgaggagtctcactctgtcaccaggctagagtgtaatggcacgttctcggctcactgcaacctctgcctcctgggttcaggtgattctcctgcctcagactcccgagtagctgggattataggcgtgcaccaccacacccagctaatttttgtatttttagtagagacgggatttcactatgttggccaggatggtcctgatctctttaactcgtgatccgcccacctctgcatcccaaagtgctaggattacaggcgtgagccaccacacctggctgaagagcttttaatcaaaaaacaaacaattaaacaaataaacagtttcattgaggtataattgtcatgtaaattgtacatattttgcatgtataatttgatcattttccacacacacatacctgtgaaatcatcaccacaatcaagatactccatccttctccctgctctaggcaaccactgagctgctttctgttactgcaggttagtttgcattttctaaaatgtcatagacatgtaatcacatagtatagatttttttgtcccgttctggcttccttcactcagtgtagtgattttgaggttcattgatgctgttgtgtatgatagtagttttttgttgtttttttttttttttttgagacagagtctcactctgtcaccaggctggagtgcagtggcacgatcttggctcactgcaacctccgactcccttgttccagcaattttcctgcctcagcctcccgagtagctgggactacaggcacaagccaccatgctcagctaatttttatatttttagtagagacgagttttcactatgttggccaggatggtctcgatctcctgacttcgtgatctgcctgcctcggcctcccaaagtgctgggctcaccgcgcctggccaacagtagttctttcccttcccttgctgagtagtattccattgcatggctgcaccgtgaaccatggtttgttcatccattcagctgctgatgcttggaaatgttaaatgcatttgagctcatgagtgatgggatcaaatcggctcttcaaggacagtaatgtcacgttctggtgcaggacgcgttggaggtataggcatctagaagcaaagaaaccagagagatgactattaacgcgttaggtctaaggtgaaaagaccctgtgggagccaaagtgggaggatcgcttgagcccaggagttcaggaccagcctgggcaacacggtgaggtctcatttctaaaaataataataataataattagctgggcatggtggcgcatgcatgtagtcccagctattccagaggctgaggcaggaggattacttgagcccaggaattcgaggctgcagtgggctatgttggtgccactgcactccagcctgggtgacagagcaagttcccgtatcaaaagaaaaagaaaagatcctgggctgggcgcagtggctcatgcctgtaatcctagcacttagggaggctgaggtgggcggatcacttgaggtcaggagttcgagaccagcctgaccaacatggagcaaccctgtctctactaaaaatacaaaatcagcctggtgtggtggcgtgcgcctgtagtcccagctactcaggaggctgaggcaggagaatagcttgaacccaggaggtggagtttgcagtgagctgagatcgcgccactgcattccagcctgggcaacaaagcaagactccatctcaaaaaaaaaaaaaaaagaaaagaaaagatcctggaatcccatgatgctgcgaatggaaagagcccccattgttaaagcagggagaatgagttgtagttcgataggaaatgaggaacatggttttaggaactcctaactcgtctggacacagtggctcacgcctataatcttaacactttgggaggccgtggcgggtggatcacttgaggtcaggagtttgagaccagcatggccaagatagtgaagccctatttctactaaaaatacaaaaattagccaggcatggtggtgtgtgcctgtactcccagctattcgggaggctgaggtaggagaattgcctgaacctgggagatggaggttgcagtgagctgagatcgcaccactgcactccagcctgggcgacagagcaagactccatctcagtaataacaataataataataatagaacgtctcagatttcttgcaccaataattagtgtcaaatgaaaatatgtgagtgtctggatcctgatataaaaccatttaatgtgaaactcatcagtgaagccaaggtttaaagtttggtgcatgcaactgcagtgggctttggctgacagaaggcaaagggaaaagtttgcagggcttccagagcgtgtggagtctcagataccctgctcagatgcagagtgggaggtatgattagcttagtgtgggtcacacattcaccctggccaggagagaagggctctgggtcagagtctcagcactgtctaagagggatgtcgtcattcccagaaggaactggggatgctcttaggaagaggaatgggctgcttcccttaccctgactcctaaggtgcttctcatgtcaatttctttaataaagacataaccgcattacctaaagtagcaactaatttgggaaatagttacaaacaaacacagtgttttaatttactattctttcattattctggatgtaacataagtgcctttgagctcagaaaaattgagcattttctcccccctattttggggaaatagcttctcagagacactcctgagtaagagatgaaggatttatttaaagttctgggcgaggaggagaacacactgggaacactcacagtttcaggctggaaatgcccaagagataggtggttgcctgcattaaccacaaaaggcaaagctaagctagatcttcatgtataatgcagtcatgaagggcaggtggaaattccacactgttcatttcctccaaaaaatcagtgattttaatatcaacatgtgacttctttttttttattaccattatttttcgagacagagtcttgctctgttgtccaggctggagggcagtggtgtgatcatggctcactggaacctccccctcccggctcaatcgatcctcccacctcagcctcctgagtagctgggaccacaggctggcaccaccacgcccagctaatttttgcagtttttgtagagatggggttttgccatgttgcccaggctgatctcaaactcctgagcataagcaattctcccaacttggcctcccaaagagatgggattacaggcatgaaccaccatgcccggccaaaatgtgactcttaaaaaccagatatctgagaggcttttgtatactgaaaaaaatgtaagcatttaatttagacatttatttctcttgggagagagaaatgctttctttccctgatgtttgctttccctgatgaaccattgacaatgtttttaattatggtactccctcaaatgtagacttcacttgcctcttgttctaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggtaagcattcacattgctgcacctgctgcagaagtgtgggttagaaacaaaaattgtattcaattcattgaattcaaattaattgaataaaattttaattaaattgcattaacattttaaagatttgtggcttttaaccaacctggactttagtccagtttatttaccaggaaatatatttgcttaccttgggctttctgtgctcttatcagtaagaagccaggtgacctcaggatcctaaccttgtcaatattgattatgggccgggcgcggtggctcatgcctataatcccagcactttgggaggccaaggcgggtggatcacgaggtcaggagatcgagactatcctggctaacacagtgaaaccccatctctactaaaaatacaaaaaattagctgggcgaggtggcgggcgcctgtagtcccagctactcgggaggctgaggcaggagaatggcgtgaaccccagggggtggagtctgcagtgagccgagatcgcgccactgcactccagcctgggcgacagcgagactccgtctcaaaaaaaaaaaaaaaaaattgattatgaaagccaggtgcagtggctcatgcctgtaattccagcacttccggaggctgaggcgggaggatcacttgggaccaagagctctagaccagtctgggcaacatggcgagaccccacttctactaaaaaagaaaaaatcactgttgtctcctgaggccatgggttaggggccaaatttcgtcttccattcattcatatttccaccagcctcatcagggtcaggattagggtgggacaagttggggcactctctccaggggtaaaatgtaaggggatgccaaaaaaagactctgcaatcgagtttagtaacattttaatgcgaaatttaaaaaaatcaaaattaatgcaaaatacccaatgtattggctgcgcacaatgccaaaagtttaaataaaagacactattggaccccacactagcacaaccttcagagctgtgcaagtagcgaggtgcaggcacaacgacacaaatcatgttgtgggttttaatatatagacttggcaattttccttttttcttttttttttttttttgaggtggagtctcactctgttgcccaggctggattgcagtgatgcaatctcagctgactgcaaccttggcctcccaggttcaagcaattctcctgcctcagcctcgtgagtagctgagactacaggcacacgccactatgcccagctaatttttgtattttttagtagagatggggtttccccaggttggccaatctggtctcgaactcctggccttgagtgatcgtctcaccttggcctcccaaaatgctaggatgacagatgtgagccatctcgcctggcccaatgttttttaatgcttttattttaaaacattttattatttgtttatatatttatttgagacagcatcttgctcttttgcccaggctggagtgcagtggtgcaatcatagctcactgcatcttggaacactgaggctcaagccatcctcccacctcaacctctcaagtagctgggactacaggcatgcatgaccacacctggctaattttattttttcattttttgtacagacatggtcttgctatgttgcccaggcgagtcttgaactcctggcctcaagtgatcctcctgccttggcctcccagagtactggaattacaggcatgagccaccgtgcccaggcttaatgactttaatgttctgggaaaatattactataatttcataaagatacagatataggggtgcgtgttttccctttgccttgggctctgttacagtgccgtatggcaccagggcttacagaggcaatggagtttgtgactccactccctagaaatttgttgtttggggcaaagtagaaagtctttctgacaagtgtgatcacttgtgacaaaaaaggtaagttttaacgattgccttgcagcttagatctgtttataactttttctaaaatagggagaaccaagcaatttcatccttaccctcagaaggaagcaagaggggtaatatatgtcactggtattggcttttaaatgtccttttgatttgagagaaggtgtctgcattattttctatctcaaggtatttttagttcttttcataatctattgccactgaaataacaattcatcccaaattggaccaggtaactaacttatgagataaactgccgtggaatgcagtccttcttaagactttgggatattcattcattaggaaaataaaatgctaaaaaaaaaaaaaactaaatacctcttactgacataattccattccctctcccatatatacctttcaaaaatacatgtcacatctggttaacgatcttttgaaatttctcaattaacttctagctggaaacaaaaacaggcttagttacaaagagattgacacaggatgcaatggacctgactttccacttagaaatcaaatactgagtgaaataaatgactttctaaaagaaagactccctgcttggtcactggtattcatgggatgtttttctccaatatcaatttgttcactttgcacaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggtatgtttgtatacaatagcaaggtaaaaatctcaggtttttcttttcttcagatgcttcataattctcatacctagtttatttgacagtatatagtgcttgggtttagattcattttagggacatcgctgagcccccaccaaaaatgacaatggaatttccatttacacttgtgcccccgtgcaggaggcttgagaacttcctgctgcttctttatgtcttggggctgtccagaggtgtgctggctgtcctgtttcacacaggacagtaaaggaaaacaaaactacagattgagatgagagaaaatcaaagacaaaaccttgccttctggctgggcatggtggctcatgcctgtaaatcccaacactttgggaagccaaagcaggagaatcacttgagctcaggagttggagaccagcctgagaaacacagtgagactccatctctactaaaaaagaaataaaaataaaaattagtcaggttgggtggagcatagctgtagtcccagctactcgaaggctgagttgaaaggctcacttggagcttgaggtcaaggctgcagtgagctgattgcactactgcactccagcctgggtgacagagtgagaccatgtgtcaaaaaaaaagccttctgaagggatagaaggaaagttataggtttgagatccaatcataggccatgtttattaatatagaatagagtatttatggctgggcgaggtggctcacgcctgtaatcccagcactttgggaggccaaagcaggcagatcacaaggtcaggagatcgagaccttcctggccaacatggtgaaaccccgtctctactaaaaatacaaaaattagctgggtctggtggcacatgcctgtagtcccagctactcgggaggctgaggcaggagaatggtgtgaacccaggaggcggagcttgcagtgagccgagatcatgccactgcactccagcctgggcgacagagcgagactctgtctcaacaacaacaaaagaaggaatcttgcttctccctttagaacctggaaatgtgtcgcatctctgaaaatgctctgattttgcatttgcaggtcctagaaattcttgtccttcctcactttttgttcagtacctaaaatgcctatacattttgtcaactggagctttgagctaacatcctaaattttaagggagaacaaatatatgtacattatgtttgaggtttgtcaaggttgtgctaaatgaatacctcccacatttagtttaattactctgtaagttatatttagaataacaatattaacctctgctacatagttctctgtaaagtacaaaagcacattcatattcattttcttattttcttcaccaaaacccggtggggcagtataaactccatgctgtcaatgacaagaaaacaaatcccagaggctgatctaagctagctaagcgacaaagcttgattttagagtcaggtcaaatctgaaaattattctttccaccataccttgctgtttgctcaaaaataaacaagaaccaagaaataagaacatctaaattattttattaagggcagagggggaagaaacccaccaaacaaagcagtaatccttgataccatgttcactattatcatctcatcaagagtagaacactcaaaaaggctcagacaagtaacataagagtcatcaggccaggtgcagtggctcactcctgtaatcccagcactttgggtgtttgaggcgggtggatcacctgaggtcaggagtttgagaccagccttaccaacatggtgaaaccccgtctctactaaaaatataaaattagccgggtgtggtggcacatgcctctaatcctagctacttgggaggctgaggcaggagaatcatttgaacccaggaggcagaggttgcaatgagccaagatggtaccattgcactccagcctgggcaacaagagcaaaattccgtctcaaaaaaaaaaattatgcagaaaaatggcagtgaactgtttgttctgtaacccgacatgacattgacccagttatgttagctggcaccaacaaatatcctgaataaaacagaactgacagcagctgggggacccactgacttaatttagttaacactgttttagaagtcggttaagtagaccaggagtggtggctcatacctgtaatcccagcacttgggaggctttgcaaggccaaggcggacagatcacttgaggccaggagtttgagatcagtctggccaatgtagcgaaaccctgtctctactgaaaatacaaaaagttagctgggcgtggtggtgcacacctgtaatcccagctactcgggaggctgaggcaggagagtcgcttgaacccgggaggcagaggttgcagtgagccgctgcactccagcctgggcaatggggtgagactgtgtccccaaaaaatttttaaaaaagagttgagtaagtagtttaagttgagttgttttgtttactaatgaatataacttacagggattattttccctatgtaacctttcatagaagctagaaatcaattttgtgttatggtgaaattgaaggtaaatggagggcagattgaagtgttccataaacccactctgtttgatattatttccaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggacaagggctttctcctgtgatttcttcaacccaaccattcccttaacaagaagacttgttctttccagtcctttcctctgttcctgaagaatgaagacaagggccaggtgcagtggctcacgcctgtaatcctagcactttgggaggccgaggtgggtggatcacctgaggtcaggagttcaagaccagcctggccaacatggcaaaaccccatctctccaaaaatacaaaaaaaaaaaaaaaaaaaaaatagccgagcgtggtggcatgcacctgtaatcccagctactcaggaggctgaggcagaagaattacttgaacctgggaggcagaggttgcagtgagctgagatcacaccactgcactccagcttgggtgacagagcaagaccctgtctcaaaaaaaaaaaaaaaggaatgaaaaataaataaataaaaagaacgaagatgagggtgacttcatttgatgtatcttattgggtagggctgctggaaactttccacatttatgaatgaagcctaacctccttcaagctatagggaactttttagatacttttccctggatttggagtgagcatggactgaacaaacttatttcaagacagcaccatattttcggtaccagctgagggcagcaaggagacatagtccttatttttacaaattttagttagggctttagtaagaaagaaataacagagtacctttcttgtcattctgctaagcacaagttttcctaaatctagtgttgccatgagtgccgttttgtttgtgaggacagccaagtgaagctcatctcccactgggaactggagaaggcagatcactgacagaatctaaggaaattagattatgggatgattggaaataaaacgtaataaaggaatgcctgtgtaaacaacatgtggggagccctgctttgttatggaataaactctaaattgtttcaaatttaaagtgaatatgaaaaactaaatttcagtaggaatattgaagagcaatttgttatttcctgtgtgcctttgtgagtgaaaaccaactggttgccatcaggaaacattcatttcccatctgatccatgtcccttttgtccattagtgcatgtaagaaatattcaagcacccactctttttttttttttttaatttttttgaagacacggtcttgctctgtcacccaggctggagtgctgtggtgtgatctcagctcacagcaaactctgcctcccaggttccagtgattctcccgcctcagcctcccgagtagctgggactaaaggtgcacgccaccacacccagctaatttttgtagttttagtagagacgaggtttcaccatgttggccaggctggtctcaaactcctggcctcaagtgatccacccacctaggcctcccaaagtgctgcgattacaggcgtgagccaccgcgcccggctaaaatatccaagcacctactctatgaagtgggactagatgtcaggatgaggtagggtgcctcaaactgtccgcgcggacctgtcctgtgaaaggtggcagtcagggttggctggaaaatgaagagtcagggaaggaattccaccagatttcatcagactgaggggaggtgggaggggatttgtcctgggctcatgtccatttcaccaaagtctagtctaaaaggactttataaggtgctcgaacaaatcacaaaacaaaacaaattgcaaggatcctcttctgtgaattttgagactaatagcttgtgaaaactggaggcctttgctccttgtgtgtgcttggagcctccccctcccccactcttttttctatggtttttttttggggggaggagttgtttatttgtttgttttgttttgttttgtttttgagacagagtcttgctctgcacccaggctggagtgcagtgatgcgatctcggctcactgcaagctccgcctcccgggttcacgccattctccttcctcagcctcccgagtagctgggactacaggcgcccgcc

SEQ ID NO: 16637 - DNA, 22120 bp, Human
  misc_feature (1)...(22120): n = A,T,C or G
aagaaaattgatctttggattctcataacacatttttttaaacaggctacttattttagatatttatttttccccgagtagaatggattaattacaagtaatgacattggatcagtcttgcctcttttaagcataggcctttactgtaatctgcttccaaacaatcccaataaaatcgttgattttaagagtcaaaaagttgctcagagccttcttcagggactcttaactttttctgccacatggatcctttgaaactctgataaaagcaaagctatagacttcctccctggaaatatacacatgcaccaagattttgggataaacacannnnnnnnnnnnnnnnnnnnnnnnnnnnnnnnnnnnnnnnnnnnnnnnatgaaagcaatagacccagggagcgaaaacagcctgtttaggggctgaagacagaacccagccttctgatactgcttactccactgtctctttagatatcattaagttcccttggcccccaaaactcccatctgtggatcccctgagtttagaagaacttccacagtaccttgtagcctaccttttataactggagtcacgccggaagctggtcaaagtttaccttttacttattggagaacaacaggtacaaagcagagtttcttatattaaattgggacatttttctctttttttcctcaaaaccgagaatggaagtgaaaattaaaatccagcaataaagggttttctttttagtttaatgaaatcaactctaaaatttgcttttatttatattctgaaatttaaaactttgttcttcgttgatctttataacattggaaagattgaacttacactttgctctgtgaatctttcaatggtttgtgaccaaaccataaatttcaacccgacccaggaaatttctgcgacttgtgcccacccagttttgcagtttggaacagaattcttgctcccaatccaaatagagactgagagaaatgaaagaggacccagaaagccttttcttctctgtgaaaggcctgatcctaagtggcgcaatcaataaagaaaagggttcaaggtgcagcctacaaatttcttagagtttaatgtgttcaggttgaggtggagaaattacataaacctgtgaatagacatggaatagaagccatgtgtatatgcattctgtccctaaaggttttgctaggtacttactaagctattccttctgtgcaatcatctttcgtttttctacttgtatggatgaaagcctaccttcactgaacacttcaccttatgtgccagctattgttctaaacccattacattatttaatcttcacgacaattctttaaggtagtcttattactatgctcattttatagatgagcaaacaagttttcaggggtcaagaaatttgagcaagttcacattaacttgtaaatcacgaaattgagcatcagatacaagcatctggctgcacttcctgagtttgtacgtcctactctcataaaatagatacattgaagactgagaaagaatactgttggccgattcctcaggcaataattttttcgatattgtattgttgtctcagaaacctccagcctctctcattgatggacggtaggaggggcacatggagtggaccaggagtgggcaggagtggggtgggggcgtgcttttagaagcgtttcgggggaacgacaaggcgcgggtcgtagaggtctaccctctctgcagtcccagcatggctcctggagctctctgggcggccgctgaccccgacatcgcggcggcccgcccccagcgccgcgctgcccaatcagcggcgcggcctggtgccccgccactccgcgccggccatataggcctcctcctggcgcgcctccgcaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggtgaggcggccaggccggtgctgggagggccgggcctcgcaccgcggctgccgcgggctttgtcccgggacaaaggggggcggccgggcgaggcctggcaggggcggcctgacaatgggggccgggcggcgcggcactcgctctctgggggtcctggggcctggaaagcctgaggagatagcacggcccaagagctggatcccttctacccctcagatcatggagggtgtgtagggggtaggggccttgaagtgcaggtgcgggtcaccccgaaaccctttggcaagggggtcttctagtagccctgtttttctccaccattttgccccactgatagtaatgcttggccctcctgtgtgtcgcttccccctaaaggaagatgtggatgaatatgttaaactcggccacgaagagcagcaaaaaagactgcaggcgatcataaagaaaatcgacttggactcagatggctttctcactgaaagtaaggactgccctacacgactaacaatggagacaaacacaaatatgttaagcagcggtgtctgctgaatgtatagattgctagtgtcccaagttggaagtcctgtgagaaggagaaaaggacatggagaataggctttatacttacaaatctttagacactgagaaccaagtaaaactcggtgctttctccagttatatataaacatcattgaccctgtactctatgtggaagtcacaccttgagacaccctctttctcacgtgacttttgttagtgtcaacaatatgatttattttagagaaatatgccccaaaactttaaggcagtaaatgatttatcgctcttttgatatatgcttcatttaaattttaggaatttgcttctttttttaagcaagtagaaaaagacctgttgcctgtgaattacgtttattataacattataccaaaatgttagagctggtaggggccttgggatcatcttgtccacatcactttgtagagatgaagaaatgaagcacagggataagtgccttctacaaataagtggcaaagctggactagaatccaggtatcctgctcttaattcaggttttaatatccttcagttaaaaaaaaaaatctgatgctctcaggtaaattctctagtcagaaatgaaatgcacagactattaaaagaatgttctaaataaattgctgtgcagttgtctctccccattgttcaattcaaatgatgttccctgtcagcgttccaagtgggtcctcagaaaaattcaggttgttattgtgactcttaagttagctgtttttctgtaactctcatttaaatgctgttcaccatcaaggaattaagttgctggagacaattaaaaactggtaaatttaagatgtgctgtcaatgacatattcacattggaaccctctggaagattaagggcttttttcttccacttagttagacaataataacaagacctttggtctctgattatccaatctaagaataagtcaatctttggttatactagagtaatcaaagaacacaacacgttgatttggaagactgcgtggtacctatctgtcaagacctagatatgttcaaatatttaatagtaaggttttaagaagtttaaacttagaaaagttttagtccaaatattcattatacagatgagaagaaaagcttgagatggtaaactaccccctgatggcaaagctgaagtgtgaacccacatttctgatccctgttccattctgttttcttctatgccatggtgatctctttaaataaactagaagaaagattcatggtgcttacgaaagccttcattctacttgaggacccttaagataattttggcaatttgctctttgagggccaggtctggaatcagatgttaagaggtagcaaaactcagtaggagttggctttgaagccagacaggtttgaatctggactctgctatttactagttgtgaaggcttggacttttctgaacctcagtttcctcacctgtataatagtgatgattataattgcattgttttgaagattagaggcaacatgtacagaggaacctgataaatggtatactcatgctgtcctcacaaatattcgtgttcgtccctccctttgtttcctttaacgtagtttagtaaatatttttatgaatagttttttgtttttttttttgaggcagagtctcgctcttgtcacccatgttggcgtgcagtagtgtgatcttggctcactacagcctctgccacccaggttcaagtgattcttctgtctcagcctcccaagtagctgggattacaggcactggccaccatgcccggctaatttttgtatttttagtagagacggggttttacccgagaccaggctggtctcgaaatcctgaccttaggtgatccgcctgcctcagcctcccaaagtgctgggattacaggcgtgagccactgagcccagccaaatagattttttaaaagttgattgaaaagtgaacatttgaattttagaaactttcccatgccttcaggtaccaagttaagacagatagctgttgcaggaagggcataaattgctacccataacttcgttaaaatttactccagatgttttaacaacatatttaaaggtaatatactgaagcagtattctcagtcacttgaataccttttcagaatttaggccatatctacttaaccatctattattttcttactatagttttaattcaactcacataaaatttattttaaaggaagactttatgtcaccttcataaataaaaaacactgttttttctcatacatactaaaataaatagctatcaaaatatttatgcttcctgagagatctgtggtagttagcaaaggttttctgcaagattttggataacattttttttaaaagtaaagtgctattttggccagttggtaattcattcaacaaatacttacagagccaggaactttccaggcatttgatgtacatcagtgaacagaacatacccaaacttttatggagcttacattatatttagatcatatgttatagtatggaagctccggccaggcatggtggctcacgcctgtaatcccagcagtttgggaggccgaggcaggtggatcacgaggtcaggagttagagaccagcctggccaacatggtgaaaccccgtctctactaaaaatacaaaaaattagccgggtgtggtggcacatgcctgtagttccaactactcaggaggctgaggcaggagaatcgtttgaaccgggaggcagaggttgcagtgagctgagatcgcaccactgcacactccagcatgggtgaaagagcgagactccatctcaaaaaaaaataattaaaagcttcatgagctcttctaaacagcctttcccacttcctaccccatttctattaatacaactaggccaattctcagtatttgcaaacatcaaagattttgccttttcagagaaggtttggaaatccttactcttaagtatcagaattaacgtcacatgcgttgtgttctgggaaattctcataggtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaaggtgagttcatgtgcacaagctgtttcttttgatcatgtcagttcactttaccttcctgcatgaatgagcacattgagggcctgaggtcataagctggattgtcttgttctctaggaaatcacctgttccacttcagcagtcattttgatggtttcctttctggccagatttaggactcttattctaaattacctacatgatccttctatctgtttttctcggctgcatcatttaattgtcctcatttccagagttgctttttaaatgtgttttgaatgagtatctcaatattttaatatcattgaataatcagttttatctttattaagaaggccattatggcccattcccatttttaaacacatagttttatatactcacttaaaaaaactgcggtttccacatctgtggattcaaacaactgagaatcgtaagtatccaaaaaagtaagtattaaaaaaaaaaaaactgtgtctctattcaacatatacagaacttttttctcttgattattccttaatatagtataacaatgatttatttctcatttaagttgtaatttatattataagtaatctagagatgatttaaagcagaggtccccaacctttttggcaccagggaccagtttcatggaagacaatttttccacgggacagtgtgtggcgggggggtggggaatggttttaggatgaaattgttccacctcagatcagcaggcattaggttctcctaaggagtgcgcaacgaagatccctcacatgtacagttcacagtagggtttgcactcctatgaaaatctaatgccacccctgatctgataggaggcagagcagagctcagacggtaatgcctgccactcacctcttgctatgtggcccagttcctaacaggccatgaaccaatacccgtccgcgacctagggattgagggtccgtgatttaaagtattcaggaagatgtgtgtaggctatgtgcaaatactgcaccattttatatcagggacttaagcattctcagattttgatagggaggtcttggaaccaatttcccaggaatgtgtgagggaggactgtgtaacaaattgaccattgtaaccattttaaagtgtacagttgagtaatattaagtacattcatggtgttgtgcaaccaatctccccgactcttttcatcttacagagtggagactctctacccattaaacaataactccccattccctcctcccactagctcctggcaaccactgttctactttctgtctctgaatttggctactctaggtacctcatctaagtagaatcatacgccgtatttgtctttgtaactggcttatttttacttagaatcctcaagattcttccattttgtagcatgcatcagaatttccttcctttttaaggcaaagtaatattctgttgtatgtacaggttgagtatccctaattccaaaatcaaaatgctcttaaatatgaaacttttggagcactgacacgacactcaaaagaaatgctcattgaagcatcttggatttgggatttgcaaatctctgtgggatcctgctttccattggtttgggtatatacctggaagtgatactgctagatcatacggtaattctatttttaattttttgagaaaccacagtaccatttttcatagtgagtacaccctttaaaattactccttttttttttttatttttattttttgagacagtatctcactctgttgcccaggctgaagtgcagtggtataatctcggctcactgcctcctgggctcaagcagtcctcccagcacagcccccgaagtagctgggatttcaggctcaagccaccacgcccatctaatttttgtattttttgtagagatggggttttaccatcttgcccaggctagtctcaaactcctgaggtcaagtgatctacccacctcagcctcccaaagtgctaggattacaggtgtaagccacgacacctggccccaaattactcattttttgaaaatttagtatctgtgtgagttctaatgtgtctcatggtttaatttgttgaaatatatgcttcttaagcagagctgagaaagactaattttatttaggaattaggaactttttaacacttctaggaagtctattaaactaaaagtatatcaacagaaatgactgtgagcttgagaaattgatatatcaaatacttttgtatttcaaagctaattttaaagaattaaaatcttttttataggtacatgatagttgtattatacatacttacagagtacatgtgatattttgatatcacacaaacgtatattataatgatcaaatcagggtaattagaggatcaccaagaatttttttaagatagtttttatgtgtagaaaaacataaaaataaaatcaaacatgctgttgcaaactgtcccaaaatattagtcaagggtgcttggaaaatattcaaggctcttctgtttcttaacttatcctgttttggtatataccttttaatttttgttgtggccataatttattgtattaaacaatatagtgtaacaatgatttactcctcatttaaattgtaatttgtcttataagtaatctagaaatgatttaaaatatttgggaagatatgtgtaggttatatgcaaatgctatgccactttatatcagggaattgagtatccttgggttttggtatctgtgggaggttctggaaccaatttctcacaaatatggagggaggagtgcataacaaatttactattgtaaccattttaaagtgtaccattcagtagtgttaagtacattcacagtgttgtgcagctaatccccagaactcttttcatcttggaaagctgaaactctgtacctgttaaacaacaccccattccctccttggtaaatgctttctaagtgtgctatttatttagaatcatattggccgcttgaactctgtaagccaccactaactctaagttggttaattctctgctaataactacagcatcaatgtggaggtttggggctccatcctcagagccagtctgcttagcttcacatttagctccagcacttcacggttgtgtaactttgggtaagttattaaactttcatgtgcctcagtttcctcatctccaaaaatgaggataataattcccattcaggccaggtgtggtggctcacacctgtaatctcagcactttgggaagccaaggtgggagaatcacttgagcccagagttcgagaacaactgggcaatgtggcaagaccccgtccctatggatacattttcctcttaaaaattaaatcctaactaatctaaagctgtctagttaacaaatgcccaaacaaaatttaaaaattagatgggcatgatggtccgtcctgtgatcccagctatttgggaggctgaggcaggaagattgctcgagcccaggcagtcaaggctgcggtgagccatatttatgccactacactgcagcctgggcaacagagagacctcatttctaaaaataaataaataaataaataaataaataaataaaaatttcctctttaggattataatagtgtggataaatattaataaatggtagcagttggaggggcaagcagttctgttttgatttaaaagaatattgaagaaagcatttacagttcacataaatttatatttaatcaactttttaaaactttatgcatttgttaactatcagctttagattagttaggattttattttttaaggggaaaatgtatcttttgttttctttttatttgggtcttcattctacagtggactaaagtgagtaaaaatcagtctttttactgcttgtaaatactaaaggaaaaacaagtagtgataatgagatttgggatcatctgtctattaagtatccccatttactataggaattaacttatcttaaaccaatgtaacttatctaaaaccaaagcatggtgtggtgtggtttcccttcctaggaacaacagagaagttaaatacagtattttaaaatcttgctggaattagattctaattatgttttctatttttattttttgttactcaaaagacttaattactatcccattaaaaaataagaagtgcatgttcctgtattcttagaagggggtgatgtaatagatggtgctgagaagaaaatcttcactttgaagagatacatgactcataaattgtttatgaacagttcttttaaaaggtgtctggttctaattctgtgttctccaccagctacttagaatgtgttgattataacactctgcttttaaaggatgaattagatgaatcttaacagcctaaaggaatagattgatcccgaaaatgaacacttcaatgggagtccttttggttatttttttttttgacagcctaggaatatgtctctatcttcatgaagttctaatcatatgtttttagaatttgctataagtaacttcctgtgtgtatgtgtagtcccagctgctcaggaggctgaagtaggaggattgcttgagcccaggaatttgaggccagtctggacaacatagtgaaaccttgtccctttaaaaaaaaaaaataacgtcctaaaaattgatgtggagtgtaaagatgaacccagaaaccatatgcattatttttctaaataaaaaataacggatgaggaatgaatcaatctcaaagttatagactaaacactataccataaataaaataatcataaaaagtaattggatatgtgaataaaataaagttttctataagaaagtctgttataactgacgaaagtcagcttaatatctgaacttcaccttttttttttttttttttttgagagggagtgtcgctctgtcacccaggctggagtgcagtggtgcaatctcggctcactgcagtcttagcctcccagattcaagcaattctcctgcctcagcctcctgagtagctgggactataggcacgtgccaccatacctggctgatttttgtttttgtttttgttttttttagtagagactgagtttcaccacgttggtcaggctggtctcaaactcctgacctcaagtgatccacctgccttggcctcccaaagtgctgagattacatgcgtgaaccaccatgcccagtctgaattttatcttatatttaataagttttcatatagggaataaagataaccctttcaggctgtgaaatgcctgaagaagcatttctttataatataaagaacagttatggtcaacacaggataattaaagtttggggatctatctggcaaaagttcaagtgttctttgtttttgtttttgtttttgttttgagacggagtcttgctctgtcacccacgctggagtgcagtggggcaatcttggctcactgcaacctcttcctcccaggttcaagcaatcgtcctgcctcagcctcccaagtagctgggactacaggcgtgtgccactatgcccagctaattttttagtagagatggggtttcaccatgttggccaggctggtcacgaactcctgacctcaggtgatctgcccacctcggcctcccaaagtgctgggattacaggcgtgactgctgaatgtgcatgtataagcagtatttatttatgtaagatataaccttgcatgtggctaatcagaatttttaatgcctagtcatttgttctagtatcacacattatatatttcctcatgtagaatcattagtctaccaaaagatggcagttttgttcctcacaagtttctgttgtaatctaaaaataaatgattatggtagcttttttattactgtacctaacactttttaccctctactagaatacaaagtttttatatacaagaaaaaaaaagagtgttgaagttttatgaaactgaccatcttttttgttatttttttaggaatttgccatttgtaaaaaacagtctttctgtttttggcttcttcgatttaatgtgagctattcttattttgtgttcttcaaatggccgtgaaatgtgaaccagaaaaagctacccccttcactttttttttttttaaagaaatctcagcttgttgaaagagatcctttctttccataggcaaatttggccaaatttagctcttctcctgaaacatggacctttttgctccaaagtgaagggttctttcataaggaaatcaaagcacttggtattttgaataatggtttattcaaaaagaacttgattgactcagcaaagtacctcaaattcttgtttgtctgcttttaccatgttaaacctgaacataaaatgcaaattatttggtctagttatttaaaattttgaaacattaagttaaaagctatttggaaacaagttattattttttcttttctgtcatgattgggtgaatataactggcttgtagagtctgatgttaataaaacaaattctttggggaaagaggtgagcctctccgctgtaaatcagtaattgtaaaagaactagtgtttaggtaaatgactgctacctgacctctattattctagaagactgaagagggtatttttattcagtagtgaaacacttaaaagcttctaaaatatttgaaattgtgctttaaaaaaatgcacagtttaatacatatcagtttataggaaggaaagctattcccagaaattctcaaaacagaaattatgcaggattagcagtatagcattattggctcccaaggctcttggttacagaattaccattgaaaattttatcaaaagcagccttgtccctgatagctgccgaatcatttttaaaaaggggggtggatgggaagatgggagagaaagtagaaaaggatatgtgtttattaaaccttaacatgggatccatttaaacttttgatgttatttatatctgaatatacagaattaacactataaagagcctgctaagactagacttccaggctgagcacggtgactcatgcctgtagtcccagcattttgggaggctgaggcaggtggatagcctgagctcaggagtttgagaccagcctgggcaacatagcgaaaccccatctctatcaaaaatacaaaaaattagctgggtgtggtggcacatgcctgtggtccccactacttgggaggctggggtgggaggatcacttgaacctgggcggtggaggtttcagtaagccgagattgcaccactgtactccaacctggatgacggagtgagacctcatctccccaccccccaaaaaagaaaagatttccaaatattaggtacatatactaatattatgagattctcaacataagaagactgtttttctgaaacaataatgtatttttgaaaagtcacttagaggaccagaaacattttttaaaagccctaccaagatttaatacatggtataaagttattgatttttgggcattcaaaaaagtattgagattaattattaaagtagacagtatagtactgtagaaagaatagggaggatccaagttcagtagttttgtttgttttttgagtcagggtcttgctatggtgtgaaggctggccttgaacttctgggctcatgcagtcttcccaagttgctggaactacaggcgtgcgccactatgccatgctcagtattttttagctgtatttctgacttttatcaaatcattcaatctgcttttctatcaataatagtatataacactaaatacttaaggtttattaatggtgtggtagggattctcatcccaattgcttattagagatttttatcccagtttgatagatgaggaaaccagagaggttaagcagtttgcgctgacaccacagctagtaagtggcattgctggaattcaggtctgggtctatatgactctagagcttgtgagtctatcctgcccctaatacatgtatttgtgtagcttaccttcaaagggacgatgtgaagataaatgagataacggatgggaatgtactttaaatttcacatagtttgtatttttcaaagtatttaaaatgatgtggtatactaatgagaaattttaattttcaaagcttcacttaaaggacaagaagcgatttgaaaaagctaaccaggattcaggtcccggtttgagtcttgaagaatttattgcttttgagcatcctgaagaagttgattatatgacggtaagaaagaaacatttttaagagaattattgagtgaccaaaactttaaaaaaatatatttaaaatttttgtgggtacctagtaggtatatatgtttatgggatacatgagactttttttttttttttttttttttttgagacggagtatcgctctgtcgcccaggctggagtgcagtggggcgatctcggcttactgcaagctccgcctcccgtgttcacgccattctcctgcctcagcctctctgagtagctggaactacaggcgcccgccactacacctggctaattttttgtattttcagtagagacggggtttcaccgtggtctcaatctcctgacctcgtgatccgcccgcctcggcttgccaaagtgctgggattataagcgtgagccaccgcgcccggccgagatgttttgatacaggcatgcaatgtgaaataatcagatcatagacaatgaggtatccatcccctcgaacttttatcctttgtgttactaacaatcccgtgaacactcttttagttattttaaaatgtataattagttactactgactatagtcaaccctgttatgctgtcaaataatagatcttattcattcttactgttttttttgtactcattaactgttctcagcgccccctcccccaacacttcccagtctctggtaaccatcttctaccgtctatgtccatgagttcaattgttttgatttttagatcccacaaatgagtgagaacatgggatgtttgtctttctgtgcctggcttatttcacttaatatgatctccagttcatccatgctgttgtgtggatcaacatgttgttgcaggatctctttcttttttatgactgaatagtactccattgtgtatatgtacattttctttatccattcatctgttgatgtacgcttgggttgcttccaaatcttggcttttgtgaacagtgctacaacaaacatgggagtgcagatatttctttgacatagtggtttcctttcttttgggtatatacccagcagtgggattgctggatcatatggtagctctatttttagttttttgaggaacctccaaactgttctccatagtggttgtatgaatttacatttccaagtaaccaaaactttaaaacctgttcattaagttgttaaaatgaattgtataaccagaattttaagagatacacagatttaaaatgatgctcattctccccacttaaaattaggcttggtaaggaggctttcttgtggtgacgaagttgcttattgggagggagaaggtgaaagactgaatttttaaatctctgtactatgtatgaacagcaggcttcctcaggctattttctctcataactgtgttaccttcagtgccttccttatccttttgtagctttcagattttttttggtttttcaatgttagtaatattaggatttctgtttaatttacaacatcacttatgaaagcttttggtctggaaaaacatcatgtttggattcttcatagggttggtaggggtgcagctgctagttaactagtaatgtttttgcaattttaagtataatgagtcctctcatccctttaatatttaaaataagtaccagtttttcaaaacttttgttgaattgtaagtttaactcaacaaacataaattgagtccctattatgacttggccaagcttgaaagcataaaccatcacactgggaaataaagactaatgtaacaaatagctttttaaaaaagagactaaacatttatattgaagtctgttgcatgacatcagcctccagctacgtggcttggttccctggatatttcaaagaaggaagatatatctttttgtttaatgtgtcatggtagaccctgctgccttgcataacaaggctgcagatacatttttctccatagctcagtggtaagacactgtcattaataccacttctcttgccattgtgaagcttctaatttctcattggcacagaatacatgacccagtttaagaacagtgctgggtgtaatttaagtaccaaaattaagttgggaaaagctaattgagcccaagaatgacaggcaaaggatgctagatcttgattctctggagaataaggaacaattgaagactaaagaggggaattaccagtaaaagcaatgaaataatttaggcataatgtgatacggcccagagttctatctggcaattgaatgaaatagatttgagcaacattttgaagaaagcatatgcaggaatgttgacttactaaataagtgttaagggaaggcaagagtcagagatgggccaggcatggtggctcacacctgtaatcccagcactttgggaggccaaggcaggaggacagcttgaggctaggagttcaagaccagcctggacaacatagcagaccttgtctctacaaaaaagttagccaggtgtggtggcatgcacctgtggtcctagctacttgggagactgaggtgagaggatcacttgagtccagtagttggagcctatgatgccactattattgtgccactgctctctagcctgggtgacagaatgagatcctatgttaaaaaaaaaaagaagggggagggctaggcggagtggcttacgcctgtaatcccagcactttgggaggctgaggctggcagatcatccgaggttaggagtttgagatcagccttgccaacatggcaaaacactgtctctactaaaaatataaaagttagctgggtgtggtggcatacgcctgtagtcccagctgctttggaggctgaggcaggagatttgcttgaacccgggaagcagaggttgtagtgtgctgagatcataccattgtactctagcctgggctacagagcaagaccccatctgaaaaaaaaaaggagataggaagatattgaggaaagtactgaaacagctggccattgaacaggtcatctttagggaaaaggattggttgtttgataagaagctttgataagagggaggaacagatttgggggcagtttgggatggatagggctaggtttgctgaaggggaagcaaggagattgaggtataatggcgggctggtacattttagatctggaggcagaacagcagttctaaggtaagggctcttttagggttgttcatggattggagggcaaatgaagttaaagacaaaggtagtataagatgcttttcttgagagggagagatgtgcggaaaatagcatgagagtaacgctgaggttgtttatgagagtgaaagtggagttcttcacaatatcagaagcttaaggatgttgaatttaaagctacatagtacttcaggttttattcttgcttctaaattccagtgtttagaaggattgtcttgaagatatggacaaccaaagtgatttttcctgtataagtaccttactagctgattgcaccactagagctccaaaaattatcatttatttctaaagaagttctgtagtagaattgaatcggatggcagtgggactgaacattttgtaacttttttttttcttttttaatgaacgtggaataggaatttgtcattcaagaagctttagaagaacatgacaaaaatggtgatggatttgttagtttggaagaatttcttggtgattacaggtgggatccaagtaagtcacctgggagaatgtgaaaagagaaaaggaattgaagaaagacattgaaagacagccttgctcattgaaagctctcttcaacaggaaatgtaatgaggatctgtgtctgatcctacttgtttcgttaactgtaatacaagttcaacaaatggatttatagcttatctgagaacgctgtcttgcttacttttacttccgtgtctagagtcaaacatttttctttcttttcaaacaaatctaattttattatcagtttaaatggggaaggaagtaaggtagatatttttaaacaaaatcctgtgctgttgcaggtggatcttaaaagagatagaaacataaaacactacaaatactggtgtaaacacagtatcagaagcttagtagaaggtgaataagtgtttgaaattaagagtttgcttttatataagcagctgttttttcagaattgttgcttaaagacaccaaacaatgccatttttaaattggtcaccagttttacttattctgattgtcactttaaaattacacatggcattactttgtgaaaacatgtaagaaactttgtatagaaacatgatatacagtaaaacattacccacctcacatctgggaaaactagatatcggaacaaatagcagttaacaaaattactagtttgtgaaaacatccaatgattttaaaactgggttgtttagactcgtgtcacttttgaaaatgactatatatttgttcttatgtcaggacttttcagttaagtagttctgttttattgggctttctttagtaaactttaaattcacttcctttattctagggatataccaaacttcttattggatacatgtgatattcttgtgtatgtatatttgtgtttttttatattaagctgcaaatgaagatccagaatggatacttgttgagaaagacagattcgtgaatgattatgacaaagataacgatggcaggcttgatccccaagagctgttaccttgggtagtacctaataatcagggcattgcacaagaggaggtaagtgttacagaacaactgtttctctccaccccctccccccgaatttggtgctgttgataggaaaagaagttcaaaatcttaagccaaagaaagaagtaatggagttatttgggattgatgcattactatgttttgaatttacgaactgtttagattgtcagggagacgaggaagttaagattgtgtcatgtattaatttgagagtacagtgaatagaataatagtttgtatttacctacagggactcaaaacaggttataataatttttcattgccttgatatatcctggattggatttgagtggagagagacagaacccagcagaaatgaagaaaggagataatgggaaaagcagtagacggacctggttacaacgtgtaacatttttagatacttaaacaataatgagtacttgtacacctggatgattttgacaagtcaaatcacattaaattgtgaacatcttgctgaaaatacttattacacttgacacttttttgttttattttgaaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaacgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgtatatgtttgtttgcttttctttaactttcagataaatattgaatttagcataggttttgtggtattgtacattatcttgcctcatccattcctttatgtggatagttcccaaaactgtcaaattattcttgctgcattttcttattttttttttaaataagagaatcatgttataatataattgaatgtgcacctgacacattttaataattggtgttgtagcaaatgtggttttgctctttggggctataaataatcttgagtaacgcaggttggaattaccaatagagctggtcagttatcaacagtagagctcagtatcaattttactgaaattaaaatcatacttgataagcatgataatcaattttaacctaattcagcaggtcaacttatttaactttggtggaggtgggatagggaaaagtgaagggaggaattaatttttttctagttctgatgtacagagattgtttttcattctttttttttttttttttttgtgacagagtcttgctctgtggcccaggctggagtgcaggggcactatctcggctcactgcaagctctgcctcctgggttcacgccattctcctgcctcagcctcccgagtagctgggactacaggcgcctgccaccacacccggctaatttttttgtatttttagtagagaccgggtttcaccgtgttagccaggatggtttcgatctcctgacctcatgatcagcccacctcggcctcccaaggtgctggaattacaggcgtgagccaacgcgcacggcctctagtttttcattctttaaatcacttttatttgtgggtgaagaggtcagctatgcattctcttaatcactttccagcctaaagttgtctcatatacagcacactgggggctcaacaagtacctatgactatttgagaagacatgaaactcttctctgatagaatcgactgcacctatatacctctctactgccgcatctttgctgatgtgaggtgtgcttgcaaattgtaagcttccacaccttaatgactgcttgcttgggtatctacatggttttcattttaacctacaatatatgtctggctatagcagttttagaattacagatttaccactatcactcatctgtcatttgtcagactcactgaagctggcatatttgaaatcaccagtttgactagttaactatttgtttttctctctagcttctccaaaatctatgccagaatagatcatcagatatggattatatttcaatcctttgcagaaatgcaatgtctgtactactttccttcctagcataaagaaaactacacttcccagccctcttgtaggtaggcgatggctagttctgaccagttaaacatgggtggaagtagtgtgtgtcactatcagactatctcatgacaaacccttttcctctgccacagcactgtgcaggaggcctcagctgaaatggtgcagccacaagatgaaagtggctttgatcttgagtctgtgtaggtcagctggatccacagtgggctttgtatgatcaaaaaataagcttttaattatgttaagccactgagatttggttgtgcttttttgtttttaaccacagcagagcccatcctgctgtgactgagtgaagatttcacatttaacaataggcttttaataagcatgcagagaaaaagaatcatctgcttgaacagagatgctatatctactgctgagtcaaaatagaaaattttaagcctttttttagatttgaattttaaataagacttttaaaataaagcttttattttggttttaatataattaggataatttgaatttatccttgagcatgagagtaaaaatagtttgagactttctgaatcattggctgattctgcctgaaggacttaatgacttccattatttgagttcaggtacaacttcaaaggggaaaattgaatgggatgtgcacatgttggctcatatgtagttctgattgggccaatttgcagga

SEQ ID NO: 16638 - DNA, 24546 bp, Human
  misc_feature (1)...(24546): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcggtcgactctagaggctccccttcctccccccgactccctccctcccccttcccccgcctttcttccctccgcgacccgggccgtgcgtccgtccccctgcctctgcctggcggtccctcctcccctctccttgcacccatacctctttgtaccgcaccccctgggtatccctgcgcccctcccctcccccctgaccgcatggaccgtcccgcaggccgctgatgccgcccgccggacggtggcccggaccgcagtgccccaagagaggtgagtgcctggccgtcccggagtgtcccctggagggaagagggtggaggtcgcgcgtctagtctctgttgctgccactgtcgcgtccactcccattcccctcttctcccacttctcccttctctcctttactcccttgcacgggttcgaattctcccaggagccactgtcagaacccaaattggaagggagtgcatgagggaggtactgccctgcagctccacggactcgtcttctcgggtcatcccgagtccccccctctgtggagctcagagtaggaggtggctggagtctggaggaagaggatccgtatgggccaggtccctagagagagtgctggactcccctgcccttccctgtacagggcctccccgcaggtgccctggcttgcttggttctgacccctccctcattaccccaccatgaccctgcgggctgcaagcaagcccagggcccagccacctcgggtgagcagttagaagcccaggtcctaggactgagcctgtcacccttggcctctcagaagaccaggcctaagccaagggatctttgggtgggaaactgggcaggccttctgcccggggggaggtaacggagcattagcaccatgcccccaccttctggcaccctgggcagcccattctcctaggctctttgtggcccagaccaggtgtcaggaaggggtgtgtccagccagcagattttttggagcttaactaccagttcacttccccgcccattttgtacacccgggaaccgaggctcaaagggagaagttgctaccccaggcctctagtggagttaggctggctgtcctttcatccccagctatacagggctggatggctgtgggtggaaggaaaccaggcaggcaccttcacccactggggacacaggcccccagcccggccccagagggaccttgttggttgagcacgtgcttccctgcagagggctggagggagtgaaagggcttccggctccagctgtggctgggtcagctagcaggagatgtggggaatgtgtggtgtatggccatctgtgtggtgtggcaggaaggtccggtcctggccccggctctgagttgaaacaacctggtggtcagtcctgacccagcactcgccacacctatggcccagctggcacaggagcagccaagttcaggatataaatggggtcacatgggaaccgtggaagctctgtctccactggcagcaggctacagactggggacatgggagcattgtgagagtggggacacccagggggcctgtttcaagctcctagtaccctggcggttccagtgtctttcttggttgtggccacagcaggaacagggcaaggacagcaggggtgaggttgaggcctggcaggatcctctggcccaggagagcaggcattgccctggtgggtgctgagcagtgtctgggctcccttggagctgctggcagttttgtcctgctgggtccctgctcacgatttagggtttttttgttttttcacttttttttctggctgtcctgacatgcacagtggaggggacccagatgtcctgggcctgtgagactcccctcacatggccccacacccagccctaacttcctttccagcctgagggactggggctggagcctgacatggttagctccctcccaccccagtcagcctttttaatttttattttattttattttatttttttaccaactgtgagctgtgaaggtgtgatccagggtcccagggcctttgaagaaaggagtctggcttctggctggcacgtgtgcagggatgtgcttttcattggtgagcttggtgccctccaccctctcagaagcagctgctcttctctctgcattgggtcaggggcaaggaaaaagcagaaaatgttcccattcaccaccgcaggggggccagaccccaaaaggctgagccacacagagtggccctcggcaagggttggaaatttcggggacagaatgcagcttcctccaaacaagtataggtaggggttgagacccaggatccacagtgtgacatggctgccccccaaagggggcagacccacctgggtgcggttctgggctccatcttttgaaggattttaaaaccttgacaggtcatcttcaaagagccagggatgttgactgagtctgggaaagagaaagtagggacagattctcatatgtctgagggactgtcccaaatgagaaaggcatcccatggcagaaattgtcccagacacgtgggccagagctagggagcaggtgggtcccagggaagtgaatctgagctcattatagggaaaacatgaatgtactcattttcttgatttagaaaataacaaaacagcgctacaggaaatttagaaaatgaaacaaaaatcacccactatttcttcagcaggcagtgactgtgttagcattttggagttcactgccagtcttttccccatccttttccttcattgtcgttgtcactggagtgtgtgtgccgtgacaccttttttcatttaatactgcgtctgtgggcattttctcatggtgctacgcggtctaagtaacgttgcttctaaaaagctacagaacattctaggctggcctgctgcagcgccatcacccatacactggagcgtgtgcatttttcccctctgttgctgttgtggttgtcgttactatgagtcccaaaagcagccagggtgttggagggcacaagcaacttggcacccaactgaatgtgggttccaggcccagacatgccacttaggcccagggtagagggaccttagacaggtcactgacctgctgagcctcgttgatataaataacaggatggtaacacctacttcagaggaaggtgtaaggacagtgtcaactaactaaccaagggactctaaagtgcctggcacagccctttcttcactccctctgtgagtaggattggcattgttgaaggagtgcccactgctggctgcctcaacctgtggggaaggtgcctgagccacgggccaatgttgactgaccactcacctggcaaagaggtggtctccgcctgaggagcccctgtgaaaccccctggccctgaggttctagaatactatggccagtgcccttgcctgccttcccttctccccattaccatatgattggctggcctaggacatggggctggccctgggaagatgggctgctggttagggtccgggacctgactccacccattccccttccggtctcccagcatcagagctaaatagacaaggcctcttctctctctctctctcttttttttttttttttttttttttttttttgtgtgtgtgtgtgtgtgtgtgtgtgtgtgtgtgtgagatggagttttgctcttgttgcccagtctggagtgcaatggcgcgatcttggctcaccacaacctccggctcccggtttaagcgattctcctgcctcagccttccaagttgggattagaggcatgtgccatcacgcctggctaattttgtatttttagtagcgatggggtttctccgtgttggtcaggctggtctcaaactcctgacctcaggtgatccacccacctcggcctcctgaagtgctgggattataggcgtgagccactgcgcctcttctgtaagagcctggctgcctcctgcctcccagctctggctaggtcagcccagcttggcattttcccagaggaaatagaggcctgcttagcctgagacttagacaaggaacccaggcatcctgagccccagcccaagaacagccatgccagcctcatcttcgcaccctgttccagtagccaaggaagggaaagaagctgggagattaagggtagggggattctggagcctcccagagcttcccaggagggagttggacacatcgggaaactcatgttagcctccccctcctcagcaggtgttccccaggtctaacctgagtgtgtatcactgtgacacacctgcttcctcttgttctacttttgtggagaccagggtaactgggagtgccctcctacagccaccccgtgggcagtagcaggacaccagtctcctcctggcaaccctgggcctaagagactgtagccccagatgaccctagggtggcccaggactaacctaaggaaggggtcctcccccaggtggcccattcagtgcagaggtcccttgggcacacgacttcagactccagctgccaaactttggcctgtggagtatctcctcctccctggtcttagtgtaagggaagtgggcatgacaactgccctcctgtcccacagcttgggatgggatgaggtcacagggtggggtccgccccaagatgctggcctggcctggctcagatgagagccctttgggtgtttctcagtttcccccgcccttggttggggacaggatgggtggaggagcaggccacccccaacgcccggcagggagcactgcctcccttccccctctcctctgggtcccttcatccaagggctggaaatagaatccgctaagtaatgattaaagtcaaattcagacctaaaaataaagagctggtgaaggaagagctggtgctccctgcatggctgaggggagaagtgagcagggagaggctggctttgggtggctgagcccctgctcctcgggatcagaagtactccaccagttgggggggtgctcttttatctgccatgatgtggcccattaagtgtagacggcaccactcagggcagactggcaggacccattagaaaaaaaatcccatttttcccatggggaaactgaggcccagaaaggagaagtggtttgtcaagcgactatttgagagctcccctcagcaggcccccagggactggagggccctgtgcagcccagcctgccctttctgcctgctcagtttctcttcctggttttgaggtgctaagatgaagtcagcttctcatcacacactagctgtgcacacaccctccaaccgcagcttccctccacccctccttctgtggtctgggcccagagtcgaaggaacaagtagaagagaggctgcttggtgcccccctggctgtcctgatcatggcatggttgtaagcctcgtgggcaggcgaaaacctgggcatcatctgccccacttggaccctggctgctgcttctcagcccagcctgacacctggtcctcatgcagactcgcgcatctatctatctgcagcttgtgctgtccgtgctgcagggagacaggagggaaggatgaagagcaaaccctgagagcgcctctgctggcgggtagaggagacgaggagtcagtgaggggaggcctgtggttctcacttcctggcagagctggtaggagctctgaagctggggctctgcgtgggctggggcagcctggagggcctcctggaggggaaggtcctgtgaaagttgagaagtgtttgaagaagaagcgtggtaggaggagaggtccttgtttgaagcttctgccctctctagggctgctggctcttttctgtgtgtccctcgacaggctcttggcctctctgagaggctggggtatgcagacaagcaagaagtgggcacagaagtacctctgcttcccagagcagaacagccaagctctgggcagacctcccctcggtgccccccacctgtccattttcagggtgtcatctgtcctgcacaaggaaaggtgggaagaaaggtcccctaaccaaggttcagacaactctgagctcaagtacccacacagctagttcctcctctgtcagagatcaccagtccttgccctatggggtgtttgaaggattaagtaactaatgcagtgccccaaacccggttgggtcagtcagctgtaactcccgtgttctcattctgcagcccatcctgctggaggagtgtactggtaacacccccatctcccttaagtagtagcaagtctgtcctttgtgttgatccccacagctttaccttctgagctgtgtgttctgcagatcctggttctgaagtggggagaccagaaatctgggggccgaagttttagacagcttatgggcctccagccatcagtctccccacctagaatgtggccaggagacttccgggtgagggacaagaacatgactttgaagggtccattgaaggctagtgctgagaggctatatgcaaatgcaggcaaatgaagatgcaaagaccacatcctgtgctaagggggtgggggagcagaggcctgggttagggccctggggaggcccagagtccccattgcccagcgcacataggtaattaggctcctgagcggtaattagaaacctttctgggccaggaatggcagcctcaagccgcagcggtgcctggggagtaggctccccattagcctgctctaaccccagcccccacctctcccaaaccactagacgggatttccggtcccactgaaccattgggggcaggggaaaaaaagccagtgtgttgctataatttggtatttatccattaaatccgcccttctccttaggtcagggtgctgacgggagccccgggatgggggtagggcagcgtgccctggagccagagcaggcattcttctgttccttcgtaaccgccccgggaggtgtaggcatctccaagaccctggcgcccaattctgctgctgctcaccctgagacacctgtgcagtgggggtgctgagggaccaccagcgcaggctgcgggggtcagtggaagccctccggcacccttccttgcctgatgtgtggtggggaatgtcacagtgcctcagcctggtgtcctctgcagaaccagaggtggagctgattttattgctgccaaacttgcccaactgctggtgggtgccccgccctcctcaggtgcactgccctttggaggggcgggcccaaatctgaaacttaattctgcctgtatctgtactatgacctgtaggccctgctcggaggttccctgggcccccatcctgaaccttcttcagtcttcattaactcgctctgtaccacagtttgcagtcttaatcctggtttacttcaaggcgcccctctctcagtcactttcccctaaaatccttctagctcctgctcccctcacccatcttcctggaagccttcccgggtggcccctgtctcacaatctattgaggcactgaacataccaggccatggctgaccatccagtaaccaggaggacaggagccgggtctgcattttgtggtggttcccagcatccagccctggcttgtgcacagaggagaggtgtgtgagtggtgaccttgggtccccaaaggcaggacctcttgagtcctttccttctccacccggatatcctggcctaccaagcatggctctgggcacacaggaaggcttctaaaacactggctcaaagaatgagaaggcaaggtggaccttgctgttgcctgttttgcctccagtggctgtccccatcccccagagcatccagctaggtcctgtggcagcaccagaatctccgggggccagggccctgagttcccccaggtcttttgtgcagttcccttttcagtgggtatttttagctgggcgtaaacagttactgaaggctcccacgccccattaggcagcagagttttggcaagggggaagggcaagggagccccttgacctcccctggccctcagcacgtgcctggccttgggggtctacagctgcttccagggtaggaaaagggcagcctgggagtttctgggctcccagttctttctccccactccttgtcagcctgggctcacaagaaaggctgcctgaggctgcagccactgacctcagcgcttgggcacaatgccagcctgttcccgggaccccagcacaagggctgctgggagccgggtttagggcaggaagtcagagtgaagcactggtcctgccacatcccaagccccttgtcccctagccctgcgggaatggggtgacagctgctgtccctttggggttaactatagtcctattggttatgagacctcggtgtggtacagccagcctggcgtcccctttttttcattcgttcattcattcattcattcagcactcatttactgagcagccgctttgggcccagcccatgcagacgtgagtcagaccctcactttccccctgcagagctcccagtccaccctaaaccacaggccacaaccagtgaggttctcactggagcacggggatgtgtgagaggccttggaggcctcggcagccaacacagctggggacccaaggaattctccagagagaggtgatttacaaaaagtttcttatttccagttttaagggggaaggtaatagatgcatgtggctttaaaaaaataataataatttttttaaaagcccaaaaggacaaaatagcaaatgaacagtaaaaagtaagtttctcttgaacttgatctcactttcccttctcatcctagaggcaacctctgttaccagtttcctctgtctttcaaaagataatcgaggcatatttgagtttagggaggtgttgcattaatacctctttaaaaacacaacttgtagtattccatagagaacctgcacctggctttttttttcacagccttttattttgagtatttgaaacctaccaaaaagttgaagtaatagtataatgaatattcatatatccttcatgcagatttgccagttcttaacattttgccacatttactctatctcttcttttatctacatagacatatgtgtgtatgtattttttgctgatttgagtgttagttgtaggcattgcatctttcaccctaagaactttagcgtgtatctcttatataatcacaatgtcatgatcacacttaagaaaattgacattaattccatattatctactatgtccatttcccctctccccgagtgatttttatagctgtccccccgaccaccccttgatatagaattcaattcaagatcatttattgaatcttgtcatgtttctctagtgtcctgttcaatctagaacattctccagccctttttttgttttgctcttttatgacattgacatgaagagtccgggccagttgttctggatttgtctgattgcttctccctggttggagtcaggtggaacagctctggcaggaacgcccccccgggcaatgcagagtcctcctccaggaggcacttagtgtccatgcgtcaccttgctggtgatgcttcactggatcacttggttccggggttgtccgcacgtctccctgtagtgcaggtgctccttcctctttccaattagcctgtgggatgggacttggaagctgtgtctgttctgctcccctggcaactttttcttcaatgacttgagctggtgttttgccattttccatactctatcatggggagtgttcagtatcggcatctagagatctcccctggccccatcacagctagagctatgctgtcccctttcagggacatcttgtaatttatccacccagcccccaactgatggacataaaggctgtctccccatcatctcctgctactacagacagcactgcagggactgtcctgctgtgtttttttaaggcatgggtactccagaagcagttgctcagctgcacccccaaggttgagtggaagtccctcggtaaaggaggaggagagagtgtgaagggaatggcaaggcggggagggagacagggcacaggtgtcctggcaacagcagatgggaaacaggtctggctaaggtaccagaagccaacaagtcccagaaaggtcaagtgactttcccaaggtcacacagcaagttgatggcagagctgggtacaggactcagagcatctgacacccaggacgatgttcctgcactgttccatagagtagcccgactcttaagtttaaataaccccaggaaggaccccctctctgtgcctgacccccgctgggttgtagaggcctaagtttgcagtagctcctcccagccactctggctgtcagcctctgacctgcagtgggagggtctcaccttctggagatgttttaaggaggggaccccggcctaggcactagctgggaagccactgagccatcttgtctgcggccactgacgtcagtgcttgggcacaatgccagcctgttcccgggaccccagcacaagggctactgggagccgggtttggggcaggaagtcagcgtgaagcactggtcctgccacatcccaagccccttgtcccctagctctgtgggggtggggtgacagctgctatcgctttggggttaactatagtccctttggggttaactatagtcccattggttatgggacctcagtgtgatgtagccaggctggattcccccttttgtttgttcatttattcattcattcaggggtctcatgaccccaccagggaggagccgtccaagagagttagcagctcccacttgcaagatgtctgtggcaaggcaggcactgttctggtgctgagagctcaactccagtcctcacagcagcccccagagccaaggagtatcaccagtccattgcacagatggggaagctgggttctagagtcacagccagcagagtaaaggtgatgagtttagccctcttccctgtttccagaccctctgaggccttcagagcccagctccttgaggcagcccaccccgaccgctcctaggcttacccttccctgagcaccgcccctgtgcccctcatagctgcttctgcctcctccctcctccctcctctcccttgcccctaggctagtgtggtccccatggcaactcctggggcctgtccggcagggaggcacggggctatggggagggctggctcagcagctcaggagtttgacacctgagggggacagaatgctcactcaaggtgtggccctagggacccccgccttgcccctgtgggcctcacttggggttctcatctgcaaaatggggataataatagcttctctgtctcagagttgttagaggatgtgatgagccataacgtgccaaggacagggcctggcacagaataagtgctcagaaaacagggcctgttattatttttattattataatcaaggcagtggggaggcggcggtggcagtagctgtaggccaggaagggagtgtttgcaaactgacagctggaagggtgactaacagcgcagcagcctccgcgcccccctgtggtggcagggagtttggggaggaagggggaggcatggggatgtggaatgctagcagggcccctattcagaaggacctaaaggttgggggcccagccagccctagtgggaccctaattcaagctctgtcacccctaactagctatgtgacttcaggcaaattgttcaaccagttgagcctcagtttccgcttctgtgaaatgggggtaagagggttagaagagctcacaatcctccttccctccccgccacccccacccccacagcttacagtccacaggaggcaggggcaaggggtcctcaccacccccaccctcacagcttacagtccacaggaggcaggggcaaggggtcccgccacccccaccctcacagcttacagtccacaggaggcaggggcaaggggtcccgccacccccacccccacagcttacagtccacaggaggcaggggtaaggggtcccgccacccccacccccacagcttacagtccacaggaggcaggggcaaggggtcccgccacccccaccctcacagcttacagtccacaggaggcaggggcaagggatggttcctgtacttagtggtgactgagtcatgtggatggaggcaggtttcaggctcatcctccttgggcctcagtgtccctgcctaaacagcaggattgatggcctggcctctggggatagaaagggccctgtattctgggaggaacggaagctctttcatccaggggatggggcaggggcgcaccagacatttccaagttcagggtttcattccagcccctcctcagccagcttgcaggagatacctgtcctccccttcagggtaagcaagacttagaagggttgagtcactcaccccaagtcgcacagtcaacagagccaggtattaagcccaggcctgactatagagccaggtgtgcggcctggaagtgttggttctccctggccgtctcctccccagctccttctgctctccatgatcacatgcccccctgctgaggccccatcgcccttggagtcaaaccctggttcctcacattggcagtggaagtccccctgctgcctggcagagtttatgccaggcccacttgaaaccatcccctacagtgtcccctgagcagcggtgctcaaggtggactctggaagtgtgtggggtcctagagccccagatgggcagggtctgccttcccgcttccctcaccatcggcttccacctgggccagtttctcatactatgccagtcccctgcctgacacctttgctcagactgctgcatcaacctggggtgccttccctggcccgccctctgcctgtgtaagccctgcaatcttcagggctcagccccagagctccctcctccagggagcctgtctgagctctgcagtccgtgcctacttcacacccccagcactttgcactaaaatgtcttctcccgcgccactgcactccagcctgggcaacagagcaagactccgtcgcaataataacaataataataaaataaaatgtctccttccactggggtaggtagcaatatttgtgactgtcagcctagcccccagacctcatccactgtatcaaagagcccagcaaagaggctcatggaggagtttctcttctaacacactgtgaccacgaagatgccactggccctttctcaccctcagtttcctcacccgtagaaaggaaacagtagttccagcccctctgcttcctgagacaggtccaagggggctctgggctgggattacaaagtatgtgtgtgcagacgggtgggttgctgctctcagggaatggggttggctagggtagcttttttggggagtcaactttattgaagtaaatatacggttgacccttgaacaacacaggggttgagggcatcaacctcctccctgcagtcaaaaaatcatatattaacttttgactcctcaaaaacttaactactaatagcctattgttgtcagaaagccttgtagataaagttgattgacactcattttgtttgttatatatattatatactgtattcttacaataaagtaagctagtgaaaataaaataagaaaatcatatggccgggtgcagtggctcacacctgtaatctcagcacattgggaggctggggcaggcggatcacttgaggccaggagttcaagaccagcatggccaatatggtgaaaccctgtatctactaaaaatacaaaaattggtctgctgtgttggcgcacgcctatgatcccagctactcaggtggtcaaggcatgagaatcacttgaacctgggaggcggaggtagttgcagtaagccgtgagtcaccccaccactgcgttccagcctgggcgacagagtcttgctgtctcaaaaaaaaaaagaaagaaaatcataaggaagaggaaatatatctactattctttaagtcgaaggggatcattatgaaggtcttcatccttcacattgagtaggctgaggaggaagaggaagagttggtcttgccgtcacagaggtggcagaggtggaggcggaggaggtggaaaggaaggcagaaaaggcaggcacactcagtgtaacttactgaaaaacatccagccacgtgtggtggcgcatgcctgtggtaatcgctacttaggaggctgaggcaggaggattggctgaacccaggggtttgaggctgctgtgagctatgatcacgtcactgcactcctgcctgggcaacagagtgagaccctttctcaaaaaaaaaaaaaaaagaaaagaaaaataaaaaatccatgtgtaactggacctgcgcagttcagacccgagttgttcaagtgtgcactatacaccaaaaagtgtgccgatcgcaatggtacagctcagtgaattgtcacagagtggacccacttcatgattgggctcagacagtctgaaaaccaaccccagaggtccccttgcattccttccagtctccctgtcccaagagcagctatcctgacagcatggattagtttggccagattttgaactttattcaaatggaattacataatatgtactttcctgtgtctggcttcttggttaacattttatttatttatttatttattcattcatttagaggcagggtctcactctgtcgcccaggctggagtgcagtggtgtgaccttggctcactgtagccttgacctccccaggctcaagcgatcctcccacctcagcctcctgagtagctgggagtacaagcacgcagtaccacccccggctaatttttgtatctttagtagagaccgggtttcgccatgttgccgagactggtcttgaactcctcctgggtttaagccatctgtctgcctcagcttcccaaagtgctgagattacaggtgtgagccactgtgcctagccatcattatgttttgaaatttatcgggattggccaggcacggtgactggcacctgtaatcccagcattttgggaggccgaggtgggtggatcacctgaggtcaggagttcgagaccagcctggccaacatggtgaaaccccatctctactgaaaatacaaaaattagctggttgtggtggtgcatgcctgtaatcccagctactcaggaggtggaggttgcaatgagccgagattgtgctactgcactccagcctgggtgacagagccagactccatctcaaaaaaagaaaagaaaagaaattcatcagtgttatttaatggttggagtttgtgttggagtttatttaatggttggtgtttactgctgtacgtagtcccttttgtgaatatgccactgtttatccattttcctctggatcggcatctgggcagctcccagtttgaggtttattacaaagcatgccacttgtagccctcctgtgcctgtctaggcagacacatgtcctgtgtcctctcggtgtgtacctagaagtggggttggtatatgtttagagatgctacctgggcgggattttgcaggtgaaggacccaaggacccacagagcataagggactttctcagatcacatagccccttctcagagctgctccggggcccctttccccacagaacagtagctggaaccaggcctggggctgacggtcaggtgtccattgtcccactagccccctttgctcctttctatcagtcctggaagccccttgtggccttagggttggtggctccctctgcccctgggggtcctcagccctcatgctcctctacccagtaccgtcagcctgccaggactggagagaatggcccatgtgtcaaatcccagcgcaggacactcttggcacctgttcatgcccagtgaggagccagatctcagcagttggggggcatttcttcacacccctcctcagtcttcatgctcttccccacagctctaatggtaccaagtgacaggttggctttactgtgactcggggacgccagagctcctgagaagatgtcagcaatacaggtaccacaggggtgagggtctgggacatgcaagcattcccaccagccccagcggggtgcttagcagaggagagaggatgcagcttagatcaacccactcccctttttcccagcactcagtcaggtacaggcctggggaagtgggggagtctcaacaggaagggacccagggctcgttctccgggcagagcacctcacccaggctcacagaggccagctcagaggctgtgaccacgagggtgcgccagcaggtggctggagggggcccaggctgcacccgcccacgtgtcacctgccttgcaggccgcctggccatccggtacagaatgtattgccaagtacaacttccacggcactgccgagcaggacctgcccttctgcaaaggagacgtgctcaccattgtggccgtcaccaaggtaatcaggtgacgcccaccccaccatcccactgctgggccttccctctgcagggggaggtgggcctgagagcatgtctgggctgccctctccccaggaccccaactggtacaaagccaaaaacaaggtgggccgtgagggcatcatcccagccaactacgtccagaagcgggagggcgtgaaggcgggtaccaaactcagcctcatgccgtgagtaccacgaggaggggttggggagggaaggggccttggtcctcctgaaggagcatcaggagcaagcagggaggccagagtgaggggcttgggtgttggggagggcctcaggaggaggtgcagggtgcgggtgcgggacctcacagagcagggctgggggcagaggcaggagggtggcaaagaagggacagggagcagaagaagagggcctcaaatgcctgactgagcgagtgcgagccacgggtgccaagcagagggaaccccttcagaaaggggagccagggtcagtacctttgggccaccatgacctccagccctgctgctccccagttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggaggtgagctggggggtacagagccttgctcccaccctcacacaccctaaacccatctggggccctggcttctagctccagccccactgcttctgcgtggtgaccagccatgtggggcaacttctgtgagcccttgtttcctcacaccttggtggagcagctgctgcgtgccaggactcacctctgaccccacagtgccaccatgaggaggggagccttatcctcattttatagaccaggagttgaaggttcagagcagttaggggacccacctgaggtcccacagatataatttggtgccaggactagaatctgagtctgtctgatcccagagctaactttcctccagccactcacagacctgcatgctcagaagcgtgtgcagaaacatgagccatgcgccttgatcgccagggcccctgaggctctcgcacctgcacggacatgcccacaggtccctgcagcttcccaggccagctctgccagccctggccaggccacacctggcatccggtagccacaggaagcctcccgtgtccctctgtattcactctcatctccctcccctactggcctggcttggcctgtggcaggtgagggtggggtcctgggcactcctggctagaggctggtttcaggactgagccatgggttgccctctgcatcagatacccatggggcccagagtggtagcagcagctgagtgtccagcaaccgcatgtagggtggcatgggaaatgggccatacgtcataatctgggacttccctaacccctgccctaccagaaatggggagccctccccactcagtgactccaggctaggcggggctggcctctgccgccctctggtggtcaggcctggacggtgcatatggggcaccttgggctgtctctgagcaccctgccccccacaccctgcagcactacacctcagacgcagatggactctgtacgcgcctcattaaaccaaaggtcatggagggcacagtggcggcccaggatgagttctaccgcagtgagtgcaccccaccccagacctcttgcccacccacctcctcccacgcaggcttcctggcactgccccatccaggaacctccagagaaccccagtgcctgatagtccagtcagcctctgtcatcccagccatgtccctagtggcctccaggccctcactggcccctccccacaggcggctgggccctgaacatgaaggagctgaagctgctgcagaccatcgggaagggggagttcggaggtgagctgggccgggccccctgggggggttctgagggactccgaacttgggaacaagaccacctctctgcccccagacgtgatgctgggcgattaccgagggaacaaagtcgccgtcaagtgcattaagaacgacgccactgcccaggccttcctggctgaagcctcagtcatgacgtgagtgggggcggggtaggggggaggttggcctaggttaggagtgaggcaccagcttcccctttctgaccactctcgtcctgccccaggcaactgcggcatagcaacctggtgcagctcctgggcgtgatcgtggaggagaagggcgggctctacatcgtcactgagtacatggccaaggtgggcacctgccgagacccggcactcaggccttccaactgccccgaaacccccactgtgctctagggcccctgctccctcagtcccccgaccccaagtgagcttttaggtcaccagggctgggcttttgtcctggtttaccattcattgactgtaacattggacaaatcatgtcacctccaagcctcagcatcacatctgggaaatggagataataacaacttagagatttgtgagagtcaagggataaggcatgaataacacagagcagtgtccggcatggatgttctggcccctccccactccttccctgtctcacacctccctggagtgtcaacacccacccggccccagcgtgctgtgtgagagggctgcagggcacgtctgacctcggcctggtctgtccttcctgcccccaggggagccttgtggactacctgcggtctaggggtcggtcagtgctgggcggagactgtctcctcaagttctcgctgtgagtgaagcagcctcttggatgggtagggtttgaggggtaccctgccctgctatgggagccccagtctgaggggacatgtggctggcctacccccagagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaaggtggggctggcctcccctggggcctacagaggtgggcaggagtcctgggtcactccccaccctggagtcccaggatctgacgctgcttcttccatccacatggcagaaattctccactaagtctgacgtgtggagtttcggaatccttctctgggaaatctactcctttgggcgagtgccttatccaagaattgtgagtatgggtactgggatcagggtggctcttggagcaccggaggggttggcaggggcgtgagcctccttgggccctgcctccccaatcaaggcctagaagcctcaggcctgccctggggagctcacaggccactctccgggcctgggtctgcggcaaagctgatgggcatccctgagaggctgctgggtaggtgtcctctctgaggccagggcctggactgactcctgcctccccctggccacagcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaatcgtaataaaccacgccatgaggacaccgccgcccgcctcggcgcttcctccaccgagcctgcttgtcctgcccggtcgtccctcccatgccatcttgtccatccccctgtgtctgtgagtggggctgggtggggagcatggctgggagatgtagccgccgctttgtgtcagctgcacgagtgagtgtccttgtgtctgccctccgggaagtgctcaccagttgccctgctgccgccaggcccagctccggggccccatctacaggatgctgcctgggggttccagctgcctcccctgctgttttcaagcctgccgcacaaggagggctacagctagggatgggagggagcccaggcctgcacagatgggaacggggttctagtcaagccccctgtgcaagagagagaaaaagcaatggtgggcccagtgggcttcctctggcaggaggagaagtgtctcatgcctgagaagatgctgacccggagagggacgggaaagctcctggtggttctccagtttcacccacgatgtcacagctttgccctgtccccacccctgccatgtgccaggccttaggtcataccagacttggcaggggttgaggatgcagggcagaggggagatcctggcaccttccagtcagggggagtccctccccaccccaccttgtcggggaacatatagagaatgtggaccagccatgagattttctcccctcactcaggttgtccaggggcagtggtcagtacagaacctctgaaggtgtgaggaggcttcatgtattccctgaggcaggcaggtggggtgttcccctgtcctgttgtggccccgacccttcctctaccagccaacaggacctgaaatccaggaagatctgacttcgaagtctaccttgtgtctgttcctcagccccactgtagttccatctaccagtgcaacagcctcctcgccgcctccactccatcttctctgcatactgccagacttaatttttctaaaactacaccattcattcaacaacaaatatttgaatacctgctgtttgctaggactgaggttcatcaataagcaaaacacaccctgtggagtccacagttgggaagacaatcaaatagtcacatatagacagtgacaaacttaagtgctacatgaggaacacaaaacatgggaatctttgtagatcagggagggcttctggaaagaagcagcgtttaagctgagatcagaagcagaatgaacaggttgtatggcaggagttagcagcattccaggaagagatgctgagactggagggagggcagctttgtctcagatctccaagaaagtgggtgaggatggacgaacagccaggcctgagaggtgaggctgtggctgtggcaaagacttagcttttatcaaacagagaataatgggaagccaatgacaagtttgatcaggagggtgagatgtcagataatttttgtttgtttgtttgtttttgagaagaagtcttactctgtcacccaggctggagtgcagtggtgccatctcagctcactgcaacctccagctcctgggttcaagcgattgtcttgcctcagcctcccaagtaactgggattacaacaggcatgcgccaccatgcctggctaatttttgtatttttagtggaaacggggtttcgccgtgttgcccagactggtctcaaactcctgacctcaggtgatccaccacctcggcctcccaaagtgctgggattacaggcgtgagccactgcacgcggcccagatatgtgtttttgaaatcaccctagctactggtagaggagtttcagagagtacagtgaggactggtccagatgagagacggtctccagagagatttagctccagagctaaaattgaccgaacttggctatggattcagtgtgagagtggaggagagggaagggccgtagcaaggcctgattgagcagaacggatgcagggagggcagcagggggcatctgctgagcgaggacaggagactcatgcttaggagggagtatc

SEQ ID NO: 16639 - DNA, 14298 bp, Human
aaagtgatgttcagtggtcctcagacttttctggggaaagatctcgtttcgtttatttatatcttcttcctttttcttgatctatcttattaatatttactttttttgaaacagggtcttgctctgtctcccagggtggagtgcagtggtgccatcataggctcactgtagccttgaattcctgggcgcaagtgatcctccctctccctcctcagcctcccaaagtactgggattacaggtgtgagccactgtgcctggcctctaatataattttaaaaggcagcatagtagttcacagtatggattttttttttcgcgggttctttaaagtgaacatacaacctactcttgacttttttgctgttagacatgaggctgcaatggacatccttatccatcaagcattgttgctgatgtcagatcattgccttgggctagattcccagaagtggaattgatcatgataatagcagttcaagggcttggctgaacttggttaggggtatggagctagttagtgcaaagacacatggtagctggaaaaacactgaggggattttctgggaggccacagaacaagtgaaggcctgaaactcatcaaggtaggcccaggctttctggctcagtggttaaagcagcactatgagaggagagagagagagaacatgcacacacatgagcacacttggcttgtatctccatgtttttatgctattttgcctaaaagtgtatcttaattttcttcgataaaaggcagaggctagcaagaagtggaattttctgttgttttttagtagttgtatttttatttcttattttttgcttaaacaacagaattaattttctggcagttctggaaactagaagtcagagatcaaggttttggctgagttgcttgctttcttctgaggcctctctccttggagttagatgccatcttttccccgtgtgttgacatggtccttcctctttgtgtatccgtgtcctcatctcttcatgtaagaacaccagtcatatgtaacagttgtatgtgggtaggcacattggctcaaacctgccatcccagcactttgggaggctgaggtgggaggatctcttgagcccagaagtttgagaccagcctgggcaacatggcaaaacctcatctctacaaaaaacacaaaaattaagcatggtggtgcctgtagtcccaggtacttggccgggctgaggtgagagggtcgcttgagcctgggaggtcagggctgcagtgagccgtgatcacaccactgcactccagcctgggtaacagagaccctgtctcaaaacaacaataacaacaaaaacccagttgtatttaatacagattgtctgcaaagtgatttgcaagcctgtctcccctgcctgtatgttggggcttgatgttttactgaagttttattttaatagagacaaagcgtgttgttgggtggcctctgactcttagggtcagggtggccactctcagaatttcagttgtagagtctgacagggatttggcctggaatatggcctaccttgcaagctatagtgagtcactctagcagtgacatgaaagtgtgccatggttctgagctctgtggacaggtgagaagctggggctgctgtaggtgtggacacaggaagaatgcgcaaggagtggaggacttgctggtccatggaaggctcgggggtggctttgggctggccctggggatgtgctgtgggacagcagcaacagtgatcataaagctgtcacttgtagaatgtttaacaaaggtcacatccatatacttcctattgtcttgtccttcagcagcgctgcgagacaggtactgtatttgtctccattttacagaagaggaaactgagactcagaggggttaagggcctcgactcaggtcccacagtcagcaagttgtggaactgtgaggcagctgtgctgagcctgtatccatagctctcctcggatccttccatcagcccctctcccccacccctccagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagtgagtcctgggccatctcccagggactggagggaggtggtggggagctgtggagagggcagaggctgggggtgaggggctgaggccaggcttgccctgtgcctcctagcagggcctctaggtgaatccccgtcattttcctgcctccctaaaacaaatgatggtgatgatgatgatgatgatgatgaattgctctgccagccttcagggaaatggccatgctgaagatcctaatgaataattaaagatctggcaaagttctcactgactggtttgctcactgagtcccaccttactgagcatccttgatgaatcaggacttgtgccaggaactggagatacagtgacaaatagagcagggacctgccaccgtgagtcccatacaggctaaaggggcagtgagacatttgtcctacatggggacagatcagtgtatttaagtgtagtggatactgttttctacgaaattgttcataaatttttttttattttgagatgggatctcattgtgtcatccaggctggagtgcagtggtttgatcatggctcacagcagcctctgccccccggcacaggtgatcctcccacctcagcctcccaagtagctgggattacaggtgcgtgtcaccacacccagccaatttttacatttttagtatagatgagattttgccatgttgcccaggctggtctcaaacccctgggctcaagcaatcttcccgcttcagccttccaaagtgctaggattataggcatgagccaccatacccaccccatcaaaaatgtaaaatgagggtcagggcgcattggctcatgcctgtaatcccagcactttgggaggccaaggcggacagattgcttgagctcaggagttcaagaccaccctgggcaacacagtgagaccccatctctacaaaaaataaaaaataaaaaattagccgatgtggtggcacatgcctgtgttctcagctacttggcaggctgaggccagagaactacttgagcctaggaagcagaggttgctgtgacgagagatggcaccactgcactccaggctgggtgacagagctggatcctgtctcaaaaaaaaaaaaaaaaaagaaaagaaaaggtaaaacgtaaccatatcaagtgtgggtaaggctacagagcaactggggctctcatctgttactggtgggagtgtaaactggagccactactttggaaaatggttggacattttctcctaaaatggaatatttgcatacctgtgacatagcagtttgatttcagggatatactccaaagagtatccctgctttgggggatgtgtagtagaaggtttgcagtggtaccgttcatgatattaaaaaccagaaagctactgaaatgcccaataggattataagtgagtgaattgtggtacacaccagtcaaaatgaagggactcagtctcccacagcaatacagatgatacttggaacggtgcaactaagtgaaaaaagcaagtctggcaaagcatgacagcttttctttctttctttttttttttttttttttttttttgaggcagagtcttgctctgtcacccaggctggagtgcaatggcacgatcttggctcactccaacctccgcctcccgggttcaagtgattctattgcctcaagctccggcgtagctgggattatagatgcccgccaccatgcccagctaatttttgtattttcagtagagacggggtttcaccatgttggccaggctggtctcgaactcctgacctcaggtgatccacctgcctcggtctcccaaaatgctgggattacaggcgtgagccactgtgtctgaccgacagctttttaaaagaagttaaacactagtatatattttgtaatagtaccttttgggaataaatggagatcagataaaattagacacaaatgagagcaagggattctagtgggtggtctccttagaagggaacaaaggatgtggaaggaccaggagggcaagtgtaagttactgtcaagttcctagtttctatggtgggtggtaagtttgtgataatattcttatcaacaaaaacacccccaagtcacgaagaggactttgcatggattgatgaatttcaagagtgtgcatgaattaaggtttattatgaccaacccagttcggggcacctgaggtcccccgacagaagtgagtaatgggacgtgttgggggtgcagaggaggagaggctggtcaattttgtttgtgcaagagtcagaaaatgttatatagaggggccctggagtgtcaaaggtgagcatcggccaggaggaagtgggagtggcatggaaggcatgcctgcagctgaggcaaagactggagagactgaaagttacacaaagggctctaagaatatcagttcctggccctcagcagagggagtggaggggagttggagttttgttccccttcactctcttttttcctttctcttctcccagccaggcagagcagggaggaggtgagaggcagagggtgctcggagaggtgagggcagaggccctggtgggagtgctggatgctgtgagctgtgactcagcttcctgggaaaactgagtcagccccctctgtgttcaccaggcctggggtctgtgaccatgagggcttgtgggcccatgttttctcaggaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtgtaagggggcttgcacctggctggcagtgggcatgggggtgggaggactcagtgttcactctcttaccttgaggttcagtacagaccctgcagaggcattgagactgacttctgggatgagccgctgatcatgtcctccactgcctgctactcagaggcaatttaagaccaccctgggcaacagagtgagaccccttgctctggggttctctcatctggcattctctctcatctggcatttgtgctgtaggagcaagggtccccaaagtacaggtccctattgccaccatccgccaaagccagagcttggcttggaccttcattctgcaagtctccacctcctgggccatagacctttggagtctggtagggtagaggagagttcagtggttaatctgaggtaggcattgaggaatctgtaggagttatctagatggggtaaggaagtcaggcagtataggtagagggaaccacacatacaaaggccctgtggcttgatgaagattgtgtggtcacagcaagagatttggggtgcccagagctttgtatgaaatcagtattcaaattactcacctggtaggtggggaaaacttgaggctgttgtaacttcttaggtccagcaagactaggtcctggatggttaattatccagggatttatgaccctcagtctcctttctgacctgtttcaggaagtatttagccaattcagccaattacagatgaggaatctctcttggtggaagcctgggcagagcagttgcatcctgggctaggccctctctcagctctgctggagaccctgcttcccacctttcaggtcctccacatgcccctctgcaggacctgtgtggttgccagaggtcagctttctcagccttgcatcttagccctttgggactcaggcctcaatttatttactgaaggaggctgagggtaggggcaagagatcctttgtgctgagggaggtgagggtggaggagtccctgggagttgtggctctcagatggccccgtcagaaatggctcctcagcctcttcctctccctgcagccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaaggtgagggcttctctggctgtgctctcctcctcggagccccaggcctcagccggctcctttgtcccacgctatgtcaatgggcgctgacttgacctgtaggaaacccacactgtggcgggcaggcgtgggtgtcaggaaggccctgggacccctggaaatggcggatggaaggctggctgttggggattattagatttttctggaaaaagaggagcaaagacatctgtgatcttcttcaaaggagctcatgctccccagagggcaaaggaccagtgtctgagccacggctgtgctggatgacagggacttgggtgggagagatggggaaggttgggtggagaaggctcgtcagggtatggcagagtcaaatcccacctctgccccttacagccatgtgaccttgggcaagtgactatgtctctgcacctctgttatctgtaaaatggggatgatgtcacataccccaagaattcgatgaaaaaacagatatgaagggcttagtacagagtacgtgctcagtaaaacggcagcctaagaagcacagggctccggaatccccaggcccttggtgccacctttcaccacagactgccctccttcccacccgcctgcagggaacctcactcttttttctttcctccttccccacagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacggtgaggtggctgtaggggcggcaccttgttgccccctgtgcccacgtgccccttccccaccaggcccctcgttgtctgaaaccctgttgttcaaggcgttcctactcatgtaggatatgtcttcctccttgcctccatttccaaagcgctaatctcctaagatggtggggtcaaagtcaagtcacccagggcatgatttgaggatgatcagctatttttctttgcctgtgagagaggagtggccgggcatggtggtgaggtccaggttccacgtagagtctccacaggaggaggtcccctctggaggcttgctctatcagagccctgctgatggaggacaatgcccccagctcctggtggagaacacactcactcaaatccagggaagcaggcaggagcccggaaacattgggaggcccaggcatttgctgtgggctctgccgtccatggtctttttgttgtccttcctcctcccctttccagacctcagtaccctacggtgcccccaacgcccagaggcatccccagtgctctttccatagcagcatggcaccctagaaacttctttctttggatattaagaataatcagtcctggccgggcgcagtggctcatgcctgtaatcccagcactttgggaggcagaggtgggcggatcatgaggtcagaagttcgagaccagcctggccaacatagtgaaaccccatctctactaaaaatacaaaaaattagctgggcctggtggtgggcacctacaatcccagctactcaggaggctgaggcaggagaatcgcttgaacccgtgaggcagagattgtggtgagccgagatcgcaccactgcactccagctcaggtggtagtgtgagactccatctcaaaaggaatacagtagacctcaaatgtcctcacgtggctcagaggggaggggtgtactggtttgctagggccgctgtaacaaaatggcattgactgggcgatttaaacaacaaacattgattttctcacagttccggaggctggaagttcaaggtcaaggtgttggcagggttggtgcattctaaaggcctctttccttggcttgtagatggccgtcttctccctctgtctcacatgggcttccctctgtgtctgtgtcagaattgtctctcctcatgaggacactaatcagaactggattaggatcctcctcaaggacttcattttactttaaaatctttaaaggttctatctccaaatatagtcacatttgaggttctgagggttaggacttcagcagatgaattttgggagggggtatacagctcagcctataacagggaggcagcagtgtgaacggaggaatagcacactgcagtgacagaggcaagcacctgccactgacaaagctgagaggtggggagtggctaatgtggccatgaaggacacggagaaggctccacagaggagctaaaattcaacgtgcgtgtcttgcaggctgttgccaggaggagagagaaggaatagcatttcaggactagggagaagcacatgtcaagccccctgggtgaatcactttcattcccaggtattatatctgtgttacactctgatgaaggagtttccatccctgagacagactgcaaatggagcctttgagcataccttaaacatagttcattgtctattacgtagaagagatcttcaaaaatcactcaccggcaccaaagaaacgattactgtgaggtcacatttattaagcacatactatatggcaggcagggtcctaagctgtttacatatgttacctcatttaatactcacaaacaaccctctaaggtatgttaccatcatccccctttttcagatgaggaaagtagagcacagagaggttaaataacttggtcgaggtcacacagctagtaacatagttaaccaccttattaaatcccaagtacatctctatggcaggccttggcagtactgagatgaatacacacatttgattagagtcttgcagagggagcacatccttccttcttaggcggggaagggaattccaggaagaggacctagcgtggggaagacttctgggcttcaggggctgtgtgccactccatgtagctggaacattaggtgtgtgttggagagaggtggggagtggggtattggggagcagcaggcaggtgttgaggggccctgtggctcaggcctgagcctctgtatttcatctggaggctctggggagccaggcaaggattttaagctgagaaggagctgtgtgttgtttcagtttccgcatctgaaaaagggggatgatggtaacataccttagaggtttgtttgtgagtattaaacgaggtaacatatgtaaacagcttaggaccctgcctgccatataatatatgcttaataaatggtacctcacagcttgtcattgttgcccctgccaggaggagggaggtgggtgtctaagtctgttggacaaaaatatgatccttggtaagataatgtgtcaacaacccatgtcctagtccccaggagggagggctgctccaggctggagtcccaaacgggcctggtttgtcatcattgaggaatctgggactgtggggtttgatgagggtcactcagatctctggcgaagggctagtggtcacagcctctggcttacgttgagattagctgattaatttcaacacacaccacaccctaattgcaacactgataggaaacatccggctggtctggtttcagcttctttgagccttacttgaagccatgttgctataggtgaagcctaaggttttaggaagttctactggaaagaggggtggttgtttaacaaggcatttcaaaaggaatggcagtcattctggagtgcaatcattacagaaggatttggcctctaagggcctctggaattctttggaagaaggcattggctgtgtagctgacactctactcactgtggacatgagtgggtttttggtgacatgagggacgagggcagggacaagtgctgccctgaatgttcctgcctggccggcaagaaagccttcttggacatttgccttttagacaatggaatgtgttttgctcttgcagaggatggtcttggagactgggatggggttcggggagaaagaggttcttggaaatgaaaatttaccatggggtcaaggacctcaaggggccccggagtgacaggccctcctggtcttctgtataccctactccccaccagacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaaggcaagcccacaaccacccatgccgcccccaactccaatccctgggcagggccagggaagtgcccggggaaagggttacgaggatgggctggtggaggaggttggaagcaggaagtgaaaagtctggaggagaaagaaatagagccagggccctacccccaggtccccccaggctgctgcagctagggctgagatgccacacagggtgtggggctccggcggctgtgtccagcctttggggccatcagcttctgagtgccctcctcccgcagacttcaccccatctccgtgaccctgcagagatatcttgtaaatgacttggttcttcgagattacatgattcctgccaaggtaggtgcagccagcaggctgcaggctctgccagtcagagagggctggggcaggctggaattgcagacagagggtggcactggggccctggtggggcccttgatggcagcagtctaagtctgaatgaagggcagaggtggtgggcatggtgggcggtgacctctaggatgttattggaacccagggttaggagggagacttcatgatttgcctgggtctgaggaaagggtgggacaatcatcctggccttgggtcttcagccatccccatttggtgggtaaggattacagaggggcggggccttgttcaaggctgcacagtgggcagaatgtcctgccctggagagctgggcagccatgctggggagtgggagtggtggtgagagggcaggggactagggaagggggttttgtgctcagggctgtggggaagtggggcttactcaggcctctgatcaccttgccccagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatgtgagtcaagctggggacatctaggcaccctgggctggccctggccctaatgaaggcaccaatcttcctcctcctatctctgtccagagcccaaggatgtcagtgctggggcgcatctacctccagttacttgctctcgctctctcccacagttctctgctgccccctctttcgggctcaaccactcatcacccactgatgcccctggccatccattccccatggtggtgatgggatgggataggactgaggtttgtagacaagttaaggtctaggcctaaatcaagggaatgcagcactaagggtgcattatcaggcactgtgcagggttacaccaggagctggtggtgaactccttggaactcctcaaatcacactccacaggcactgcctatgggtgaattggcctggctagggagacagatcctcccctgccctcccctaaacctaccatctgcctttctcagatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatgtggtgtcttgcgttccatcagactcattaggtgttcatcactcccgtggagatgcttcctgtgttaaagcaggatctgggcatgctcaggagaccccaggtagccacacttgaagccacctctgctgggaccccctcacccatggcagttcaggagccagcagaatcaactccaggctccctggggcaaggggtgaggcagagtggggcagaggaggggaggcaactgctactgtgccaggagctacagaagcatcaggcagaaggacaaaggagaactggggagttctgtgggtggccccaagaagtgtgggccagtactgcctttctgagtggacctgccccacaggggtaaggctcgcacagggctctgcttgggtgaactctgggtgggagttccctgtggggcatgaggacttcctgccaaggcccagccagagtcctgggcatggcaaaggccgagaactgtgggtgagaacccctgctactgaagggctggtgtgaggtggctgactggggatgagaggccagcctgcttcctttaccattcccgggcctcctctgggcttgctccaggcctcgtgttcttgctctgggggcttgcgcccccttgtccaagggtgggaggtggggatactattctgcagcagagccgctggtttgtcatttggactgaatgacactggtctcgacttccgccccctaatcccttggggtctcccaactcctgacctgattcctcttggccctcggctatccaagtctaagtcctgcaggcaggtgggggagctagtccagctgaggccagtggtccagctggcctggcctctcctgcccgaagctgtgggatctggatccactcttggagcccttctgctttccccaccacaaaatcctcttccctgttgtctttgtctttccttcctgtgtcctttttcttctctggtcctgagtcagctttgactcagaaatgttatagctggaaagaggcttacagccaatgaggtcaagctctacatggaatagatggggaaactgaagtccagagaggttgcttgggtcccttgaggtcacacagcctgtttgcccccagaacctgggcctcctgactccctgtaggtgcctccttccccctggcccaatctgctctcctgccccggctacatttggacacatcattgccagctcagcctagtggcttaatggagtattccacaatgatacgtgactgccacaggaaggcttcaagcctccaagtctttccctttccaagagacagacaaaccaaacttgaaagaaggaatatcagacatgatagatgttttggggcagatgaaaaggacaagcctccctcgtatttcccaacagagctggtctctggtggccttgcttcttctccgggtctggaaggggcccgtctccctggcccctgctttggaaggcctcttctctccaccctcctgggtccactgtggcccttggctttccaaagatgctggctcctggggcaggcgggaggctgtaaggctgcagcagaagacccaggcccaggcccagagtgaggtctaggaggaggaagcagggcccccaggctgccctgctccaggaaagaggaaaatgctcacagagctacaacatttaataacgtcatttttagggggcggtgatgagactccccagcacacagggaaggaggcctgctctggggctcaggtctgctgagagttagcggtctccttctgggggctcaagggcttgttgagcttagagtctgagctgggcagcaggggctccagctctgagggctgcttgaggtccatggagtgggtgagggcactctgtggtgtgcaaagcggggtgcatgagtaccccccattcccagggggtgacctgctcaagggcatattgcctgacaaaccaggcctcagagtatccagaatccagtgggccatgacctggcaaagatttctaaacccattttgccacagcaggtgacacctaa

SEQ ID NO: 16640 - DNA, 9350 bp, Human
gtggagtggcacgatcttggctcactgcagcctccacctcccaagttcaagccattctcctgcctcagcctcccgagtagctgggatcacaggcacatgccaccatgcctggctaatttttgtatttttagtagagacggagtttcaccaggttggccaggctggtcttgaacacctgatctcaggtgatccgcccatctcggcctctcaaagtgctgggattacaggtgcgagccatcgcgcctggcctagaggtgtacattttttaacagaaccattcaaaaggaggttgtggggatcatgacacttccatgctacagcattaatctcctaagaataaggatacactcccacataccatgacactctgttcacacctaaaaaaatttacatttattccagaatatcatctaatctccagtccgtgcttacatgtccccaattgtccccaaaacatcttttatagatttttttaaaattttgtttaaatgccatatccaatcgatatggcaatcaaatgcaaatccatattgcatttggttatgtctcttagtctttttgcataaggggggcctctctttaggatgcaaaatctttatcatctcttcttttccacttggggacttgggctgaaaatcaggagtggctggaacacgcccatttactgtttggttttgcaggttgttggagggtactacagaagaacatccctctggagaggggccgtgagcctggttggcctagactgagtgccctggcagagctcttcctcatgtgtgcagtgggaaagaagcccagatcagtccaaaggcctaacccccactcccagaccctaccctactcttcagagaaataggctccctaccctgaaccctaaagacagctgtaccttcatccccagggacccagcaccccttctggcctatccccaaagagtcaccctgggtcttaggtagtaggtggagctgagggataatggcccaaggccaagagttgatccttccaactttgttcagtgatccagctttcatatcaggtgatcaggacaaccaggccaatctgatagggggcggtgtttataaaaaggccactcacctagagccagaagctccacaccagccattacaaccctgccaatctcaagcacctgcctctacaggtacctttcttgggaccaatttacaatctctgggatccccaactatagaacctggaagctagtggggacagaaagacggggagcctgggctaggtgtaggggtcctgagttccgggctttgctacccagctcttgacttctgtttcccgattttaaatgagcagtttggactaagccatttttaaggagagcgatggggagggcttcccccttagcacaagggcagccctggccctggctgaagcccaaccccaacctccaagactgtgagaggatggggactcatccctggaggaggtgcccctcctggtattgataaagaatgccctggggagggggcatcacaggctatttgaaccagccctgggaccttggccacctcagtgtcactgggtagggggaactcctggtcccttgggtatatggaaggtatcagcagaaagccagcactggcagggactctttggtacaatacccagcatgcatgctgtgccaggggctgacaagggtgctgtccttggcttccccattttggagtggtcacttgcctctactccagccccagaagtggaaactgagatgatgtgtggaggagagagccagcgttcatgttgggaatcttgaggctcctttccagctctcagattctgtgatgctcaaagggtgagctctgtgggcacaggacgcatggtagatggagcttagtctttctggtatccagctgggagccaagcacagaacacgcatcagtgtttatcaaatgactgaggaaatgaatgaatgaatgtctccatctcaaccctcagcctggtccctccttttttccctgcagttggtacagatggcattgtcccagtctgttcccttctcggccacagagcttctcctggcctctgccatcttctgcctggtattctgggtgctcaagggtttgaggcctcgggtccccaaaggcctgaaaagtccaccagagccatggggctggcccttgctcgggcatgtgctgaccctggggaagaacccgcacctggcactgtcaaggatgagccagcgctacggggacgtcctgcagatccgcattggctccacgcccgtgctggtgctgagccgcctggacaccatccggcaggccctggtgcggcagggcgacgatttcaagggccggcctgacctctacacctccaccctcatcactgatggccagagcttgaccttcagcacagactctggaccggtgtgggctgcccgccggcgcctggcccagaatgccctcaacaccttctccatcgcctctgacccagcttcctcatcctcctgctacctggaggagcatgtgagcaaggaggctaaggccctgatcagcaggttgcaggagctgatggcagggcctgggcacttcgacccttacaatcaggtggtggtgtcagtggccaacgtcattggtgccatgtgcttcggacagcacttccctgagagtagcgatgagatgctcagcctcgtgaagaacactcatgagttcgtggagactgcctcctccgggaaccccctggacttcttccccatccttcgctacctgcctaaccctgccctgcagaggttcaaggccttcaaccagaggttcctgtggttcctgcagaaaacagtccaggagcactatcaggactttgacaaggtgagcccggggtgcaggtggcaaggggcaccttgcagggcctgggtgcagcccctccctcccagctccagcatgcccacacagctgctgtgttgccaaggcctaggaaggctctggacacctcagaccagctgtgtgacctggagccgactcttccccttctctgggcctcagtttcctcatccttgaagcccccttctcagggctcctcaaagcccccaagaaaaaagccctggaaatggggccctagcagagtcctgcaatgtggggggcctatgagtgagaaagctttcattctgcagaaacctaaaccccaacagaggctaatccccagctctggtgtcacgttgcttccctgtgttcacactaaccttttccttctttgaaattggacccctggtgttattgggaggaagggtcaatggggcataaaatgacactttaagccatacccagggctgctaccagctcctgctgcaagctgcaaccccctgcctagagaccaagttgggaggataggggggtacccagccaccaggtacaggccaggggagtggagcaacgttcagcctttgaccttggaagtgccagaggtgcccctaagcttgtgccccctcagaacagtgtccgggacatcacgggtgccctgttcaagcacagcaagaaggggcctagagccagcggcaacctcatcccacaggagaagattgtcaaccttgtcaatgacatctttggagcaggtaggaaccagaaccttgcccctccatccaacaatgcctgctgttcacccacagccttgcccagcccctcagtccatgaaataacccaccaaccctacaccagatggtacaacatactgagatctggcttgggatcagggtttgagcctgggctatgccaccaattcccagtggagaaacagcaaagtccttctcctcccctaggcttcagtttccccatctgaacaataaggtgttctctggcctgtaagtctaggcccctataattccagcagctaattctgaaacctgtatctcaagtttatgttgaagagacccagcctctgtcttcaggaaactcacaggctagggccagagaaagctaatgctggatacatacatagcagatacttgggaaatgatggtttccttgtttctgtcttccttctttcctcaccttacactacacggttcaggatttgacacagtcaccacagccatctcctggagcctcatgtaccttgtgaccaagcctgagatacagaggaagatccagaaggagctgggtacatgggggcccccaaccctatagccaggagaagccttgagacccaggttgtttgttcagtctacaaacacctgttatgtgcctgctgtgtgcaagccctgggcacacagtagtgcctgcccttgcctagaagatgtgggaggttagtggggtcgcagacttgtgaatagacagtcttacataagagtgacatggggtataagaggggataattcatggggcagttagggcagcccctgagctctgcttgtcctctgtgttctacagacactgtgattggcagggagcggcggccccggctctctgacagaccccagctgccctacttggaggccttcatcctggagaccttccgacactcctccttcttgcccttcaccatcccccacaggtgaggcctgccggttctgccctcccacctctaaagtgcttgccatgttttctcttcctggcttctcagccctggccctggctcagcatctccttcccgacctcgttccccacagatcccggcctcagtctgcccccatccagtccaaacataatctaacccccagctctcaggagaaagttccacttgtgatctcagcgctcattcccctctgttcatattccctccctcccagtgccctctgtgccagtcaggtcggcctcaccctcacaagcatgaccctattggcctccaatcttgctaacgctgaaccttctgcctggaataccttctagcctcttctctgaccaccagaatcctacccttgctcaaagtcaatgccgacacgagcttcctctccccagaagccttttgactcatccagctggcacagcttcattcctgatgtcttataggacttacagccatcagcccttgatcatgccctggaattttaacaatgtcaagagagttagtgagcatttacttctacccaaacgttgttctagttattcctgcagtaagaggcctgaatccccagccaggctagaaattccccggggctgccccaggctgcctgctgcttttttttttttttttttttttttcatagaaaatagaaaaacatttatctgaaattgcctgcttcttggctccagagaacagccaagtgcgcagccaggcgcaaagagaagtttagtaaatacttgctgaagttaaagaacaggacgcaaggaagagggaggatgtttctacctcttccctgttcctcccctcccctcccagtgtagggatggagatggcggtgggcaggctgtctggatggggtggaggtaggagcaacacatgccccagctttccagccctgagcctcacagtgccctcttccctcctcagcacaacaagggacacaacgctgaatggcttctacatccccaagaaatgctgtgtcttcgtaaaccagtggcaggtcaaccatgacccgtgagtacatacccctcacgaaaaaatgtgtgcaggttcagcagtcaggaaggctgtttgtccctgctaggaactgtttatataatgaaaggaggggacctcaattgctatagtctgctctaagtgacgatatttacaaaagtttcacaaactttagtgcacaggaatcaactaggatggccaggcgcagtggctcaagcctataatcccagcagtttgggaggccgaggcaggcagatcacttgaggtcaggagtttgagaccagcctgggcaacatggtgaaaccctatctctactaaaaatacaaaacaaaaattagccggacatggtggtgcgcctataatcccagctactccagaggctgaggcaggagaattgcttgaactctggaggtagaggctgcagtgagccgagatcgctccactgcactccagcctgggtgacggagtgagactctgcctcaaaaaaaaaaaaaaaaatcaaccaagacgtttgttacaggtgatggttcccccaggattctactgtggtatctaaggtggggtacctcaggcgattctgatgtgaatggctcagagacctctctttggaaagccccactttagtgtataggtagggggaccatatatataatttaccatccacactgggacatttgagtgtgaaaatgctatcaatgtttatgctagtcatcattactccaaaacaataaacataagccaggacatactgttgaggccccttaggaggcatattttgagtaggatgaagaaacgtatgtctttctttcttcctttcactttaatttttaaatagagacaaggtcttcctatgtggtccaggctggttttgaactcctgggttcaagggatcttcctgcctcagcctcccaaagtgctagggttacgggtgtaagccaccaaacccagcctgtttttcttcttttaatttcttttagataaagcattatttaaagtaaattaatattaaaaggcactatctttaaggctggtcattttagagagagctttgtaaaagaaataagcatcaggccaggtgtggtgactcatgcctgtaaccccagcactttgggagtccgaggaaggtggatcgcttgagctcatgagtctgagaccagtgaaaccccgtctctgcaaaaaaaaaaaaaaaaaaaaatacaaaaattagccggatatggtgcctgtagtcccagctacacgggaggctcaggtgggtggttggcttgagctggggaggcagagagagtgcagtgagctgagatcgcaccactgtactccagcctgggtgataggagccggagggtgtctcaaaaaaaaaaaaagaaagaaaagaaaaagaaataagcatcaaagttcagtttggttccttcccacctacccttcattgctttcaaagtgccctcacacttgtgttctcaacagaagtctccctcccccaggcacctcctcccagggcctctccagccctgaggtcccatctcctctgttcctcttgcagagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgcgcttctccatcaattgaagaagacaccaccattctgaggccagggagcgagtgggggccagccacggggactcagcccttgtttctcttcctttctttttttaaaaaatagcagctttagccaagtgcagggcctgtaatcccagcattttaggaggccaaggttggaggatcatttgagcccaggaattggaaagcagcctggccaacatagtgggaccctgtctctacaaaaaaaaaatttgccaagagcctgagtgacagagcaagaccccatctcaaaaaaaaaaacaaacaaacaaaaaaaaaaccatatatatacatatatatatagcagctttatggagatataattcttatgccatataattcaccttctttttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactataggcatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgtttttttttttttgagacagagtcttcctctgtctcctaagctggagtgcagtggcatcatctcagctcactgcaacctctgcctcccaggttcaagtgcttctccagcctcagcctcccaagtagctgagactacaggcacacaccaccacgcctggctaatttttgtatttttagtagagacgggtttcaccatgttggctagactagtctcaaactcctgacctcaagtgatctgcccgcctcgacctctctcaaagtgctggcattacaggtgtgagccacggtgcccggcccacaattaattttagaacattttcatcacccctaaaagaaaccctgcacccattagcagtccctccacatttccccctagcctgcctcccctgcctcaccagccctggcaactgctaatctactttctgtgtctatggatttgccttctctaaacatttcatataaatggaattacacaatgagtggtcttttgtgactggcttctttcacttagcacaatgttttcaaggcttatgtgtgttgtggtgtgcgtcagtaagctcttggtgcttgagtcctgagactgggtctaggtctgtgctctcttaagtcgttgataggcacctccttcactcctctcctctcctttcatgttgtttgacccaagttttttaacaattgaagggaacaaggagaaagggatccagtctcaggggccaaacccagttgggtggatggggatccctcctgtcccattctcaaaaggcagaacacgtgacttctcacaaggccttgatttcttcattcacagcccgggaggggataagcttcccagaagtgcttaggttatttgaaaaaggcccaggtctcatcaaaggacactatcaagaaattgaaaggaggccaagcacagaggctcacgcctgtaatcccagcactttggaacgccaaggcaggcggatcacttga

SEQ ID NO: 16641 - DNA, 52790 bp, Human
  misc_feature (1)...(52790): n = A,T,C or G
tgggatgcctgcctgtggtcccagccacttgggaggctgaggcgggaggatctcttgagtccaggagtttgaggctgcagtgagctatgatcgtgccactgcactgcagtcggagcgagagagcaagatctcatcagggtttacaggaagccaatcttctccaggatcaaggacatgctatatcagccttctcagcactctttctctcacactggaggcaggacatgccatatctggactttgggtttctctgggacatagtctgcaaattattcctctttgtgaacccacagcccagcaagcagggactggcatagggcaggtctcaatacttatttgttaagtaatggcctggccaggtcaccgtgatcaaggtggagtaggaaggcctgaactttggcacaaaaagaaagaagtttcacatgcagacttcggggagcatgggagtgtaaggaagaaggggatagcacagagctacatgagggcaggggccccagagcaccacagaggtgaggccctcagtcctgcaggtccagaaagagcatgccccttgatccaggtacctggaattaacttgcctctccagggcttgagaaaacctgaatgcaactcgtgaatttcctttgagaagtgttaacttccaacaggactttggggtagtctgggagcaggctatcttccaaagcaagcaaagaaatgaataaagcttccccagctctgcctcctcagccaatcgcctctggcctccgaagccccatcctgccatagcccacttccaggtcccttgtgcagatggctgcccaccatatttggctttcatggactgattctctaaaggcctgggagtactgaccaggctggagggaagggcaggctcctgaggccttacagtccctaggaagttgcgtatctgcccaacccctgctctccaccctgcagactgtaaggtttacaagagccaggccctatcatcatcctttctagtctgtttctaagttggaacagagtacggaatgggtacacaggagccagcacagtggttgcgatggtttaagtttgaagccggggcgctgacccagtgaggtcacctggaactgtgcccctttccccttaccagctgggagtctgacatgcttttccattggcgaagacctagctggctctcccctcaccctcttcatacccgctctccagctctccccctccctcctgcccccaccacctcagatccaccagcctttccagctgtcactcaaggcatcatcctgctccctcacctccagtcactggcttcccaggatctctgaatcaagtccctcctctgcatcccacagccactgtcctagaccagggcacctgctcctaggttgtcagagtgactgtcccatcatgcacagctgatcgtgttgttccctggttccaaatccttcagcaacttcccatcactcacagaactggttcaatctcctcagctaggatcttgtcctagcacactccttgggtatcatttctcatgaattccctcttaaatctgaaaatggccaaaattagttcccaaacaggcttttgcaagagctatcttttctgtttcaagtgtcccccgtaccccaccacctacaaccctaaatccctggtgaatttccactgcttttgcaggtcccagctgtgggctctcctttccagaatgtctccgtttgcaggcttgctcttccattacatctacggctcttagaaagcaggggctgcgtgtggctcatctttgtacgcccagctcccggcaggacgtggcacgaagcagtgccagtgtgaacggatgaatggatcaaagccgggagcagggctgcccccctgcagctctgccctacctctcccgctttaccgtaagtcagcggtaggtctgcagctctccgcctctacctcctccccgctctgggcgtgtctttaaaacccacagtcggcctctctgccccctagaaccgcccccagcttctgtctcacttcctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagaggtactattgggttaggggatgatggggttaagctttgttggtttgctgtggtggggagaggcgggaagagagggtctaacggaggatttggtcaagtaccctagagagtgacacaaagcgggaagtccagacaccagggtcctgaccgtctcgggtggggcagggaagggagggtaggatagagtagaaaagaggacacggaggagttggggcggcctcgctgggctgcggtttctccactgagcagttgggcaaggtgagaagggtcagtggcctccgggcctgggcccttccgcccaccctcgagccctgcctcaactttgcctcagatgcaggacttcagattagggaggatggaggtagtacccctgttgcgctggcctggagccaggggcatgtcccaggcacggcaaaactaaaaccaacttcccagatccgaggtgagaaactggctcagactgaagaggtatctttgccaaggcctcccagctcatgtggtttctgcttaaggaagcctccccaacgaacccttctcttgccacacctttcctgcccacctcccacctcccccgacaaaggaactacttgggtttcttgctctgctgcctttcaggcccttttactccccttcatgaaagtacagaggacaccgtattacagtaacttttataaacattattacaactaagaataacattacttaacaatactaggtaacatttatgagcacttcaaatgtgccaggtactgtattaagcactttgtttttttgttgttgttgtttgtttgttttgctttgttttttgtttgtttgtttatctgtttgtttttgagacggagtctcacactgtcgcccaggctggagtgcaatggtgcgatctcggctcactgcaacctcctccttccgggttcacgccattctcctgcctcagcctcccgagtagctgggattacaggccacgccaccatacctggctattttttatatttttagtagagatggggtttcactatgttggccagattggtctctaactcctgacctcgtgatccacccacctcggcctcccaaagtgctgggattacaggcatgagccaccatgcccggcctgtttttgtattttacaaaatgtggtaaaatatacctaatggataagttcctatgttaaccatttataagtgtaccattcagtggcattaagtagattcacaatattgtgtaaccatcaccaccatctatttccagaactttttcattactccagaaactctgtactctttaaaccataggggagggaaagatggcttgcctccacccttctagtttccttggctgggctatgaattaaatagcctatgaattaaatagtcataaaatagattaccagcggaaaacccatatttaattacatatgtatactcaggagtcccacaatatatgagactcaaagaaaggtcagatgattgaagcctgtataacatcctgagctacggaaaagagcttggagcttctgggtgatggtgataacacaagttatgggagggtgaggagaggagctgtttggtgaatagaggttgtcttgctatgtagattaaaagttcttagataataaaagttgtctggagcagccctcttttaatatagatcattttactaatgtagattttcttttaagatataaatgcctttcttttttacaaaaggagagcttttcagagctattcctgtatcagcagtttctcagaataaccagcttaaaatatgccaaagaagtatatttcaagagcctcctgcagtcatactttgaagtggtgtgtcctgagccccagtaatgcaacagctcctcattttctccttcccctagcccttggtaacttctaatctaccttctgtccctatgaacttacttattctagatatttcatgtaagtggaattgttaccagtagaggatcttgactgcaaattgttcaggttcttggcattttgaacaaagaattggacaaaatgtacagcaaagcaaggaaagagtgaagcaatgaaagcagagatttattgaaaatgaaagtacaccccacagggtgggagcggctagagcagggctcaaggaccccagttacagaatcttctgggttccaaataccccctagaggtttcccattggccacttggtgttcaccccattggttgcagaaagcaaccaaccagacgtactttcaattttccatctgccctgcaggaaatggggtgatttgcaaagagagtagcctctcttccttttgttactgaggcatggagagttgcggttttcctttcgatttagttctaggaagtcagagggaatcggccttaggttccctgcctccagaccctattctcctgcctcagaatcatacagtatttgaccttttgtgactggcttatttcacttagcataatgtcattgaggtctatctatgttgtagcatgtatcagaatttcatttctttctaacgctgagtaatattccattatatgtgtagaccacattttgtttatctattcatctgttgatggatacttggattgtttctacattttgtctattgtgaatagtgttgctgtggacattgttgtacaagtatctgtttgggccttgtttttacatcttttggttatatatctaagagtggaatttctgggtcatattgttgttccatgcttacctctttaatgaacccccaaactgtgcattaagcactttatatgaggttggtacttagtgtatctaccttccaaactgagttccttgaaggcagaatgtatcctacacctcttatatctcagagcctattactgtgggtgatgagaagtagatgctcaataaatggtgcagtgagagctggagggcctgaataaatgggggtattggggtgctgataagccagggttttgcatcatccaatgactggctggaatggaatatgaggtcctactccagggtccagctgtaagggtggttggccggtaggtgggggcttttgggacttctccaggcctcacctgcctctctggtcccccagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccaggtgagtaggccggcacagggtggggtggtgcatccaagtaccaggtagagggcgagaggagcaaagatccaaagagtcacacagctgaggacaaggagcttctggggccttgcaactctaaatgtggtctgcagatatgcagtgtccgtgttgatgaccacaatttatgctgccagtccccacgcaggtggatagtaagtttccaatttcctcctgtaataaataatgctgcagaatcatctttgcatctttatccagtaacttctttaggataaatttttagaagtgccactgctgggtgtagggggacgggaattctacatttgatacatgttaccaaactgccctttagaatttagtggaattttccgagagcactgacacggaatctcagtaaggctggattctaggatcagagacaggtagttagtttctgtctgaaaagttgaaaccattaacaccaggcagcgctatctgagaatgtctgtatggggaaaaaaaatcacatccagttgtaattatttttattaaacagattttaactcagttttttaataggtaatacattcgtacagttcacgaacaaaatttgtaaagaggagagagagagtgcaatcttctgtccatgcccaactgcctaattcccaccacttctccctcttcccatccacaggtagccattgttactagttttgaatgtttcttctgagagtttctttacgaatatatatgcaggtaggagcaatcttatcaggtcctattttccctcttttagccaaaaaggtagcataactatgtgaacttttcaccattagcaatagattgttcatagaaggcgcttcttggttcttagagatccacttgcaaaatgaaagcatttttcgctggtttttgacaactcagaactatatatggctaaaccacatatttgctaaactacatatctgctaaactgactgtgatttgtttcctgctttaggataaacttcccacactatcagaataagctttcccctccgactcctcaacagctggtatcaccacgtttcttagcttattgtaaaggttgagtggctttccacttgtttattggccattgtgtttctgcatttgcgagtggcctgtttaggtcctttgcctgttgttgttgttgtttcctttgaggaattaagggactaattaaagaattcaggaacaaattcctcgaaagaaaaaaatgtatgcatttcttttgctcttacaatttatgcagttttaaaacttacatatttattggattttgattgaaattgcaataaattaggagaaattggctttatctctggttctatcttttggatttaaaaaattttttttaattttttttttttttttttgagatggagtctcgctgtgtcacccaggctggagtgcagtggcgcgatctcggctcactgcaacctccacctcccgggttcacgccattttcctgcctcagcctcccaagtagctgcgattacaggtgcacatcatcatgcctggctaattttttggcatttttagtagagacagggtttcactataatggtcaggctggtctcctgacctcaggtgatccacctgcctcggcctcccaaagttctgggattacaggcatgagccaccatgcccagccttatactaatttcttaatgaatttgtaagctttcatgttttgaacgtgataatgcagccatcccacgggatccatgggagtctgtttcaaattcatagatgctcaagtctctgatataaaatggcatagtatttgtatataacctctacacatcctcctgtatactttattttttattttatttttattttttgagacggggtcttgctctgtcgcccaggctggagtgcagtgctgcactcgtggctcactgcagcctcaatctcttgggttcaaacaatcctcccacctcagccaccagattatacaggactgcaggtgtgcaccaccacgctcagctaatttttaaattttttgtagagacagggttgcacgacattgcccagactggtcttgagaactcttgggctcaggcagcaaccctccctaggcctctcaaagtgctgggattacaggtgtgagccactgtacccatcccctcctgtatactttaagtcatctctagattacttataatgcctaatacaatgtaaatgctatgtaaagagttgttttactatatttttgaatttgtatatttttttattgtggtacttttttaattgattttttttcgcctgaatatttttgatccaagatttgttgaatccacgggtgcgtaacctgcagatactgagggccaactgtacatataaattgtttagcgtagtgcctggcacatattaaatactcagtgaatgttaaaattctattataatttctctgctctagaacaatttgaagaatataagaaatttaggcttataaaagttttttgaaaaaccatcttggaactggtgccttttttatagtagatttttgggaacttttcccatttttgccatggcattaatctgttttggctcttgtgtcagatttttggaagattttccagttcatcctgagttatctttcattatttaaaaatctcctatatgcctgtaactataccccctttttttatttctgatgttgtatatttgtggtttagcagtcttttcaaagtactgtacttttagtctttccttagattgcttactgattttaatgttttccttctttctgtttgatcattttatttttgtcattttcttccttctaacttttgtcattattcattttctagcttcttgaacttataattcatttatttgcaatctttattgtttaataataataactttttttttttgagaatctccctctgtcacccaggctggagtgcagtggtagatcttggctcactgcaacctgtgcctcctgggttcaagtgattctcctgcctcagcctccccagtagctgagactacaggtgcccaccaccatgcctggctaattttttttatttttagtagagacggggtttccccatgttgaccaggctggtctcgaactcctggcctcaagtgatccacccgcctcagtctcccaaagttctgggattacaggcgtgagctacaatgccctgcctaataataactcttttaaggcataagttctctgtatatggttttggctgtatgccataactttgataacttcattagtgttctcatagtcaatcatttctcaaatttcatttcagtcttttcttaaaaaggttctcttgcttaaggtcaagagttcgagatcagcctgggcaacatagcaagacctcatctttacaaaaaataaaaaaaattagccaggcatggtcggtggtacatgcttgtagtcccagttatttgggaggttgaggcaggagggttgcttgaacctaagaatttgagcctgcagtgagctgtgatggtgccacttcactccaaccagagcatcagaaccggaccctgactcgaaaaaaaaaaaaaagaaatttttttctcttgaaaagttttagagaatagtgttttctaaaattttcaagtggttttgatgtttggtttcttgttctgtcacccaggctggaatgtgatggtgcgatttcatacttgttaatttctgcactatggccagtttatacagtttgtatgagttctacatctaagactatattgagattttcttagcggcctaggatattccttggactcacatattcctagcaataatccttagagttgaaaagttgtatttgttgtacacacatatatatacatacacaaatatatgtatataatatatatgtgtatatatgcatatatctatatgtatatatccatatatatgtaagttctagtgcttgtgtgtgtgtgtgtatctccacgctattgaaactttctacctttctttcttttcttttttttttttttttttttgatggagtcttgctctgtcatccaggttggagtgcagtggcatgatctcggctcactgcaacctcctcctcccgggttcaagtgtttctcctgcctcagcctcctgagtagctgggattacaggcgtgtgccaccatgcccggctaagtttttttttttttttttgtatttttagtagagaaggggtttcattatgttggccaggatggtcttgatctcctgaccttgnnnnnnnnnnnnnnnnnnnntcttgatctcctgaccttgtgatccacccgcctcagcctcccaaatgctgggtattacaggcgtgagccaacatgtctggccgaaactttctacctttccttccattctgtttcaccagttctctaaatgataattacagagtggtaacttccccatcaaaacatatatataggccagatgtggtagcttccacctgtaatcccaacactttgggaggccaaggccggtggatattttgagcccaggagtttgaggccagcctgggcaatatggtgaaaccccgtctctacaaaaaaatacaaaattagctggacatggtggcacatgcctctcgtcccagctattcgggaggtggaggtattcctcagagaggatcacctgagcctgtccgttcaaggatgcagtgagccatgatcacgccactgcactccagcctgggtgacacaatgagactctgtcttaaaaaaagaaaaaaagtgggccaggcgcagtggctcacgcttgtaatcccagcactttgggaggctgaggcaggcggatcatgaggtcaggagttcaataccagcctcaccaacatggtgaaacctcgtctctattaaaaatacaaaaattagccgggcgttggtggcgggcgcctgtaatcccagctactcgggaggctgaggtaggagaattgcttgaaactggaaggcggaggttgcagtgagctgagattgtgccactgcactccagcctgggcaacaagagtgaaactccatctcagaaaaaaaaagtgtatacacacaccaacacacacatacatgcacactctagaacctatctcatctatcaccacaaagagtagaatataactattcttccagagaaaataaaacatttagcacacttttatagtttttcttcttccctcttccttctcactttcagatttagttgaaataatgtgaacttttagttccagattactaccaaattgttaatttttttttcttttgtaaacatcctttctgaacaggtattaagcttcatggtcatattacaacgcacttgttagccataccttatactttaattggtttcattgctcatgataagttttcctatagcttttcttctcctttcttgaattatttaaggtgattaattttccatttggcaggaatactccatcaagtaattaaaaaaattattccagagtttactttctgagaccttaagtgtctttacttgtatgtccttcttttgctgtcacatgtgagggaaagttgagctaggtgtaaaattctgaggtcataatcacagtgctttcacctcagaatatataaaccttgcttcataaatttctagtctctggtgttgtagatgagaagtccactaatggtctattttttctctgtgagtaatctgtttttgtttgttaaggatctttatttatttttatttattttactttttagagatggggtctcactctgtcacccaggttggaatgcagtggtgcaatcagagttcactgcagcctcaaactcctgggctcaagcaatcctcccaccttgacctcccaagtagccaggactacaggcacctgccaccgtgcctggctaataaatatagttggatggttttcatttgtttatttgtttgtttagagataaggtcttgctctgttgcccaggctggtgtgcagtggtgtgatcatagctcactgtaacctcgaactcctagactcaagaggtctgctagccttagtctctgagtagctaggactataggtgcctgccaccatgcctggctaatttttaaaattttatgtagagatagggtctcactatattgcccaggctggtctaaactcctggcttcaagtgatcctcctgccttagccgcccaaagcactgggattacaggcttgagcccatgcccagcctgctaaagatctttatataattttttcttttttcaataatcttctatcgccattgttgatctgaaaaactcaagtctttcttcagcttttcatctcagggaaattgtattctgctttttaattttttttttttttttgagatagagtattgctcttggaatatagtggcatgatcttggctcattgcaacctttgcctcccaggctcaagcagttctcatgcctcagcctcccaagtagctggaactacaggaatgcgccactacacctggctaatttttgcattttctttttagtagacacaaggttttgccatattggccaggctggtcttgaattcctggcctcaagtgatctgcccgccttggcctcccaaagtgctgggattataggcgtgagccactgtgcctggccatactttttaatatactgatagcccttcatttgtttattttattttttatttttattttttgagacagggtctcactctcacccaggctggagtgcaatggcacgatctcggctcactgcaacctccacctcctgggttcaagtgattttcctgcctcagcctcccgagtagctgggactacaggtgcgcaccaccatgcccagctaatttttgtattattagtagagacggcgtttcaccatattggccaggctggtctcgaactcctgacctcgtgatccacccgcctcagcctcccaaagtgctgggattacaggtgtgagccactgcacccggcccatttgtttatttttaaaatttttactactgttgttatatggatattggaactccaagaacatattttacatcttttaaattttttccccattaattctgttgctttgctttttttccccgagattctcagagagctcctcgaattgtttttctaactcgccagctcatcttttcgccgctgactccattcttctatctgctacccctgtagagttgttgtgggtttttttccccccagcaatcttttttttttttaattgccaaaagagcttaatgctctcaggatgctttttcttggcagcctgctcttgttttctcattgtagtgtgttcttaagtctccctgaaaaacacagttggcatttacagaggtgtatgtttcctacacgatccccttttcaatgggtacttgctcagtttggctgctgattctcttcataggtcctgcggtctgtgctatctgctcccatgtaaaagttgacatctagattgttcagtgtttgtagctagcgtgggctggcagcaattgtgtaaagcacaatttataccccacattcaatccctgcagtggaacagggccgctccccacgagccccagatggtgtcagcttgtaagtagtcccacctctgctgtgggggtcagaggtggatttctctccattagggatagaaaaaaaccttttgtctgtacccattttagatgtccagctaggtccctgtaaattagactaacaagatatagattaacacgagaaaagcaggctgggtgctgcggctcacacctgtaggcccagcgctttgggaggctgaggtgggtggatcacctgaggtcaggagttcgagaccagcctggccaacatggtgaaaccccatctctaccaaaaatataaaaattcgccaggcatggtgtcacacacctgtaatcccagctactcaggaggctgaggcaggagaattgcatgaaccctggaggtggaggctgcagtgagctgagatcacaccactgcactccagcctgggcgacagagcgagactccgtctcaaaaaaaaaaaaaaaaaaaaaaagaaagaaaaacaggagctttttagcatgtgcatctagcatgggtatcacatctagcatgggaattgtgcatatacctgggagtatccagagatgagtaactcaaagcgttggttagaacttcagcttacatagcatcttaatgaaagagaaagaaatgtttagagaagtggcagggtaaaagaaaggggttttaggcttgcaaaggtggcaaactgttggaagttgtgtttctgttttgcattgctagaaggaatacctgaggctgggtaatttgtaaagaaaagaggtttatttggctcatgttctgcatgctgtacaatcatggcaccagaaacctgcttggcctcaggtgaggctgcaggtaggttttactcatggcggaaggtgaagggggaacaggcgtgtcgcatggcaagaggggagcaagagagagagaaggaggaagcaagagaaggagatgccaggcgcctttaaataaccagctctcccttgaactaccaaagagaggatttactctttaccacgggatggccccaagccattcataaggcatccaccctcatgacccaaacacctcccactagaccccaccttcaacattggaggtcacacttcaacatgagatttggtaaatatatgggaactctaatggagtaaggtttgtttgtgcgggcctacttggtgccagctttccatcttcgtggctgtaaaacttccctgagagaggagatttatggtagttcttgtttctcagaagtttctgttttttgtcataagagcaaagagcgtaagagtcaaaagagtttctgtttttagtcatgagagaagctcttagaaggctcctttctgcgtctgttggttttcatttgcctgcagctcaaaacaatcatatgccaaagtggcatattttggagtggcatatttttatcccttatgtcaggtacaatgggcagggaaggttcagccagcaagagggcaggattcctgttccttgagcacggtgcatggccttaacaaacctgaaaaatcatgtgctcccactcccatttcacattgtttcacaatttaccagtggttactggacaaactcaacttattttttctgcacaaaacttcagtgccataaataagagctcacaactttcctctggtcacaagtcagttagcagccacctcgctctttgaccctgggctgatttagagctcacactggggagcagccccagaggtggctttaaacctgggactcggggtgtctgccctggggtggctgccctggggtggctgccctggggccattggtatttgctccacatgcctgtggagtccattttttcatgttcatgtcacacctactgtgttgcatgttctttactagggggtggggtagaaatatgaatggacatagcccctccttgagatcacagcctggtaaacagatcagccattaacaattgaggcggcagggttccgtgcagaaggctgcatgactttgctgtctattgtgactgcgttttgatagttacctttgtcacactgtcttctgtattatgtttgccctcagcaacatgtcgtatctggcacagggctgacatcctgtttgtgctcagtcatttgtggaaggaagaagtcaggcaggcacaaaggtggctgagctcagaaaaggccacttaccctgctgggatcagctggggaaggtggcttccaagaggccatcacacttagtgtgatgtataaggaaatagaaaggccacagacaggagggactgcacgtgcaaggaaggggcactagtgagtttgcagcatctcaggaactgcaatagaaggttgatgtgagggcaggcactagaagggtgagttggggtcagatgtggcaggcttggaaggagtcaggactctatgctacaatttccagaacactcagtgttctcagctttctcctttgtcatgccttcataccacctaatcttctcaccagtgactatcctctggaagacaatgggaatgggaccctgtggagggctctgttgaaaacccattgatggggccgggcgtggtggctcacgcctgtaatcccagcactttgggaggctgaggtgggcagatcacgaggtcaggagattgagaccatcctggctaacatggtgaaaccccgtctctactaaaaatacaaaaaaattagccgggcgtggtggcgggtgcctgtagtcccagctacttaggaggctgaggcgggagaatggcgtgaacccaggaggcggagcttgcagtgagccaagattgcgccgatgcactccagcctgggtgacagagcgagactgtgtctcaaaaaaaaaaaaaaaaaggaaaacccattgatgggcattgaggagtggtgggatgatcagagcctctctctgcactctggtactttgacaagagtgggcaagtttgggaacagggatatcagtatttctttggctgcatacttatttatatttcaccccattccacggagaatttgaggggatttatcaccagatgtgggatacttatccaatagaaactgaagcaaagaatctggacaagggaaagggagcctcatgagtacactaggtcttaggtccaggtgggggtgaggcctgcaagaatgcagagatggaggggtgtggagacggctgtggtcccacactgccagcacttgcctgaccagacattctcaggagtgcttccacccaagcatggtgtgggtctagggctgcaggtggagctaagtcctgtctgcgtctgggtgtcagatcctaaaatttgctggatggagttggggaattaatccagctgaaagagcttgaaatatcattgaatggaggaaacaaaaggcctattaatcaagtttaagaggtgtgattgaaggattggcacctatccctgcttggtgctctcttggtgccctctgtgaagttagcagtaaattgcattttattggggattgatattattgggattgcttcctggcctgcaaggagcattacatgggcagaagaaaggctgctgccaggagttgggcaacatgatgaaagatgtggacaataaatgacccatttcctagtttttctatgaacttatcttgaaggtagatttatagaataatatgtggataaaaggggttttcctcctggtctcctttgatgttttggagaaagaagcaaggactttatttatttatttgtttatttttgagacagtgtcttgatctgacacccaggctggagtgcagtggcacagtcatggcttgcggcagcctcaacctcccaggttcaagtgatcctcctaccttagccttcctagtttgtagagacgagttttcaccatgttgcccaggttggtctcgaactcctgggctccacccacctcggcttctcaaagtgctgtgattacaggcttgagccaccacgcccagccagaagcagggaatttaaagcagcgcaagccaagatcaggattagggctggtgctccggtctcacttctcctgaaggccaatcgcctctactttctgcagctatgggagtgggctttgctattcagggatggaggcctgggacattttagaacaatttgggttttttagttttgtttttttgagacagggacttgctctgtcacccaggctggagtgcagtgtgcaattatagcttactgaagccttgacctcccaggcccaagttatcctcccacctcagacccccaagtataatagctgggactacagacatgcaccaccatgcccagctaatttttttttttttttttttgtagagatgggctttcattatgttccctaggctggtctcaaactactgagctcaggcaatccacctgcctgggcctcccaaagtgctgggattacaggcgtgaaccactgtgcccagcctttagaacaatttttaacaagacttgaaattaacaagcttttggcatagtggtgcacgcctgtagtcccagctactagggagactgaggtgggaggatcacttgagcctcagaggttgaggctgcagtaagccataatcatgccattgcactccagcctgggcaacagagcgaggccttgtctctaaaaaaaaaaaaaagaaagaaattaacaagcttttctcattgattgctaactgataaaattaaaaactattaatagaaccaccgccagccagccagacagccattgagcaatcacttattgagcatttatttcatgactggtgttatgatagctattgccagatgaaaaagaatgcctgccttcgaagcttgaatttgtggagagtttcagcctatggataagttgcatgtgtgtgcagacttgtactctatggcaagaacccagaggtcccagaagatacgttcagatcaagtgctgtggcagttttcagaagggaaaacttgtatttatgtgggagggtcagggaaaccctgatattttagcatttgggctacaccttgaagggtttatttgtctctataagttgcatctaaaacaaactgtataaattagtgagtttttttagttagtagcttaagcaaaagctggattgatggctgatgtaagtgaataggggtcaagctggcctctgacctgaccaattagatattcagattgtgtcaccaggaggtactttctctgtatttcttgtgacctggctttcttccaagactggtccattcacagaagggtttactcctcatgggtgccagatgattgcaacagctccagaggttacaccctcagccccaaattcaaggggaaaagagtgtgaatctctcccagcattccaagctaaatctcagtgtgtctttgattgggtcaggttcctctccctgcaagggtggctcaggctaggggggttctcagattagcgtaagcctgagtcatatgctcccccaaagctcatggactgagaacaggaatgtgtggctacctaaaggcaaagtccagtttcatattggtacaagaagaaagaagaatgtgcctttaatacatcttagaaaaaatgtccaatagccaccgtaaatgaaagcaaagaagaaaaaaacactccaggtatatggaaggcagtggaacagaaactgaagtgcaggggacaggtttgaagccagcctcaagtgaaacaccctgaccccttggtgcctgggtaaactcttttcaatagaaagccatccttttccaaccaggttagggaatgggctgttcaggctgcatgcaacctttcctgttgacaaagtggagaactatcctgccatttgagatgtttttcctgtgctattctcctaactcccacaccctcctgtaagattatcaggaagagagaactgttccctttgtacaaacaaggcgagaggccagagagttaacaggagcttcccaaaagggagagcttgccagagccggggccagaacaggatgcagggtttcctgattgcagaatgggtgcccctttcctactcctgctggactctacattcaggcagcccacagctaatgactgcactgagttgcaaaaagaattctaaaagttgtttcttaagaatttagagtgtatcttaagtaagcatgcaatttaagcaatgttgaacttaattttcccttttacagaagataaagaaactaaagtgaaattagacttgctgaacttcaaagaaataattcttcatcttaaaatattttcctaaaaggtccctctaagattaagaaaaaaaaccccaagacattaagaggttggagccattttgttttttgaaacagagtctcgctctgttgcccaggctggagtgcaatggcgcaatcttggctcactgcaacctccgcctcccgggttcaagcaattctcctgcctcagcatcccgagtagctgggattacaagtgcctgccaccactcctggctaatttttgtgtttttagtagagacagggtttcaccatcttggccaggctggtcttgaactcctgacctcgtgatccacccaccttggcctcccaaagtgctgggattacaggcgtgagccaccgtgcctggccatttttttgtatttttagtagagatggggtttcgccatgttggccaggctggtctcgaactcctgatttcaggtaatccacccacctgggcctcccaaagtgcttggattacaggcagaagccaccatgcccagccccatatcgtttgtttttaatgaaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaataagcaacttttttttccaggaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgtatcaaattattctggaacctagcatgctccttcaatctaaaaattatctttatttcaattgcttaaattacttctcctccatcttccttttcttccttctcattttcttctttttcttgctctattactaataatatcacaatttgtaatttattaactttaggtgtgttcagtttattaatataatagtactactaccatttagggtgggggaacttatttacttaatgacttaatgaatgagtaacaaagattagaaccaccatatacattcacttgatacatatttttataaaagtgcttgagaatatcagaattatttatgtcacacaaggagttactgcctgttttctgtgtcaccagattctattaacatttaatgattacctttactctttgaattttgaattttgtaacaaattcctgctgtggcatattttgcaatttggttatgttctgccaaagctgtaacagtaggtgaggtgtttcaaatttggcatgactgaatagaagagctgcccgttctcaccatatgttactcaactcatatattgctatgttatttttaccttactcatcaaattatcttttctcttatacatggctttaattaattgattattttaggtatttccatctctggacatttcatgtactgaaaatagatcagatttaaataaaatagctttataatcagtatttatgtgataaactctgtcttatttcttgcaacatttaccggcatgtaaatccaaattgaatattggttaatgttcagcaatattcaatactatataattgtagtgtattgttatgaaagtcaatgaatttccccccatgatgtactttgttccaaaatttgaatctcctttaataacatataacacataagttgcttaaaaaatttctcactgctgacactatttggattgtacttatgacaggcatactggccatcacctcagcatatgaggataaccatattttagaaataccatgctggtggcactggggagagctgattggagctggagagaccagaggcagggaggcctcttaggacatcgtgctcaaggagataagcaataattgaggcaagaacagaggcagtagcagtgggaactgctgggacaggtttaggagccagcattctgccttaatcatctttacacccttgccgcatgcctagacctagttggtacttagtaattttgggggggtttttttgagatagagtctcgctctgcctcccaggcaggagcgcagtggcgtgatctcagctcactgcaacctctgcctcctgggttcaagtgattctcttaccctcagcctcccaagtagctgggattacaggtgcccgccaccacactcagctaatttttgtatttttattagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgcgcccggccgggcagtggcatctattgattgtatggtttctttcatttcttcagtaattatagtgtctttactatggtgagagtaaatagtccactgtgttttctccttcgagatgtaattttacacatttaactttgtgattcattggaagcatatatgggtatgaaacaagaagcaaggctctaacttcattcctgccccctaccctcctccctagccaatttctctgattccaattgttgaaaacccctttaatgtccatcagtttgggctgctggctgggcgcagtggctcacgtctgtgatcccagcactttgggaggcaggggctggcggatcacctgaggtcaggagatcgagaccagcctggccggcatggtgaaaccctgtctctactgaaaatacaaaagaattagccaggtgtggtggcgtacacctgtagttccggctgcttgggaggctgaggcaggagaatcgcttgaacccaggaggtggaggttgcaatgagttgagatcacgccactgcactccagcttgggtgacacagtgagactctctcaaaaagaaaaaagagaaaaagatgggttgctttctttgttatataaaatattacatttctatagatgccagggactacatcaggcctatctggtctgttctactgatccttctcttgactcttgaactagtaccatattctcttaataatggcatttctataatgtgttatcccttccttacactgattcctcaaacatttcttagcagctggtcatagtggcttaggcctgaaatcgcagcacttttggggccaaggtggaaggatgacttgagcccaggagtttgagaccagcctgggcaaaatgttgagactctgtctctataaaattaaaaatttttttcttagctattttatctgtttgttccttcatatgaaatttagaaacctagccaggcgtggtggctcacgcctgtaatcccagcacttctgggaggctgaggcgggtggatcacctgagatcaggagttcgagaccagcctggccaacatggtgaaaccccagctctactaaaaatacaaaaaaaattagccaggcatggtggctcacacctgtagtcccagctacttgggaggctgaggcacaagaatcacttgaaccagggaggcagagattgcagtgagccaagattgtgccactgcactccagcctgggcaacagagtgagactcagtctcaaaaaaaaaaaaaaaagaaaagaaaaagaaagaaaagaaatttagaatactttggttaagtttcaaaaataatttaaattgccttaaacctgtttattaactcaaggagaattaataatcttataatatttagtcttatctcttagtaggtttttgtcattttctaggtattttgtaccttcttttttttaatttaaaaaaagttttttagagatggagttcttgctgagttgcccaggctggcctggaactcctgggtgtaggcaatcctctcaccacagcctccctagtagctgggactataggcacacaatcatggctttgtagaattttttaaatagctgctgtgaatgggaagatggatttttttcccatatttcttctcatttgctttgctaagatagaattatgctatttttctttcttaattattatgtaatctagccactttggtgagcaatttcttattaagttagtggtgtttttgcttattgttttgagtattccagaagcaaatagatgttatttcgcctttctgaagatacggttaagtctgggttcttgtcacggagcccttctgggcagtttcccacttcacctctgcctcctccaaagtgccaggcacgcagcaggtactcagtgagtgtcctctgaatgaaggtaaaggaaccgcttggctaaggtcattcctggccctgggtggcagccctttgattcaggatctgcacctcagtcttaccagagggctgggggcttttagacccaggtgtctgattcaggctagccacctcacagacacttgccgcccatctccatctggagggaaagcaggggccagtcaccctagggagaccccattcaggacaaaagaagcttagaaaaaggacccagcggaggctatggccatccagaacgtcttgctctctatccagccaggctgcctgaggcgtgcccttccaggcttggaaccctgtctccaaggaaggggatccaacatcagacacagcccctctccccaagtgtccaggatccaaagggggaaaataacaactgtttcttattctcttccctttattcctataccctatagaattgcccacatttattagtattctgttttttaatttcaaaaaaaggaatacattcatacattcacaaggctcaaacataatctaaaaaggtatgcagtgaatgtcttactctaccctcattccacccatcccatagccacttttattaatttgcatgtccttttaatatttatttattcaaatacaatcaactatgaagatattcttatttttccccattcttacacaaaaggtagcatctgatacacacatttctgcaccttgatttctaacttaaaatatatatcataataatacaaatagttagcatttattgaacactcattgtatgccagtcatttttcaaacttttatccatatattaactcatttaatccttccagtactcctattattaacctcatttctccatggagaattttccttatcagtatataaagagcttcctcaatggcttacagctacatagtattccgttgtatgggtggatcataatttatgtaactaattgccttgtgagggacacgtgggtggcttctaattctttgctattgtggactgtgctgcagtgaatatattgtatggatatcatcttgttatgtgtagagatagagctgcagagcagatccaaagaaagaggattgctgggttaaatgcatttgtaattctgatgggtattgccaaattgccttctgtagagttattagttcttttcataattgcttagtatttctaattaaacgtagcattgatgagcactatgtatcagtctggctggctagtaggctctctgttggtggttccagaacaagttgatctcagtgtagtcccagatgagaccctttcttctggcctcaggtgggctgacttattccttttttttttttttttttttgagatggagtcttgctctgttggccaggctggagtacagtggtgcaattttggcttactgtaacctccacctcctgggttcaagcagttctcccacctcagcctcccaagtagctgggattacaggcgcacaccaccaagacttactcttatcactgccggtgagagtaaattacagcaatatttctggggaactaacagtattttccctggtaatatttgaagaagcagccttgtaatggttaagaacatggactctaagctggactgcctgggtttttatattttctttcgctgctgtaacaaattaccacaaatttaggggcttaaaacaatgtaaatgtattctgttatggttctggaggtaagaagtctgaaacaggtctcactgaggtatataaaggtgtcagcaggctttgctcctttgggaggctctcagggagaacgttttcttgcctttcccagcttctagaggctgcccacattccttggtgcatggcccctttctgtcttcaaagccggcaacatcacaacattcccacctctgcattcatcacatcacatctcctctcattctcctgcctccctgccctttcctttgaaaggattcacgtgattacgttgaacccacccagataatctagaataatctctttatctcaaagtccttaattgaataacacctgcaaagacccttttgccatagtaaggtgacatattcacaggtctcaggaatttgcacgtggacatctttagaggccactattctgctactacagtttgcatctagactctaccacttactaatcgtgtgatcttgaacaaattattttgcctcttgcaccagttttctcatccttaaaatggggataataatggtatctattccactggattgtcaggaggattgaatgagtaaatatttgccaatgcttataatagtatctgagacacaataaatgctatggaagtatctgctagctaaaatatattaaccaggccaggcacggtggctcacacctgtaatcccagcactttgggaggctggggcgggtggatcacctgaggtcgggagttcaagaccagcctgaccaacatggagaaacctcgtctctactaaaaatacaaaattagccggggtggtggcgcatgcttgtaatcccagctactcgggaggctgaggcaggagaattgcttgaacccgggaggcagaggttgcggtaagctgagatggtgccattgcactccagcctgggcaacaagagcgaaactccatctcaaaaaaaaaataaccaaataaaaatattaaaatacaaacactttgatctagcaggcctatatttataatctatttcataggaacaaaagcttccatgattaggctatataacttggatattactaaagtgttgtccatattggcaccaaaagaaaaaaaaaaggaaaggaaaacgaaagaaagaaaatgcacaaacaggaaattacctgaatgccagcaaaacgacagtgattgaatcaattgtggcccatctgggatataccagagctattaaagagaatacatctgatctgtgcctatgcacctagaggaatgctctgagtgaaagttcgttgagaggaggaagttcaaagtaattgtatgacttgatttatttctttcttttttttgagacggagttttgctcttgttgcccaggctggagtgcaatggcaccatctgggctcaccgcaacctccgcctcccgggttcaagcaattctcctgcctcagcctcctgagtagctgggattacaggcatgcggcaacacacccggctaattttgtatttttagtagagacggggtttctccatgttggtcaggcaggtcttgaactcccgacctcaggtgatcctcccgccccggcctcccaaagtgctgggattacaggcgtgagccaccgcgcccggccgatttctttctttctttttttttgaacaaacatcagcccccaaaattattgtagatatctaggtcaatcatttaacatgttctgtttcttcctctgggaaatatgtataacgacaattctcactcaaggggctcttgcaaaggttaagtggcatggctgacatgtgtcaagtctgtaccatcctgcaagcagcagcccagtctggcatttgtgtaaggcggtttcagtggagagatgtgtggaagggtgcaccccacgatgctcacctggtgcttcctcggtggggaagggaaattcagaagtggtggaaagagatgattgtcgtttcgtatatctttgtattgtttcccggatgttgaaattgttactgtagtaactttttatactcatgtgttattggtagtttggatactatcaccataaccacaaacactgaattaggaaaagcagaaacctagaaacatgccatgattcaaagtctggtatttttggaagaggaatttaataacgaacgttttaagaggaaaaagtcaggagagtcctaacccaggccaaccttgtgtgtccacagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaaggtaagcacgcacgccaccttcctgggcggcctgtgcctctgctgcaccctagggaaggcgagtcagaagagatcatctccatttgacagaaaagaaaactgggtgtttattcagtctttgggggttggtaaggtcttaggttccagggcacaggataagggggagatgaggccctgacaaagggctgcagccacccagaggggacacattttactaatttacaagactctgtggattgacctagcgatgactcatggggaacacgtgaaagttgaaaaactgcaaagctgagaatcagacccagtatcattttggcgccagagggaccaagcacttcaggaggttctcttaagccaccggtgtctcggaacagagaagtcaattgggacctggggttacggtagaagggggctaagaaaacctcctggggatggttggatgcttacccaaaaccatacagtggctcagtggaggagatcccttgtctgcaggatgacctgctgtctgccaacctttgcgcgccctgcctagtgttggacgcttgagagggaaggagacacagactagtttctgatctcaaggagccagagccacttcacgtagctggagaatgagacagtgctcagctctgcaatccaaatccgggagatgtagcagctgtgtattagctggaacaggggggctttcaaaataaggggtagggggagtgtgccagagagtctccaggagtctttgactaaatctccaagctggaatgtgagctctgagcagctagtataggatgcccttactgggaaaggggagggaggctatggaatctgaaggcacctgggtagggtgccagtgacaaagagcttatttacttctcctggagctggacatgggtcatgaaggataatcttagagggcctggacctgtgccttctccacctaggtagtgaatgtcacccatattaaggaaatgaccccacagagtttacacagcttgccttgggtgttataactgggcaatagcagagagaagggttattttattctgaagcataagagatttagatttaataaaaaccaggctgcagataaggaagatcatggagctctcactatatgtagagagtcagtgagccggtagtgatggctttatgattgcgcacacttagccttgctgttggctcagagatggagagaggtacacttggggtttggagccaaaagcaagcactctaatgccacctccttttcccttctggctgggttcctgcccactgcattcgagagagctctccttccagccgcccctccagggagttgtccagtgctttgggatgccctggaaaataggtatcctggaaaagcaacagggacctcctctctatcactgtcccaggtcaggatgtcccttaccagcatgtccttgacctgcctgtgaccttctttgtgttctacagatgcagctgtatccaagaaagccagcccagaggctgccagcactcccagggaccctattgacgttgacctggtgagatgggtttgaggtctgaaggggtggtggtggggcccagcaggtcaggcaggttgtgagtcctgctgtccctgtgtgtgcagggagagcgtctgagtgagggacagcaagtggctggactggaaatttcagtgagaggaagtaaaggaagacattaaagaagggttggctggctagctggctctgactctaggctcctaaatgccaaagttgctcttgatgggccatgagccaggttcagtgggggttagatgtggggtagacagtcggccacagatcagggctgctgcagagggaattccagcattagatggcatattagtgccttccagccatgagaaactatggttgtcagatgtatggttagatatagggtcagcagtcctgagggatgtgcagatgtcctctcccctcctacaccctacccccaatgtgtgagccttctcttggagtcagaataggtgggccttcccctgctctttccccacagatggttcttggaaaggaacggggaatggtgccaggagtcagatttcgatcccagttgcccgggttctgctggtgtgattccagggccaccatacatgtaacaaagcagagtgtctcagggttcaaggtatccatgtcccatctaatgctggcattccttctgcagcacccctgacctgtggctgtccagctttcatgtacacatctccagggacaggaagcttgctcattctagaggcagctgctcccaactctggactgctctgacttagaaagtgcttttccgagtggaaatgcagtggtgtccctttgacttgccccctttggcattcacaagtatggctcctttccaccagaataagcatcctcggtttcttcctggacttggcatctggtctcttccctagcctagtcactcaggtttgcatgcgcctagcctatcaaggatctggcccaggactggccagtccttcatggacagcaggtcttctggtggtgggtaggggcctagcttttgccatggcatgacccataggagagagagagtgctgtaggttgaggcaatcaggagaggcttcctggaagagacaggacttaagagtctcagagttttagagccaggcaagagcatggagtctaaccccctttttttcacagaggacgaagctaagacccagaaaggatgtgacttacccaaggctacacacagcaaattaggggcaagattaaaagctgactctgttttttgtttgtttgtttgtttgttttttaaatgaaggctcgctctgttgttcaggctggagtgtagtggcgtgatctcggctcactgcaccctccgcttccggggttcaagccattctcctgcctcagcctcccgagtagctgggactacaggcgcgcaccactacgcctggctaatttttgtattttttagtagagacggggtttcatcatattggccaggctggtcttgaactcctgacctcatgatctgcccgcctcggcctcccaaagtgctgggattacaggcgtgagccactgtgcccagcctaaaagctgactcttaactgccttgggtactgcattcctatatacacaacctcaagtaaaaagaggaattttttaatatatgtgtgcataatacaatcacatagtcagaaataaaaacatagaaagtgatcaatagtgtcttactcccactttagcccccagttcttatgcccatataactatcttttaaaaatttcttttgagacagtcttgctctgtcacccaggctggagtgcagtgacacaatctcggctcactgcaacttctgccccctgggttcaagcgattctcatgcctcagcctcctgagtagctgggattataggcacgcactaccacacccagctaattttttgcatttttaggagagatggggttttgctatgttagccaggatactctcaaactcctggcctcaagtgatctacccacctcagcctcccaaaagtgctgggattacaggcataagccaccgtgccccacctcttttttaaattcttatatatccttccagaatgtatgtaattacaagcaaatattattatagatatttgccttttgcattctgtgtttcacaaaggtaggataataccagatacacatggtatcataccagaattcttatcctatcaataggtagagagcttcccgatacctttttgcagctgcataatggaccattaaatggatatggcaggctttatttagccagttccttgttgctgcatatttaggttgttttgctattacaaacaatgctacaatggatgatgtttgcaaataaataatataaaataataaggccaggtgtggtggctcacacctgcaaacccaggaccttgggacactgacgtgggcagattgcttgagcccaggaatttgagaccagcctcggcaacatggtgagaccctgtttctacaaaaagtgtaaaaatcagccaggtgtggtggcacatgcctataatcccaggtactcagcaggctaaggtgggaggatcacctgagcccagggagtttgaggttgcagtgagctgtgatcacaccactgcattgtagcgtgagtgacagagtgagaccctgtctcaaaaagcaaataaacaaataaaatcaaaataataatagggaaatgcccttggtccacagactcagctgtcttccaggtgctagtcattggtgaatgaacaacaagagagcctgcactgtcttgtgtgaaggtctaggtattttgggtctttgtcttgataaaatcagaatagacgtggcctctcactatcagctaggaagcagtttgaacttggagtatcagagggttgctctttttgccaagcctctggcttcagtccttgcctggggatggcagtgctgctgagggaaggaagtggggaacactgtgagtgcaaggacaggtgaggcaggcacagacggctgtcccaagggaaagtgctccatcagctgtgccaggagagaagcagctcttgggtccgtgtttctgccttagaaggcaggagttgggcatctagctccagcactcatccctcttgaaactgctggtttgtttactttcattgcaactatatgcctggaagagatgaagagaaagctcaacaggcttcactaggattgtttgggtggggtggcagcagctcagatattttccctcctctgtttctcataggctttttgtaatcgtgttataatactttaatggaaaaaaataaatttattattttaaagctataaaaattataaatcagtcattatgatgtgtttttctctactgagccctctggtgtgttccctgttttattaacgtggatggagggtgtgtcagggaggttgggacagaggcagagaagaggccagcccggccttcagggagttcgtggcctgtctggaaagagggtcttttacataccagcagtttgcagagccagacacagaacgatagagcaggaccttttaaactcctttttcaaaaaaaaaaaaaaatgtttaattttggtaaaatacacataatataaaatccatcatcttaaccatttcaaaatgttcagttcagtgtacactaagtgtacaggtctttagcattgagtacattcacactgctgtgcagccattaccaccacccgttccagaaggattttcatcttcccaagctggaactctgttcctgttaaacagtcactccccatgctgcctccctcagccctggtgacccttgtctactttctgtctctatgattttcaatactctaggtacctcctataagtggaatcacacagtatttgtccttttgtgactggccactttcacttagtgcagtgttctcagggttcatccatgtagcatgtgtcagaatttcctttctttttaaagctgaataataatatcccattatgtgtatatgccacattttgttgatccattcgtctgttggacacttggcttgtttccattttttggctattgtgaatctgctactatgaacacgggtgtacagatatctccttgagaccttgctttcaattattttgcatgtttactcagaagtgggatcgctggatcatatggtaattctatttttaattttttttttgaggaatcaccatgctgttttccattttttattgcaccatttgacatttccaccagcaccgtgtaaaagtttccacttctctacagcctcaccaacatttgttatattgtctctctctctttttttcttaaataatagtcattctaatgtgtgtgaggtgggttaaactcttttttgaccactatcctctattgaaaaaaaatatatattatatcttaacttatagtatatacatatgcacacacatactgtagctaaaggagttttataaaataggctgggtccagtggctcacgcctgtaatcctagcactttgggaggcggaggcaagtggatcacctgaggtcaggagttcaagaccagcctgaccaacatgatgaaacctcgtctcttctaaaaatacaaacattagccgggcgtgatggcaggcacctgtaatcccagctactcaggaggctgaggcaggagaatcacttgaacctgggaggcagaggttgcagtgagccaagattatgccactatactccaggccgggagcaacaagagcaagactctgcctcaaaaaaaaagaaagaaagaaaaaagttttacagaataaattatgattgttacatgggatgtactctgataatttctattctatactattatttttgacataaaaatgttggtcatgccccactaaattgctttcatggttggatccactaatgggtcacaagctgcagtttgaaaaccactggccttaagagtgactagactttcctagaggcctggcagagacagatgcctgggagataatctgttctctctccttcccaagacaggctcacactctctaataccagagaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccgaggtatgtgaccttgggaaatcacttcacctctctctgcctccgtttccttctctgaagattggcaataatcatagtacggtacctactttttttttaactataatttttatgggcggataaaattcatataaaattcaccattttaacttttgaagtgtgcaatttagtggtatttattacattcataatattttttaaattttttaattttttttctttgcagctccagctcaaatgattaaatttttttctttttaattttcagagatgaggtcttgctatgttgcctaggtgggaggctcaggtgattctcccacctcagcctcctgtactttcataatcttgcacagccattgccacctatctagccccagaatatttttatgcccccaaaaggaaaccccttacccatgaagcagtcagtcccatttccccctcccccatctcctggcaaccaccaatctgctttctgtgtctatggatttatccattctgggcattgcatgtaaataggatcatacaatgtgtattttgtgtctggtttctttttttaaaaaaatttattattattattagtgtttgagacagagtctcactctgtgccccaggctggagtgcagtgacacaatctcggctcactgcaatgtctgcctcagggctcaagcgattctcatgcctcagcctcccaagtagctgggactacaggtgtgcaccaccacgtctggctggtgtctttcatttaatgtaatacattcaaggctcatccatgttgtacatctcagtcctcattgctttttatggctgaataatattccatcacgtggctataccacattttgtttattcagtcatcagttgatgcacatttagtttgttttaccttttggctattgtgagtagtgctgctctgaacattcacgtgcaagcttttgtttaaccgtctgttttcccttcttttgggtgcacacctggggtagaattgctaggtcatatggtaattctacatttaattttttaagaaactgcctctatttcattttgagataggtacatgaagcacttagcactgtgcctggcacagagtagtaataagaacaatatttatcatcatcaatgacattttctaagtgccaggtattttatattttacttgtattaacacatttcatccacattaccatatgaggtagatgttattattcccactttatagagggggactgaggcctgaggagttttaagcaattcatccaacttgtgtagtagctgacccaggtagagttaaggctgagagggcagaggcaaggtcccagggaggccagtttcagctcaatgggaggattttctcactgttaaaggagctgctttcgccagtagtgagcactttgtccctggaggtgtgtgtctaagtagggctaattactgagcatgtcctgagttgggcagtgtgattcctggggtatcttccagccctgttaggacacacaacaaccaaagtggtccctgggctccagtaactcagagtcagaaggaggtgatgccagtcgcggtggctcgtgcctgtaatcccagcactctgggagactgaaacaggagaattgctcaagcccaggagttcaagaccagcgtgggcaacatagtgagaccctgtctctacaaaaaaatttttttaaaaaaaggaggtgatgtgatggagagtttggaggacttcttgtccccagtgagctcggagctttgagtcagggagcctggacctgtgacttggtgaggccccagggattaggccaaccacaggtctggggtacctggccctggggctgctgcctagtcatttctgactcaattttcccaactttgcagcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggtaaggttctccccagccccagccttccctcctgaaggcctgagttccaccaggaaagtgagctggcactggggtgggaatccaggccttcatcagatcagctctttgtgggaaagtgtttgctcgacgccttctctgtgctctcccctgttcttggctgcatggtcagggagcttcccataagcatggcccactcccagcccagcaggggtgctgagacactcagggttgtcagaggccagcagagactggtggacagcagatagtaccagcttgggaaggcttcctgtctgaagagagacgtaatctgcgtggttgagagcagaggagaggggacagcaggagcaaaagggtggccacaagtccctggcagtcagggcaggctctgcccactcacccctgcaggcacctgacctggctctgtgactccctctatgcaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggaggtgggtagggcagtggcctgggtgctgcccgccagggtctgggcggtgcccctcttctgtattttggccccatccagaaagcccaaagccaacaggagtcccttattcccactgaataagatagggaaagttcacagtgtgcgtgggggtgagagtggacacagtttaccatgtgttttgccatgattgaggtgtggggagcctgacaggctaaaatgcacagttctatgagtcctttctcccaaacactactgtgcctttgcacagggcaggtctccacaagaagtttgttggctgatgcctagcatactcccagagagggcttgggcataccataacaggaaactggactccccatgaccttaactctgctctctcagtctacacccatcatttccccaagtgtttctgcaaaggccacctacctaagtatctcatttgtcagagttatcttctatgaacactgccaggcaggtagtcagttgggcaggagttgaggtcaacccagaggaatctggaacaagagagttctaaggatctgcttcacccagagtacagctttgttcctcattctgactgagccctagccttggtcacacactgagcactgactgatattccttacccacaaatgctattggtaatcgatgggttttgattaactaaatgaagcgtcttttaactctagacatcccagctcatggagctgagaatggggacagtgtgcttctttaggattgcagaaggttccagaccaggtagcagttgtcaggcctcctgtacagggggcaaactctgaattctgggcagataacttaattgaatattcatagataaggcacagcaagaaattatggaaacccatttgtgaattactcaaatccaaatgcaaagcagagtcacattggcacacacagtggctgttcccgtccccctgcagggcatccatttcccccagccgactggcctgcaaggattcccataggtgcacacccacacccctcccagcatgcatcctaggcagttcataatgcatctccccttccccgtttcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtgttctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcactgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcacctcgccatcaccgagcactgtcagtccctcagccggtcctctcagactctgaccgcagcctcctgttccttgagctctcagtcctaccttcgcctccctccagccccgcgcactccccatttcatcccatctttcatcagaattgcagctccctgcccagcagaaaatcctggaaggactcaggagcttgtcgcctctgtgctgccacctggagaccgagatctgcaggagaaaggcctgggaaaactatgagtggttgcctgtgactgctaagggctccttggtgctccgcccagcatgtccttttgctctgcagggcagcccccgcctgcctttcttcactgggcccttgtcccagcctcaccctcagctgatggcggcaccttctgctccagggagaaaacaggagctctccaatggcatagggacagttgacatcttgctatttacagatccccatcgcaccccttccctgccctcgttagggtggaagggatgtccacctgcctccaggactcaccctgtgtcctggccccagcccttgaccccctgggagcctcactcctcctcctcatctctcttgcatcttctaatgtatccactgccttctgaactaaacaccctgaatgaggtctttctcatctcagaaaactccacccacttctctctccagctgtcggctccccttcctctgctctccttgtttacacttcagccccctccttgccccttcttcaccccacctcctgcgcttccccgccagtaccagggtggcctctgtgcctctaggtgcagtgtcgcgtttagtcgttattattcttgaccggcgctgggcccggtctttcctggaaagatcgcctgctcggatgcagctctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccataggtacctcaaactcagcaccttctcctcccgtctcactggctcgccccactctctgcccggttgcacaagccaagaccccatagccacccagggcaccccccttttgattattcctcacatccaaccagttattgagtcttgtctttctagggtgtaaattcctctgaaatctgggcacttctttccatcccataatcttggtaaaattaaagctaccactgaccctgggtagaggcagaagcctgggaaggaaaggtggagaacaggtttggagtgccaacagtgtccccagatgtcatggagaatcaagtagagggaccccagcaatattgggggtggggcggggagtatgtaatgctcagctatcagcaaggagtcattaggggctatacagtgaattaagggagggggtaaaagcacatttcaggtgatgatgaattaaatacctaggagctcacattagagagcaggcctagagacgtggggagagagccagaggaccgctgcttttgtgtatgtagctttaagacacaggttttaaaaattgttataggagtcccaaactttagaaaatatatattttaaaaccccaacaaattaggtcccccctatgcatttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagccttgcagtgaggaaagttgcagaatactggtctgctacattactactttccaagtgtatcagggcatttaggaacccctcccttgagcttcacctgtgtcctagggattcagtgagagactgtttgtgtaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgttctcacccactcttgtgacagattactggctccggtgccttggtggcagcagcaacaggagggggccaaggtgagggggcagcctgtggcagaagtggcagtggtgacggcggaggaagggaggcctgtggggaatggctgatccaggggaggggccgtggcactggtgagtgtgcatctgagaaaatgaaacggaggtgctggccaagaggctggagctaggcagaagggcagcagaggccacaggctggccgagtttatggtccagttcactcctaacatgtgcagtattcctggggtctttgaggctttgcaagagctggggttttgtgtctgcagaaagatagcaatgcatgtgtcttgccaaactgatcccagctgtagctgatgcttaagtgctcagaaagttcttcaggagcttgagggctcttgataagcatgaatgtcagatgttctgtatcttccagaggctggatgctgactatcagagtttggcttgtgtttggctgatgagcaaacctggaatgaatcagtgataaggacaattgttctcaagctggctgtacactggggagttttcccaactacagattcctaggtcctacgccctgagattctaatcgagtcagtcttgggtgcagcctgggcctcagttttttcttaaagctatgaatgcctaaccaaagtcaagaaccactgaatcgggggattcattgcatgtctgtggtagaggaatgctgctcatttgtttatagatgtggcagtcttgaatgcaggtgacattttcataccagggtgtaataccgcagaggaggggagaggctggatcttccctgatgtacctcctggacttttggagtgtgattacaatgccaatccagccacttcctctgagcatgcttgggacgactgttagacctgctgtgttgagttagaatgcacttgacctgctcaggccgtgaaatctatgaggaaggggagtgagatggatgtagctcatgagccagattgcaggtgtatccaagttgcatgtatatcctgaaaaaatcctggctctcacgaggctcagcctgaacacagttttgcattcaaagaaacaatgtccattaaccaagtataataaagaaataaatcccagtatttacttgcatcttttgaaagaacattaaagggaatccagctcataaccccagcagcacttcttcagtccttcttccccttttctttggcgcctggcatctctcactgcatagcaaagctttcccccttgattcccggtcctcacacgcaggctcaaggctctgtttcccatcttctttcttctgtcccccttccttttctcttccaagcaaatctaagtcttttccagtgactgtccctctctatgctcccccgacacccagttatcctaatttgcggaataaggccaaggtgtggggcctgggggcagaatgggagagtctcccctagtgagcagggaggggagtatgttctgcaccaggccactatgtctgatggccctgctggcaaacctgagtctttcagaaagtcttgtttaaatgcgtcagcactccccagctgtgatgctggagtttaaggcggagcaggggagaattctgggtttacagctggctggagttccagtgagaccagctccatgggtggccatactttatggaagtccccaagggcaagaggaattttggaggaagtgagtcagggctgaaaggtccagcctctcctccattaacaagcttggtggaaagggggtgtccttttattaaaggagacagtagaggtttcttagagaaggcagctcgagtaagtttaggacaaaggacatttccctggccccgggacaatggaaggctctaaaaacgaggttctagtggctgccataaatgaccctgctgtaacgatgggaggggtggcctaaagagacagtactgtggctctccagggagctctcctcttggaagagcagatctgaaggcgggaagactggttctaaggccgaggacattgccccgagctttgtggaggcactcaggaacacaaaggggcatttccagttgggtttggagcaggaagaagaacgaaaaagagaaagtcctgtgtgccatgtcagtgggtggcagcatggactcagcctcagctattggcaccaaggatctgaaccagggaggacccagaaggggagcccagcccctccaccagcttgtgggagagcgctgctgcccagtgaagcctggagagaggaaacaactggattctcccaaagcgggagaaggtggagtctccagccacccagctacaagctaggaagacgccttgtagaaggctccttacagggaggaaaccgagttggaaaggcgagacagcagtgtgggctcacccggagcaagacgtgtgaaatcagcttttgacagcgtggctgaatgaggatctggagatgcgaggcgctgggcagactctctgactagatccctggatatgaagaggcaaagccagctctagatggattcatagtgagtgtctgcttctgacaataactggcagaaagctgatgagcctggagcagggctgtgaaatgcaaatccagtgaaatccagccactcctacaaaaacccaccacatcttaggttacttgtgggcggaaacgctttttctctcagttgaagcttggttggaagcagatgtttcacttgggcattggaagggtctggggaaatgtgctgcctcctaggccagggacattagccagaggccagaattaactgaggctttagcaccaggtgacaccaacttcattgagaagccagcggcagtccataaagaggaaaaacccaaggcctgccctggactctgtcccagccatgctcccaattggccctgtgatcctgtccatgtctcttccttgctggtctctggctaacgtccacaggtggcattcatgggaggttccaagttggtcatcaaagactaaacatctgggcttggcagctgagcagatgataagcaattaactctgtattaccatcagaggctccacctccctctgtagtcccagtcccttgggaaaatctcagagctggagcccttccctcatcctctggctccccaccccatggcttctcgaacagtgttcccaccaggaccttgggacaggagagaacgcctcacctgaaggactcccaaaactcaggtttctctaagctgctggggcagatgccaagagcctccactgctctctcactgccaaggacctgggtgtccacctagatgtggccttcaggaggccaagcagtccttcccctcgcctttgtgtaggacactggcacctcggctgacttcggggacaagaaaaggcaggctcccgaccccttccaaagaatcatctggggttcaagatgaggcttctttctcccgtcccaagttttggtgtttcttctgagtctgctcagaaagatgaaattaggagcagacatctcaggtcctgcctgccatagcagatggctccttccctgagcctccataagcagcacagcacactcatgcacacacccactggcattttctctcacactttcatacacttgtgtcaacgcaggttcacagctcacacttaactgtgcatgcacacacagatttagcacttggattcattcccacacatgcacgttcacaacctgtgtgtgtcacccttcctcccctactcatgagggtgtatgccctggttcatacatgtaaccctcacatgtgacacacccagttcacacccattcatgcacacataccttctcttgtgcacacgtcccctttcccagtggtacaccctccttcatgtgcacgcagatgctcccagctataccagcttgctagtgttctgcacaggtgcttgccttggccctctgaatccctgacgcttggtttttctgtgttgcagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctccacaagtgcacctctgaccagttcttctctcagacagagagcctggggaacacactcctagacagaaacacaatgcgtgagctcattgccgtgagccctgtcatccaagtaaggcctctggctgtgctacacgtttctgagtagagggccaatcccacaggtggctgcacagggctgcccacagatccaaggtcacagagggatcagaccccttatcctggaagcccctctacttcctccagtgcttgccctggctctgcaaatgcccctccttgagccagagccccaggccctaccctgtggcatggactcaacattggggctagcccagccagacagaaacagcaagtgttttcatggtacagaaaagtcatttgcagacctcagtgggaggctcttggccttgctctgagtggagtgctttctatgtcccagggctctgactgggctggggtccttgaggggattggaggaaggagcatgggatggagagctaagttcaagcagcctgggatctctagtataggtggctgaggctgatagaagacaggagggacctgtatccatggggtttggccaactctggggccggtagtggaggaggggagagctggatccccagctggtgaacaaagtgtttggagggcagccgagcctccccttctgactgctatcccatcacaaccaggatcagagctgcatttgggggctgatgtgtggctactgccagcagaccccaaggtgaggtctctagatggtgagtcagcagccctagaggaccccctgctcccaccccagagctctctgtgaccctgggtcctcaccctgcccttctctcctgcccagcccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccac

SEQ ID NO: 16642 - DNA, 50453 bp, Human
caggctgtccatggtgttggagggggtagggctataccttaggctgagctagtgaaatctgtccataagcccggacactgtacactgggagagactgggagagaggacacacagttggatccttggcgggggttggggggaagggggctgggctgcagactggaagggagtgggggctgtgcagctgcttgggggtgcaggtaggggactgggtggaacaggaactcacccagcgtgggtccacatagtaggtgtcataatgtggatgggaacacagggagaaggggctccaaagccagttccagagtgctggggcgtccgaggaaccggcccaaccgctccccgctgcagccggcttgtccctttctcggaactaccgagggagaggcgcgtgcggaggtcggcgttcggatctcgcatccgtcactgttgccggcgcatttcctcgaagtcttacctcgaagggctgggtcccacccgcgcgccctgtgcgtgtctccctgtttccccacgccctccttgcctggctgctgcgaggctttgcaggggaaagactggcgcggggttcgcaccctgcccatgtcacaggaaaaccgtgggagcctccccgacgcggcgcatttccggaagccccctctccaggagggttgcgggaaggccgggactctgcatccagacgaacccggtcgcctcccaagaggaaagtcggagacccagctgaggggcaaaaatgccagggaaaggcgagcccagagcttggtgatggagaaattgggaagccaccccccacccttcaatcttaggatggggaattcgcaactgaagccggagcttcagacttggggcgcactcccagcttagcccaggaaagagatttaagggcgcagcagtgtggatacctctcaccccggccccgaaggtctagcgagggtctaacctgggccccttgccaggcccgccccccgcccctttccagcccccggcccgtgcgccgctgcccctttaagaagcccaggtaggcaggcccggctgctggagccgctcctatggcaacccgcgagctgcggcggcttcatgaatattccggggcgcgggagcccgagcgctgccggagggcgcttcgggggaggcggccgctgatgtaagcccggcgggtcgctgggctccgctcggttgcggcgggagccccgggacgggccggacgggccggggcagaggaggcgaggcgagctcgcgggtggccagccacaaagcccgggcggcgagacagacggacagccagccctcccgcgggacgcacgcccgggacccgcgcgggccgtgcgctctgcactccggagcggttccctgagcgccgcggccgcagagcctctccggccggcgcccattgttccccgcgggggcggggcgcctggagccgggcggcgcgccgcgcccctgaacgccagagggagggagggaggcaagaagggagcgcggggtccccgcgcccagccgggcccgggaggaggtgtagcgcggcgagcccggggactcggagcgggactaggatcctccccgcggcgcgcagcctgcccaagcatgggcgcctgaggctgcccccacgccggcggcaaaggacgcgtccccacgggcggactgaccggcgggcggacctggagcccgtccgcggcgccgcgctcctgcccccggcccggtccgaccccggcccctggcgccatggacaagctgccgccgtccatgcgcaagcggctctacagcctcccgcagcaggtgggggccaaggcgtggatcatggacgaggaagaggacgccgaggaggagggggccgggggccgccaagaccccagccgcaggagcatccggctgcggccactgccctcgccctccccctcggcggccgcgggtggcacggagtcccggagctcggccctcggggcagcggacagcgaagggccggcccgcggcgcgggcaagtccagcacgaacggcgactgcaggcgcttccgcgggagcctggcctcgctgggcagccggggcggcggcagcggcggcacggggagcggcagcagtcacggacacctgcatgactccgcggaggagcggcggctcatcgccgagggcgacgcgtcccccggcgaggacaggacgcccccaggcctggcggccgagcccgagcgccccggcgcctcggcgcagcccgcagcctcgccgccgccgccccagcagccaccgcagccggcctccgcctcctgcgagcagccctcggtggacaccgctatcaaagtggagggaggcgcggctgccggcgaccagatcctcccggaggccgaggtgcgcctgggccaggccggcttcatgcagcgccagttcggggccatgctccaacccggggtcaacaaattctccctaaggatgttcggcagccagaaagccgtggagcgcgaacaggagagggtcaagtcggccggattttggattatccacccctacagtgacttcaggtaaggggccacagcgatgatcctgtgggtgccctgcgcggtggcaggcatgcctcctcctgaccctgcctcccagccggagttaactttcctgccttgcgctgggagctccaagagaggcagggcgcctctaggctccgagacacccccaggccccctcctgcaccgcgctgggggaactttcctctgggttcagtcactggtcttctcgggtctgggctgcattggagacagaatgaaaaggtgttctgagcctggcctacccctgccggcagccaggatagggctctgccaccttaagccacatattcctcctcccccttcaaggctgcagagtcaggatggccatcctagaggcagctccgggtcattcagcctgcagagcagggccgtgaagagagacagacctcttagcaacgggccagctccttgggtgctgacagcaggcatttatgtctgctttctggtgccctgggaagctgcggccgggtccctggaggaccgaagtcactggggcctcaggccgggatgaaaaccccctgcacccaccgtaaccctgagctcagctcctcatgctgagtggtgggccaagagcaggcaccctgggcagctggcatccagagcggcagggctgaatgaccttgctcatagtgatgggtgaagatgcctggtgttctgactgatgagcagctgtcctgtgtcccatgcttgtccagtggcccatccataccccagagacccaagctccagcatctgcttggtctctcatgggccactcgtgggtccccaaacaaggtatgactgccagtcagggagagggaccctgcccccttccacatcacttgagtcggatgccactgaacagcagataccactgggagcttgtgggcatatttgtgcaaaaagagggattgttggttgtttctagggttgggatcagggatgcctttacctaagtcaaggtcctaaggttccctagtgcccctctgggctttcgtgatgcatgagattgtgatgaaggtctgggaaacacttttcaagctgggtttaattctctcattctctctttctctgggccctgccgcctacttatctcccttccttgcctaccttagttgcctgcctataaaaatgagcattttgccaacccagagccctctttgcaaactccagggaagctgggtttgtaatgagagcaaagccattttccatccaatgagagagatttctcgcactgggaatgaccagtcagacaacactcggtggcttaaaataggtagtgaacagagcccctccccccttttttcctttgacagactgctcttcctaaccctaatatctccagggttcccattcccagaagactagggagaccagagggcaggctaaacagacagccatagtcatcaaattgtgtgagcaaatgtgggaccctcccatcaggaacggtgtctgggttcccagtgccaggttcctgaagagtgggcttgcctctggccagtactgggccctgaggatcctgggccgagctagagaggagtgagcaggggctatgtctcctccacccccatgggtgtcctgggtttttcctcctgtctctcaactcttcagtggtggtgataggcagttccagtaccaacccctcgagattgctgaagggccctcccctcccttgcccaggtccctgctgtttttgttgtcagaaagcatctgttcagggttctcatcaccaagcccattgcctggggagcctacaagaggccaaccccaggcatgcccagcctccctcagcagcaagcattggccggggaccttctggatgctgggcctggcccttcctatctcccttaccttagaagttggagagtgaggactgggttgatttcatcagataggatccttttccccttcctggtcttaccccattctggtatgtctgtctgcagtccccctgctgcagaatctcccactaactgcaggctgcctgggacatggctgcaggagagggtgtggggatagggaagcggggatacagcagaattgtgaaatgggcaacaggaaaagggtcagagtgggctttgaatttgggtttgtgcaacaagcaacagggactggtagctgcaagtggcacgtcctctttgcacagccttgtagctgtctggagctgggtggggtgtaaggaaagaaatccaagaaagaccatctgagtgtgtctggaggagcggtggccatacctttcctgcttctaggccaaaacagctagtgtcatccttagaatgtcaaacaggcaagagcctagctaattcttctaagcttcgaaaacccaccacccaaccccacctaacccaccgcaccccgaccagcacccccagccttggtctctagagttttagccattggccttgggcctctatgtgtagccaatcgccattgcccacctcaggcttcgcaagagcttctgcaagcattgctcaggctagtcgaggatttattcatcattttgacgggcaggaagcattgatccagcagaactggtttaataaagaattgccagcaaacaatgatagattgagtttgcggtttggagttcagggctggctgtgatgggctgcttccagcatctcccattgctgggggaggaaggctgggtgccttttccagggcaagggtgggctgtgctttgagggaccagcataacctgggccatggctaatcataggcttttctgggctacctctgcttctcattactctacctgcccccgatcccaccccccaatagaaaagaaaccatgccctggccaccgccatggcttccccaggctccctgggcttttctggcttcccctcccctccaactccccatctgccttttgaaacttgtatttgtggtgtgttaagggaagaggccaggatgctgcagcccctcaggacatagctccccgggctcctccccgaggctggctgggctcttgggtcctggatgggtccttccttccacacaagctgtgtcctggagaacctggaacaacaacaacaacaaaaaacataggtactggctaatcttgtttttctaagaggagagaaaggaaatggaaccccaagtgcagatgtagctggttgtgttcctggaagctggtcaggctcagggagtcagcctgggtgtgtgtatctaggtgtctgtctgagtgggtgtctgggggctgtgtgggtggatgtggaagctggtggggaagtccctgtgtggaacgtcagttctgggattgctgctgcgcccccaaagctggctcagccttaataatggaggcaggcagaagcttggcctttctcatccccctgtccctaccctctcctagactgagcctcctgaagccatgaggaagggaagacgggggtgcttaaagtgtcctttccttggggcagaaagagctgggctccaaaatcttggaaactgggccagtggcctagcaggtcccaggggtgtcctgagccgacttcctgctgctggtcactggcaccccgtcactgccattactcacctcccatcacctccccaaccctgactgctgtggagccctgtgtgggttatgagccttatttgagccccagttttcccatttagaaaatgggaatcttgttgcctgttgccatgtcaagcacaaattgtacaactgtggtcgccctgccgaggtgagaagctgcagtgagctgtcagaggagccgtgatgctgttgtgaaccacacctcccctgtcctcacaacttcctttccttggttttgggaagatcacaagggcctctgtccttggctcaagcaggggttgtgaaccttcttggggtcagacattttactccatccagaaggatacctgggtgtccagacacatagagtgtggcacttaatttctggtgtctgtggccccctaagttgaggaccatctgggagctcaaggttgtgaacccctctctaggccatcccagaagagagcctgggcctggtgagaggcagacactcaccttctctggagcctggcagtgggggtccctctgcaatctggggcttgggcctcccattgccagcaggatggaaacaaaaacagggctcagagttagatgcctgaggggggaaaggggttctcccttgggactggtttcttttctatttcctcagtcctacccgctcccacctttctcactttgaatcctggaaaggactgttctggcaggaggtggcaaggaggaagaggcagcagcctgactctgggtctgggggttccgaggccccttctttgctgggctttcctggggccattacccaggaatgttgttaggactctcagtgtgcaaagccaggcggaaaggagccgcaggctgtgttggagggggaagggtgcctagttgcagaggggaattccaaggtgagctgcctgggctgtgctatcagctggcacagtgggcagcagggctctctctggggatgagatgtgtcccacctgacaaggcaggggctgctggagctcaggaccgaggtgcttccaggatgctgggtgcacaaaaacccgataggggcagagggccaggatccccatactgcctggctagagaggcctcggctccaggttctccctgctgcaaggctcaagttcctggtctggtggctacatggtaaggatgggggttaccttctcccctgcttggccctgccacactggttcccttagctgctgtgagcttcgagggttttgggctgccaggtagctgcctgcctcacatagggagtttccaactgtgctgacctgtctccctgtccatccacccttctctcccatgctttagggcccagtgtccccagggccttgtgggatgctctctcaggccaccctggccaccatccatctcttcctggctgaccaccttgtggcatttggacggagctctgtgtttgttacaatgcagcttgtcctgctgtaatgtcatccgactcacccggcgatcttgttcaatacagattctgattcagtaggtctggatggggcctgagatgctgtatttctcattaagcgcccaaagattgctaatgtggctggtgtccagaccaggaccatgcttggagtattgaggttactgttcatgcgcttgttccatgcttagcccaagctcccaaactgagctccctgagggcagagctccgttttatctctttggcctcagagcctgtggcctctatccccaagctcagcgtggcagggtgaagtctgtgaactgggctgagccaagtcacagaggtctgcctgccagtgtggggatgtgggattcatagcttgctcttcctcctttcctgcactgctgcttggacgctgctggtcccgcatgctggcttttgggatgggtgtgaacaggaagaagctgggtggtcagaggaccctcattaatccatcctgtcccaccacttttgcagcttttctcccatccaaagggccagaggggtgggcctggctggggagaaggcgcagggagtactgtgactgctgcattgcaatgagatttctggaaaggagcagatgtcggtatgagcgcagaggtgactgagcaggggagccagtggctctgacaggggccagctgagaggaggacagaggcatccaggccttcttcccaatcttatatccttcttccctgccccaggctatggccagcagccgcccctgggggctgggcttgcttgtcacttctccctgccccctcctaccctgaaaggcattagctttcatacaaatgatggggctgacaagtgtcatagcagcctgagtggcccttgtgcctgccacaacactgaccaccatggaggaattcactcagagcagaaggtccagccccagtcccctgggggcttgtcttagaaccgaggaggcagccggctcctgcacagactcacttggctcaagggctcttacaaagctgcgactgccagttgctaattaatagaagggctactgaggccggccagacagtcttgctttcgcccaggggatgctgaagaattcacgtttcccagacagagagggccatgggcgggcaggggcattgtgttggctttggagaggatgttctctgccagctaggcttctttactgaggaggcattgccagggccctagaagtctgcagtcccaagggctaggaagccactgggagacactgtaccatcagcacccactcggatctgaggtgggaggcagcacagagaggtggtgagctccccgtcaccgtgggcgctcaagataagactgggcagtacttcgatcagaggttgccaagcagcatcccatgcaccaaatacagcatccagatgtgctctgtttggccagcatagtgggtcataacaaatctgagccaatgtttttaaatggaaagatacaacatgaaaatatggctctcgggcttctcttgaaaaactggaaaccctggcagccctggccccacattcccactccacagcggggagctgaaggagacactagaggctgcctcctttacattggcttttgctctgcagttgtgcaggtccccagctgtcgctaaggccactgtcttacacccagccacgtcattcatgccatttagctgcctgacccctgtaggctttggattttatagccctagactcaaatcaacagagactaaagccaggtgggttcacagatcagtaaccaccatttacaaagcacctaccatgtgccaggctgtgctaggagctctatatctcccatttcatttattcttcacgatggcctccaaatagttttatatccccaacttacagataagcctccgacgaggaaaggagagagagagagagagaggtcccccaaatcatgcagccatgaatatcagaactggaatttgacattcctccttcttttatgttagtgtttaaaaaatttaattacacaagtagttcaagaaaacattctcctgagaattaaaacgtcgaggaggggctcagaaagggatagtcagcaggcacagaaaatcgatcaggtgtcggaatatcagatctggagaggccttagcaagccgctggcctggagcctttgtttcatagatggggagtagaggagcaaagagggggagcagctggctcaaggtcacagagtatgtcagaggcgaaaccagagaccaagtgggttgtgtaacgtcttgtctgcaaaggccttcaagcttaagtccacccccagcttcccagccagagggttcacagggaaggcttttcctgaatggtcctgtcagttggagctttttcttgtcactctagcttcatacctgtctttctgggatgatagatattttcaggatcccatcaaaattaggctgctcccatgagaagggagccttcccctttctgaagatgcagagtctggtggctgggacatgctgtcctgaccccagatctggggatgctgtttctgaggatgctgggctgggatgccagctcacctcctcttcctgggcaggtcctgactgctagagacctttggggtttggggaccatatccgggtgccattaatgcccctgttcatggatggcggtgattggggttcagaggagaaggggcaagtgtccagtggtatctttctctgatccaccagagaaatggtcacgtgatctattcatgctagacttcagaaaagtcaagaagtggggttgatctgtggtttaggactcagtgtgtgaccagaatcagggcttattctgtgaccatggctagaactcagcttctgacaatggtcggggctcagtgtgtaaccaggattggggttcagtccgtggctggggtcagggctaagtctgtggccaagggaagggtttggtctagggtcaggaactggcatccttgtgcaaagcctttgagccaatttcggtgcccttgctgaggtaccaaggctcaggactctaccttcgtgccccgcccccctttaggaagctctccctaagttccctgagctcctacacctcttagtatctgagccagctgcctctggtcctctctgggaggtaaagtacaaattataaataaacaacagagccaccactgccgacgccagagccaccaaatctcacacgtgacagctccccacccaactctgctctcttcatcgtttggggctggtgtttggtgttctcagccaggcagcaagctcaggtgccctcagggtcagggctggacctcgagccgtgccggctggatagggggactccctccacccactgctcccccagctctgggctaccacaaattgcagagcaagcagcggggcctccaggtctgatcacggcagctgcgggggcctgataattggctgctgatgattttgtgtctgtctaagcatttatctgtgtgggtggatgtgttatgtctgcgtgaacgaggctttcagaaattaatacataatgggggctggctaatacattatcctctgggcttggagagaggcaagctaagggagtcatgccctccagaataccatatcacccattccaagactgctttcactattaagggtgctggaggtggcaaaatggagagtagggttccacttctggtttatgggagggcagatgagcaatagatcaatatggattgatggtcagggaaggcatcctggagcaagtgactctgagctggatctgaaggaaagagagaaccactctgtgcactttcttggaagcttaagctaagggccgcctggctggggtgggtgttggcaggtgctgggggctgcttattcagaacctgcctcctttaacctgtactccttagtccctgcccttcacccttgaggactctgagcgggctgcctgtgctgccatctgagtacgtgtggtgtgtttgcctgtgtgtatgtgtgcaccctggtcctaggtgcacagcctttgagaagactcgcttctcctgccttactaggcccagaaggcaggtgttgcctgcaataatgtcactgagcgtgtggcctggagcccagaagtaattaccctgcagttccccgttggaggctagagcagcccctgttaatgattaatgtgagtccccagccactgtatgccaaagtcagccatgggcttctcccacctccagtatcttcagaggatgtgagggcacttgttcctttccccaaagacaggaaagaccctcaggtccacaggtcccgttcatgccattagcaccttttagaagaaacttggtccagcaggggagactgcccctggggcctggcttcctgcagtgtgggggccggcccgccccagagccctgggtcctctatcttgagccagcctgcccagaactgcccacctctcccaccctcagcttcccctcctgaccctcatcctgttctgctgggtgacctcagcaagctcctctcttctctcagtgtccagggtcgggcctcagtatgaggctgaagagagcagagctaattggccaaataggtattgagccctgaatcctgaccccattagcacaaatagagccagcagggcagggacagtgctgccgaccagtagagcttttgagaatctccctccctctttctggctctgtcaccgaggtccagccagtcatgatcctagagttctgcagtccctgggggccagggacacgtggaagatctcttacctaggggccttgttttgtggaggctttgtcggcccttgtcctggggagcggggctgggggtcttcctggcacgttgtgtcatattggtgaggcctcttgaaggccctccctccattaggtcatggcctccgtggatggaggccaggctttcttttctttgtttccggggcatccttcccgggaagtgatgcagcaggagcttaatgaaaatgaactgaaatgccatccgggaaagggcctcaaccacgctctcctcccagcctcccctcctagggagcagtcccctcctggaagctcagacctggcctcagaagagctcagagtgtgaggacccatgcagactgcagggcacaccagatgactgtgggtggaggggccctgtgggacaggccagcgggatcatctactctgggattggcagaggaaggaaacaggaaaagccgttcaacgtgtcccagaggctctggggcatcatcatcctgttgggttgctctgtagctcctggggacagagtctaggggacaagcctgtgaatcctaccagtagaagacttggctctgtgctgcccagctgtgtggacttaactgaggcctcacctctctgagtcttgctttcctcctctgaaaatgggaccagagaggggttgggtgttagcaagatcccaaagcctgaattggcagccgctgaagagtcatctgggtgcttatgtgatcatggatgtttgggctccctgggtgaggccgggcaggtagagtttcaggaagcactcaggtgattctgcctccatcactttgggagccaatgagctgggcatccccaagcccccatctgcactaacagcctgcagttctctgattgctctgcatttgccttagtcctacggtggctccccagagcttggggtaaaatcctgccttcttagcacaatatccaaccccattggtaataggcctccctctccagggagcttttataccttttttttccttgtgggttgtgaggagtcaaaatcataaaattctgaggccagaagggacctcagagaacatggccccactcatcttccttgttagactgtgttttcctggagagaaggcagcccgttccctccagctctgtgtccccagatgccccagagaatccttgttgtttggccccaagctccatcccatcaaaaaggggtggtgtagacccttgcagagtcagtatttagctactctttatagggaagccttcctatggcctccttgttagccccttctatgaccaatgctgcctgccttaagaagttctgccccgggtcaggcactgtggctcactcctgtaatcccagcatttttggaggctgaggcaggaggatcactcgagcccaggagttaaagaccagcctgggcaacatggagagaccctacctctacaaaaaaaaaaaaaaaaaaagaaaagaaaagaaagaaaaattagctgggcatggtagtgtgtgcctgtagtcccagccactccagagactcaagcaggagcgtggcttgagcccagggaggtcgaggctgcagtgagccaagattgcaccaccacactccagcctgggctacagagtgagaccctatctcaaaaaaaaaaaaaaaagcaaaaaacaaagacgttctgccccaaatccatttccagtgcttcatgttgcccctcaagcctgtttcctcccgctgctggcagtgccttcctgtgtgagcaggtgagctctcccacctaatttccccagagggtgtgctcccgtgctactccacaacaatgttctatttttgctccaatctcctgagtgggaggacagaaggttcctgggggagtggtgttggagccttctttgattcttgtaagcttgactgagaggttctccaactgcttgttacctcccccatcttccccagtggtcttgtccactgggtgaagcacagagaggttaggccctggcctgagggaacatgcatctgggcaacttggagcactgtgaagcagatgtcccctgctgtgcagtttggcggtgtgtgtgtgtgtgtgtgtgcgcatgtacatattcactggtgtgtttctgcatatgcaacatagggtctgcagaggaggaattagcccatcagataaacaatgggttttcatctcaaagtgtttcttttgcccaggcctgttctcactgtgctgttgagaaggtgcggttgcagtccctttctcaaggaattctcttcctctataactttcccagcccctcatgtaccctggaagagccctgagttctcaagctggcgttcaggatgtcttccacattctcttcagagctgggagctgaggtgtcagggttccctgaggtgcgcgttcttccgtgagtgagctgtcaatctggccagctgcccttggctgacctctttagcctctgcactgcagagattcatggaactcagcatatctttagagatgtctagctccatcctcgtgttgtgccaatggggaaactgaggaagagacagtgagaggaagggacttattcaaggtcacatagcaagttagagacagggacgggactagaacttgagaatctcaggcccctgacccagacaccttccatcgcatagcatgggcctccttcctgtaacccctggcctctagccacagtgctgtctcctgaccagcggacctacttgggcgcctgcatcctctttgaggctttagtacccaacagggcatgctgccccctgctcctttctggagcaagcctggctgaatttctcctcccctctggccatccccagcctgagggatacagagtcagagattctgcatcaaccctcttactcccttcccttggctcatggccccatctgcccatggagctggcctggattttcagctccgctgtggggtgggtctgtccatcctctatattgagggcttcttgaggtgggaccatttgtgtccctcaggatcctcctagctctcaggccaggacctgcatcttaatggccatagaatgatgatgatgatgatgatgatggggatgatgatgatggggataatggcccacttgaattgagtatttatgccatatagcatattgtaaatattatctcatttggtcttcctagactcctgtgaggtggggattaatgttctcatcctgcacattagaaaacaggctcagagaggttaagtgatttgcccaaggcctcacagcagagcacctagccaccgtacatctacaatagcctggccacacagaaatgtggtccctgcaccagcagtctcagcatcacctgggtgcttgttaacagtgcagatgttggccccaccccacagccgactgaagtccaccaggtctgcagctcagaaagtccccaggtgatgtgtgtgcacattcctgtgtgaggggcgccgtgctgtatggctgaaggatcacaggccaagaagagaagactgggttagctgttgccctcacacagctcaccttcttggggagaggctgaggccagctctcattgcatcatgacaggcaggacctcagcccaggatggggaggtaccttagaagaggcaggggtaaagggtcatcattgggttttaagaaaaacaaaacgaaacaaactttgttcctcaaatattgataaacatagaaaaattggaaaataaatgtacacccaaatccaaacaacccgcctgtaaaccaagccccagatgcccttggctctaaatcggactgtgtctgaggcagccctaggcaggcaagggagcagcttacctgggagccctgtgattctgagtcagagtttttgaggtgggttaaaaatagagccctagtggccaggcgggggtgggaggaagacagcaatttatctattgtggtggggagaccctggggtcagggaagaacaacagtgaggggaggttgggcaggaaggttgggcagtgggtggggctatatttccctccagagacctgagctgagcacccagcctggctcaagaaggctgtgggaggtgatttcaaccctgagggtacagggggaggctaagatgccagccccaggacacaggcagggaggactcctgctcaccctgggacaaaacactcccccaccaccagagaggcagctccttctagggtatgggatggtgaaggtggtgacagtggctctgcctcagagaatggtaaagaggagctagacagatagggggtgtggagggggagtaataggtgctttcagacagttatcaaggtgtgaggaggggaggcaggaaaggcatcctcatgcgtgtcacgtgtctgtgtcatggactgacatgcgtgtgatgttaagctatcctcctttgcctattacacctgctcttcagacaaccaccctctctccaccttcatcattgatctccaaaacatcttctcatcctgacctcccgggcacggcaatgactttgccacatatttctgctgaccacttaggagccatctggggaccaggatcgtgtctttcccctgacacatgttagaggaccccttacagcacagggcgctggccattgtttaaaggtagatgaatgtttctgattataaaggtaacatctgcctgttttggggaaggtggaaaatgtagaaaggtgaaatggagaaactcagagtcacgatatattcccacccttagaaatcatcaatgttaatgatttagtgaattctttttttgttttatctttggcagtcttttcttcttctggcaacagtctcccgtccgtccgtccatccatccatccatccatccatccatccatccatccatccatctgtccatccatccatttaacaataagataatgttactgagattcctccccatcccttgcccaactgtgtgttcccatcttggaaaaggaagagaaatcatttctgcccttggggagctcacagtaggggaagccctaagactcctcctgggtctgtctggttggggaatggaggggattccgggagagcagtggagttgcctccttcatcccctcctcagggctcctgagtctcactgctaggcctatttgggaagaagggagaacttctaaaatcccctgtggtggaggtggggtagaggagggccaagggggtgtgcccataatgagaggcttattatgggtggttggttctgctcccaccgcctgcacagctcaggctggaaacacagtcagggccctggttggcagtctttagccacaaggtcccccgaccagctctctctcatcccatcctgtcagagaccccaggccccctgtttcttctgtcccatgtctgttcacctgccttctcccccactttcaatgtctccgctctttttctgtcacttttccaccatgatcctcagcactgggtgggaccacctgccgagggctgttgctgtgagtcttgggggtttggatgtgctaagttcttccctgattgtcggaggcttgtggaagcctggtgggaaggagtctgtttctgagggctgcccgcatcatgtggcttctgctgggctccctgccactcagcctttggcacgcactcctgaggcatgcatggcatgcactcatctgttcacccatcccccatccactcattcgtatgtttccacccattcacgtatttatgaggacctaccgtataaaaggtactgcgccgacttcagagagtcagtgatggcaagttagactgtcacacacacagtttcttataacatgataagtactatgccagggcagcgcctgtgaggggcagttaaccagatttcctaggatacaaagaaggcttcccaggagaagtgatgcctcctgtgaaccaaggggggtaggtgggtacaagtggggagaagagttccaggcagagatgacagcatgtgggaaagcccagaggcaaagaaagcaccatgcgttggggacaccgaaggctgctgagtctgtctgcagcagagtgtgcaaggagaggaatggggagcatcaaggcaggagaaggaggcagagtccaggccaggaaaggccttggggacaacagtgaggaatttggatttcacttaagaggtgatgggaagcgcagaaggatttggggcttagcaaagtgtggagagtcgattggaggagggtgctggccccagccctgaccctgaggtatgtgaggtcctggactggccaggagctcagctgggaagctgttggagtagtccccatggtgggttgatgggacacgttggatccagtgtgatgaagtgttggaaggcaagggagatagaagagttgaggatagctctgaggtttctgggatatacttttggatgcctggtggtaccattttctgggagcacaagagtgtggaggaagctgtgaagctctgtctgaatatggcaagggtgaggttcccgtgggacatccagttgtagacatgtagtcagcaagtggatgcatgggtttacagttcaagagaggggtatggtttacaaggcagcagaataacaaggccatgggagtcagtgaaatcacctggaaagagtgcacagagcgggaagagatgagggccccaaggagcaaaaacatggaaaggtcatgccgagggaaaggaggccgttcaagggaagggaaaggagaggcagtgagaacagagaaaagtcagtggagtgggccaccttggaagccaaggaggagactgtctgcaggtaagaatggtctacaggaccagatgatgctaaaggccagggaggaaatggactggaaagtgaccattggatttagcagcaggatgcatattggtgacgtgctgaggagtggagagcagcatcgcttctcggccttttggctaagatcaagtggagtggagaggagcgctgggtgaggggcacgaaagcgagagtgtggggacggtgacacctccttcaaggagcttggtaagagataagacagcaggggttcagggagggatttttttttaagtttagagagcttaaaaggaaaagctgatgggaaaggatcagtggagagagacagatggaagagagagagggaatcttctgtagattaaggtccctggggaggaaaatggggatggtatcaaaagggcaggtagaagagccgctgattcccctgtgactgggaagaggagatgggattggggagatgcttcaaggtggcagaaagaggaaggggacactggcggctttgcttttctctgtgacgtagaaagtggtgttatctgctgactctgagagaaaaagtggtggtttcagagctttgaggagagaggaattaatttgaaatagcagctatggggaatgggcaggaaagtttactaggttctcctggaaggatcaggggacagagatgagggctgtgaatgaggccatgatgatgacattgaggcatgaggagctaagaaacttggatatttagtaggactggtctgaggttgtgggattctctacacagctcccatgtgaacatgaaaagggttgatggtggtccttgcctggggctgggatttcatgacggtgccaggaggaggggcatgggagttaaaggcgttggttttagagaggcgaatgagctggaccatcgtgtctggggtgaagggtggttgggaggatgtaggagggttctgatgagaggatcagaggagtcagcagactggatattcccaggactctgaaaaacaggtgcagcacaactgaatagaagagccggcaggaaagaagggcagggtgtacaagaggactgcagagatgcagcaccggaggtggtgacgtggtcaagtgtgtgctttggaatggaccattgaggtgggattgttagagtcagggtggcaagctaccaagaggccaaggtgttgtctgggtcaatgatatggagtagaagtcacccaggacaatcacaggatttggagtggaacgggaggttgtgaaccaggtgccagcattgccaaagtccttgaggatggcagatgggtgctggaaggatggccagcaaatgacaaggatacccaaaagatcttgtagacgtttctgccacaggcaggaggtagcagcagtagggagaggggaggatgctgactcacccctgattctgaggcatgagggatttggaagagtgatgtccttaggacacaactagggttcacttaagcggggaggcagtggggtctgggagtgaagaagttaaggatgcaggtgccatggaagagagcacaggagagagagctgggagggagacaaggagcttggggagggacagagtttgggagtaataaaataccaccagccagattgatatttctgtggagtggttagaaagcaggcctctggagtcagactctttgggtttgaatacttggcccaccatatatggcaaatctctcaactccttgtacctcagtctcctcatctgtaaaatgggcataatcatagtatctacctcataggggtttttttttaatgaagattaaataaagtagtccagataaggtactcagattagtgcctggcaaatggtaagtgtccaaaaagtattgactgccatcctcctccattctcactgttttcagtgtcaggatctttgctgggtctggaaaaccaagggaatgggaaagataacccaaagggcatatgagttggagagaatgaaaatgcaggctggagaccaggaaggaggtggggcaagggtccagctgagagacagatgcagaagccatcatggaagcagctagactagacatggtgactgctgggggtgttgctgtaggggtgggtgggaggtaagaggcagcagtaagggatggctgggaggttttgagcctagattattgaaatgcaaactgtgccattcagctttgaggaggatgatgctgagttcagctctggagtcgttggctgtaggagacagcaggccctccaggtggatgcattttgcaggcaggtaagaatgcaggtctggtgctgggagtggcactgagtgggagctgtctgcaaagttggagagggtaacagatggggcactgagtgtgctgctcacctgggagaaagcgtggagacccacgggctacagtcagcactgcagggacatgggtgtctgagacaaggtccctgtcctccatgaacccatggtgttttaggagctaaaaccaagactcaggctgtgcagaggcttcagtggtcagagttgaagagctagcttgaaaggtggaaaatattttaatgacaaaacaatgacattcttcttccagctgacaggattcccagtggatatcatttgtgccaaaatgtatgcaagaaagtatgcatgtgtaaaaatggatgcatgtaggagggcaaaaggcaagagcgtgtttacaaaaaatgtattcatggtattgcatgtgggtgtgcatgtgtgtgtgcgtgtgtgcacgcatgttcgtgtctgtgcatgtgcacatgtgcatgcgtgtatatatgtgcatatgtcctcaaaggcaagcgtgggtgtgtgtggacaagaagaggctgaaggaggtcatccctagctgggacctccacttttcctactttcattctgtcacccttcccatcctctttggcctccagggaaggagagggcccttagtcttgtccttgagtccccgagttcagtatcagccacctcctgtcatgtcttcctcagctcccttgaggctatgaacttcctctcacaccaaaacatgaaatttccagatatcggtgtaatgggctgcttggctttttaccatcccccattctttctgcatatgggacctgcccctccagtgtcagcctataagttgcctcttcctgctgagaggccacctgcctgcctgggtggacccattggtccaggtaggaagtaaggattgagataagacaggtctggaagcctggggctgctggggctcccagagcccagttggtgtcttgctggccaggactcctgttaacttaaagggcactgggctggaggaggatcctctggatttggagagactagggcccctaattcaggcacgtgccaactccaggatatctgagcctgactgccccttgctttcctgtcagggcattacacccaccaccctggattcacaccctggattgtgagatttattcatgagtgattctcggggtggccagatgataagggagcattgggcatccagcttgaggcttcggaaatgttactcttccttcctttgtgagccttcgttttcccttctataggacatgtgtgaccgtgaccgagtgattgctgatggccagggtgccttcagcacttgagaggtgtgctacttcctctacctcagacagccctagcatcaggagcatgggccccccaaatcctctttgcagtcttctcttctttctctggggcaggggccacacctgctgtggtaggctgcctttccactgtgatgtaaaggtgtcagaaaggcatatctgcctcccacatccctctagggtacccacaaccccaagaactcaaactctggagtcccagagacttctcctaatcttgtgtctgtccctcactagctgtgtagtctagggcagacacttctctgtcagcctcaagatcatcatctgtaaaataacagcagccacagtgctagtgtgagggataaatgaagtaatgcatggaaaacccaagtaagttctctatacatgtgaagtgttttggggtctttatgaataaagacttttcagtcaccaaggagccccagtaaaaatgctcagagatattaaggcatcacttgagatgcttcgaccagcaggattggaaatgaagaggggccagcaagctgaggatgccagtgtagaagctgttgccaccttcccctggctaaacccactgaacggggctggcaggtgtgctgggcgctgtccgtggtgctgaacgtcatatctagctctggcagggcctggctttcggagacctgtgcaagcatctggcaaggagtaaggaaaggtagtccagaagccaacggcagttcccaaaacccaactcctctcacctcctccagaagcagtttcccggcctcacccttctaggccaccgggatcccatttttatggatacctgggctttttacggatacctgggctcatagggatggtttcttacaccattgccaattgccttctatccaagccttgcgctctgaccagaccatgagtctctggaggtgagggcatctgtgtactgaggcaaataggtctgtcatctgattgctggagggacctcctgctactggctttcctgggtctattacaggctcctctgtgatcccactcccagcagatgttttgctttggctcttctctgggagatttgatcctccctcttacctctttcctgcaaatttattgattttgatgatttatttactcatttcataatgtagctgggcataggtcagagcatttgacagaaatcaattgatttcctccttatgacagtgctgctagtcaggtactgtggttatcctcattgagcagataacaaaactgaggtgtggcatggtaaagtgacttgctagtaaaccatggagcaggaatcgaaccctgacttcaggcccatccctcctcccaccatattatactgtctctccagcagctctgtgatgttccagggtagtggtttgtgggaaagaatgatccaggatcccgaccccagcccagatcgagtgctggaaatatccctgagcatctggaagctcaagattgaaaccattagtcagagtgcgaggaaatgggtgtttttgccttatgcaatttggttttatgaagaccacaaaatgcaaacattctcctgttaattactctctcaaatttggactgtaattgagggaactagagctggggagagtgtagaaacccgttggagtggcaggcccgcccgagtcagcattcccagccgccttgcacccgctctgttaattttagaaactcctccagcctgggtgtattattagctttatgtacagagggccacatagccctcagtggcctttctatgcacagttaaaaaatttgttttcttttgtttttcccaggagattaaatgaagagggatgacagcagagtgtatagaggggtgtttgtgcactgtgtgtgtgaatggggatacctgcgtgtggcatctaatgagtgtacacagctgtctttgagtgaggtctatgtggctgggtagagcatgcacggctctagggcaccccatagatgctgaaaccatcctcctggggcccatgactcattagcaggtgtgctgcattctttgtagtaaagtgtgaagctgaggatgggtcctcaggccttagttgggttctctcagctggcatatgggtactggggccacaggaaggagtggtgggtcatggggtagagaggagctgaagttggcctcttggcatccggccttatcccccataaggccctgtcttgaggccctgaagagcttggctttcaaaggagctgcagaaagctgactctctggaaactgccctttgccacacagtgtgatgtaggacagccatctcacccaccttcagcaaaacaggccctaccctctccttgaatcacagccccattttgagtctggcaaacaaacaaacaatttgctatgaagtaatttctttgcaacctggaactctgcaggcaggggcactttggtttacagtgagaccctctgaagactcgaggaaagcttatctctttctttcccacttccttcctcctggcttccctgcagtaaagaatcaaagatggtggaaaggttatttctcctgggagaagacatgcttatttctgcctcacttaatacctttatctgttattgtgtaaatgtctaaattaatagcagagggaaacagctctgcagtgcaagtttttggtcttggggccagccctgggatggctggtgcttgggcagggtccctgggaataactggccatgccttctggattggggtcttggccacctgtgttgtttccacactccagaaggccccctgcttggtgagttgggagaaacccaccacagacctgtgagttggtgttgtgcctcctcctcatgctgctcaacttctccaaggctttgccctgaggctccctctacaaacgacttgaaggtgcctgaggccttaggagaaatgattctggaagccctgggctggtctctttctatcacattgagtggtatctcactggtgcctgaaatccccccattaattattcttgttttgaagctatctctccccctccacacccccatgttaggatgcaaacctctgagggaaggagatggtcagacattttctgattataggggatggactaaaggtggatgccagagaaccagtttgggagagggccagatcagaatgataggactcattacacagtgaggaaactgaggcccagaatagggaggcccttccggatgtcacatagcatgttgatgacaaagctggggccggagcctgggcctcctgccttccaggcacctgagtcatgtctgtacctcccctgctctttggtcatggtctgtggaatgtctccctgacagcccatctcaagccacagctgaccctcagggaggatggggcagcctagcctgagcctggggtggtgtggggtgagctgctccttttgctaaaacagcctcttgcttctctctgagtgtcactgatttgcttttcagcctgactcttactgcgggctggggatgggaggaggaagcttgttgttggggctcggggaaactcacagaagggcagcacggagggtatccttagtgaatgaagagcctcttattgtgtcattccctgtgccaatctccacatcttgccctggtacccatgtgcctgtcttcctgtctcagaacctcccaagacttctctgtcccagatgctgtccctcagatcttcctcccttagtctgtaacttgtcctctctctcttcctggcgactgacccctgtgtctctgggcagattttactgggacctgaccatgctgctgctgatggtgggaaacctgattatcattcctgtgggcatcaccttcttcaaggatgagaacaccacaccctggattgtcttcaatgtggtgtcagacacattcttcctcatcgacttggtcctcaacttccgcacagggatcgtggtggaggacaacacagagatcatcctggacccgcagcggattaaaatgaagtacctgaaaagctggttcatggtagatttcatttcctccatccccgtggactacatcttcctcattgtggagacacgcatcgactcggaggtctacaagactgcccgggccctgcgcattgtccgcttcacgaagatcctcagcctcttacgcctgttacgcctctcccgcctcattcgatatattcaccagtgggaagaggtaagtggtcagtgcaaacctcttgggggaaaggccactccccacagagggagtgaggaactggcagggaacctcagataattgaacataggctgtcagattgtggcaggcacacctgctccaagaggacaaatactagtaagttcttgacctcttatcatgtgctggatactttacatgcagtatctcaatgaagtgtgtaacagctatagagggaaccatataggtacatgtatatactcatttttcacctgaagaaacagacagaaatattaagtgacttatacaaggttgcatgattagtaatttgtgaacctggaatgtgaacttaagccgatcacctctagagcccacattattaaccactgcgttatgttgtagggtttgtaaacccataaacttgttggggacaggcagggaatagggatgggtgaaaagggccagttgggggacagtagacagtgtggtggatgagaagaactagagaacatctccgttatattgggtggcctctatgcagctccagctaatttttgtcaagtgggaatgggcccagggttgctagatctatagcattatgagaaatggaaatctggatttttatacaaattttgttggcaactctcttagtttgggttcttcctgagcagaacctgagacaaagatttgcatgaaagggatgttttggggatgcattcccaggaaaatctggtaaggggactggggagagggacagggaaaggcaggaagccaagcaatggttggacattggagggtgtcctgtggatggctgtttgcctcagccctatgggatctgaggatagtgtgcgccacaccttggagttgtcccagtcagggcaagggagttggaatgtttatatccccttacctgtcagtcattggttcaaggcactgccagccctcagcactcacagccaaagcagtttccagcagcccgggcaggcctctgacaaaaggtgcggccgctggctgtagagagtgaaatcacgcgggcaagttggagtcttgtgctcagaaactgtaaagggatcctaggggctgtgaacactggctacaggaggaaaataaaacattgaaaaagaactgggcggaccaactgcattgtgaacaaacctcactcatccatgggctgaagcagtcatctgcagcagaggagctaagggctttgctgggaggaagagcagctgaccttgccaagtgcttcggtctgtgtctgccacccacccaagttacacaacttggcagcagcggcaggcaggccagcctggagggcctactctctctgtgagacagcccaccttggatccctgccacctgtgggcgggacaagcttccatggagggccatttcccgctccatccctgtgccgcgtggctgacttcccagcctccaggaccccctgcttgcctggcagaagttcccatgttcaggacatgaagccccccatgctcacccccagcagcagcctgggcctcgactggcagcacctatggctgatggtcagaggcgtcatgaacgcatgtgccataggagaagtgtgtgcaccagtttggcagcgtccctccatggcagaaattctctttggcttggaaaattcacattacttatgctgacagagaggggccgtgactctcccaaggtcatgcagttagacctctggtagaactgggacagaatccagctagccctcttggcccccagcacatagtgtgggctgtcccaccccggtgtagtggaatggcgcatttaagacccaagttaaaatcccggctccacactgcctagcatgtagctttgggtccactttgcctctctgtgcctcagtctctttatctgcaaaataggtataagttgtacctgatgtttataaagccttagcatgaagcctggtgcagaagaactgtttaatatgtgtccctcctggccgggcgcggtggctcacgcctgtaatcctagcactttgggaggccgagatgggtggattgcttgaggccaggagttcaaaaccagcctggccaacgtggtgaaaccccgtctctactaaaaatacaaaaaattagccaggcgtggtggtgggcgcctgtaatcccagctactcgggaggctgaaataagagaattgcttgaacccaggaggcagaggttgcagagtgagccaagatcgcaccactgtactccagcctgggcaacaagagtgaaactccgtctcaaaaaaataaataaatagatgttatttatatttataatatatatatatttatacacacacacacacacacacacacacacacacctacctccctccccaccaagttgtcttagtaacatttccttggttccccatacttagctgtcaagagaaacagggcaagatttatgatcctcatgtgtcaagtgaggaaactgaagatcagaaaggccagccgccccagtggtagggcttttggcctaggcctcctgtcttcctgttccatgcacttcccgccttctcagatggaaagggaatgactttgattctacgattgtttcctttcatggctggggcccctccatgggggactggacttcattcagtccagcaagtgcttgccgggcacccacctgtgctggcctgggtgggcgctgggatcaaaggactaggacgactgttggcagagagtgggagggcagtggcaggggaggagatctgtgcaacaggttgagttggaggtgcctgtgagacagagatgtgcagagatgtggcaggtggtctgagctgagggctgagaggggacagtgactctggagggtgcggctgggtccactctgaggggctgtgaaggaaagatggaggcgtgtttcccctcatgctctgacacacttgtctcctggtttccgtcgcaggtggaaatgtaggaccaggttggctccctcagaccctgagaaacccccaaccttctgcatgtcttggacccacagctagactgccatgaaaagcagagacacgccagctctttccctcctccagcatccattcgtgtctccaggcctcagcctcccaggggctgaccttactcctccagggcctgagggctgtggtcttttgtaggagttggcagagatgccagtggctggacagggtgagtcgtgggttggagctaagcttgtctttcacgtccccacattatgcatcctgggagctcaggcccagggctcctgtccccactgccaccctggccaggccaccctcttgggcacccagaactggtcaggcgctggtcctggcctttctctgggggaggcagaggccccaggaggccttgagtcaggcctctgaactagacgtgccgccccatctcgtggggaggaagaagatcccaggaggccagatggatgactctcacccttccacacacaaacctttatctctcctaccagctgggaagaaaattgctttgagctagtttctgccgggcacactggccagcctagggctctcactggacccctgagattggactggggtttcccagctggccccaggaaccctgtctccaggaccatagcaggccactccagcccgggggcttctcccacctctgcttggcccagaggcagcagcagaaagaccctttggagccctaggtccacatgagagctgaggagagtatttagtacagaaaaccctgccctaatctcctctttcaagtccctctatgagtctctttcctcctttgggcctcagtttccccacttgtgaggcacataatgatgttctctgaagctgtggctccctggggcccagtccccagctcccatctgccttggcaaggtttatgttagctgattctgaagaccttgttgtagctcacggaacgtgaaggaggatgccctcggttggggctagggagcttgcctcccacagactggggaaagcttgccccaggctgcctggcactgcaagaagctagactcctgaccccaggcttctactgcctcccccagccgggcccagaccaggcccccaggagatctcctaagtgttggtggcagtcaggcagtcttgtgagtcagcgcaggtgggccaccatcttggaggatgcaagcctcttgcctccatcctgggcgatctgggtcagcagactccctcccgagcctctccagccatgcctcctccctccctccgaggtgtgagcttgttccaggcatggaggctattgttagaaaccatggttacccttctttggacgttaccctgcaaggctcagcactccagtgacccatcccagaagtctctcctctcccttggcagcctgaagtggccaaagaggggctggaggcagaaggccagctggggctgctgtgtggcctctgatgagtcccctcatcctgtagaccttgattgcctcatctcagaatcaggtgcttggcatctgcgagaagtggagatgacacaaggagaggtcctggggcgtgggtactggccctgtctcctgcacccaggatgggacccggcatgaccctcagtgcagctgccttcaaactgcacccagcatgcatatgcagcagcctgttctgccaggcctggggttgctgtcttcaacgcagacacttgttcttgagacacaggtggaagttgttcttccatgaggagaaaatgaatccacaggagaggattcaatcaggccccaggaagaggccttggtggaaacagcagcagccagacctccaatttctggcctctccttgggactgagaaatcaactctttgttgggagggctgggaaagagagggaaggaaaggaaccaacatgtcctgagtgcctaccatgtgctagtggtggatatgatctcacctgacccccatgatagccctgagatctggcaattacccattccacagatgaggaaactgaggctcggggtggaaaaggcagtggctctgtccttgcactgcagttgagaaactgcagaaggagtgagagcagggcttccccaagttccatgtgtggcagagtgagctgcctggaccgcctgacgggcaaggcttgtagtggcctggaaatgaaggtgctcaacccctgcagtcagaaccaacatcgtaagagggagttctaatgaaatataaagagcaaggcaaatatttgcctggtgcaactgactctccggtggcctgtggccccagccaacagtggggacacaccagtgtttagcagcctctcccagcaacgtccagccttgttctcggcaaccacttcccaggtgctggagagtggtgcaggtgaggtgagtgtcctcaaatctagggcaccccctaacctgaatggatgtgcccccaccagctcttcccaggcagctcagactgtgcgttgttggcgctccagctttgtggtgtctaaaaaccacctgaaacacacctctccagccctgccacctgcacccaccaccccagtgcccacagtcctcctcaccgcagttccaggcttcaccaccaccatgctctcagtaggacacggaagtctgtgtcccctgcaggagaaggcaccttggttcttcccacagggacaagggtaggttccctgtgggctgcatctgcccagagcgggtacctttttgttcttccactgtctacactagcaggagccctgctgaccaccattctcgtcactgtcaccattgccttcaccttcatcacgaagcccttctcagttcctgaaaccttaccacatgctctgtgccgtgttcattgctgagatcacgataaaggcacaattagacaaggacctgatcttagaagaaaaggagtaatgaaaagataaaggcgatacagaaggaaaggaggtcattgcaggaaaacatgccaccttcgatgctctgtctttaaggcccagcgtgatctgtccaaaggagcagttactgtggcctgtgacagtctgggactctttctagccatgcccggaggcttccttgagctcccatatggtacccactcattcatttagatgtacgcgcatttattcaggcaatcagcagatatttttgatgcctgcttgtgctaagcatggaggaacacagaagtgagaagtagagaggagccctgcctcgtgcagcagcacgcaagtcagtgaatgtcatttcagatagtgagaactccaggaaggaaattcatcagggcaaagagtcacagtgagaatgggaagggagagcccttggctgtgtcacacacagggatccagtgtccttcctttccatggaagtggcttttgagccaagacaggatgacaagaaggagctggaggcagcacgcaggcagatggaagagcaagcccagtactgagggcctggggcaagcacgaactggcctggggcattcaaggacatgaaggaaggccgctgtggccagagatggctttgggcagagtcagggaggccggtagttgggagccgagatgccgagggccacagttggcatttggagtgtattcatgggtgcagtgggaagtcattggaaggtttatggtaagagagtgacatggtctgatttatgtctccaagaggtctttctagctgcttggttgagagtggcttggaggggcggggagcctcatcaagaggttggggctgtcatcttgcgggtgtttagattggggtcatattgggattggagggaagtaaatggctttgagatgtccacttaggcagtagagccaaaaccacctggattgatgggatgtggggagggatgagagactcactcacggctggctggtgggtttttgttgctcagcctcacgaacagcgacaccaattgtgagatggaaacaggttttggatgtgtccacgtagagatagaccgagacagctggacatacgagccaatttgtgttactctgagtccacctgtgtgtcttaggcatgacagaagcaaggaactgggggtatcccagggcttgaaagaggagcacagggaaggttgccttcatcagaggaggagcattgccggtctccacggccccttgtgatggcggcaacacagttgcatcctggggagccctttagccagggagaccccactcagggtgcttccagagatgccctagactttgataccctcctcaactaaagaaactttcagcagaattcctgctgccttgacaagccaggggtgggaggagaacggcatgcttgtggctgtgggctctgctaccagccgtgctgtccagccccacagcagcatctgggctgggggtgctcagagcctggaccagcctctctactcacctccccattgtgccctgcttgccttcctctgttgctgggtttctatatacatgttcccaagtccctttcctgggtgcggcttccttccccagccagactatgagctctgggcaagcaagggcaagactttcctccctgacccccatagggaggggggctttcttgggcactgacacaggctgacttccaggggacatggcatagacatttgggtctttctaagggtacttccccgagacccaggaaagaagggccccactggcccccactccggaaggctcctctccccacagtgaggagtctgggggctctttgcaactctttcttgaccacacttgggtacccagcattcctggcgcagacacctctaagcttgctgtcaaggcctgtgcagggccgttcccaggatgtcctgaggggaccattctgcctctgtgcccaccccttgacccacttacaagtggctgttcgcaggagtggcatggatgtggcttggctgtgggccagggtcctctgctggggggcacagtcagggaagagaagggaggtgggctgtgctctggtgtggttttctaagagttctcatttcaagtctggccctccagggcattacgatggtgccttctgtcaaggtaggagaatagaatatattttctttaacagtttgttggcttgagttacgactttaaatatccaaatctgtggcttgtggaacctgatttgccccttgtcctggactctccaaccctggggcaggcctgcctcattaccccagctcagcactcagccatgtgcctcggggaggctgctgtcctgcccccacgggcccccgtctgtgcctccagtacccttggcctcctgcgcagctttcctgtctgtggcagagggctgggttctgaaggttggtgtctcagtcagctcaggctgtgacaacataaacaacagaggctgggggcgctgaaataacaaacactacttcccacagctctggaggctggcagtctgggttgagagtgccagcacgggggcttctggtaaggccttttttttttctgacttgtagacggccgccttctccctgtgccctcacaggacaaagagatcgtctctgtctggtctctttttataagggcactcatcccactcatgagggtgccaacttcatgacctgatgaccttccgaaggcctcatttccaaatgccatcacctcgagggttaggaattcaacgtaggaatttgggagggacacaaaggtgcagtccctagcagctgggaagagaaggagcttaataataatggccccacccttgcgtctatgactggtgtgcagagagcactttgctagctagtttaattcacaagcaatcttgtaaaacagggggcagatgtctagcttgtttgagggggaggctgagttgtggtggtggggaggcaggtgtggaggatggccggctctgagaccgtgaatggtgctgtgtcactcgccctccccaaacccctggtgtcttagctcagacaccagggggttgggtgagctggggagctagtggcatcctggtcaaccaagacatagaaaggttaggatttgcccagggtcatagacatgtcacattcacctaagtgttaattaaggaggcaaaagtgggatcttccccccggctggtgctgggggctctggtgctcagggacctgctggggagagcctcacggtcttaggatacaggtgcctgaacatgaccagccacagaaaatggaccagagaccccaaattcataatcagatctgctctgtgtcccagacccaggccccagcccagccacagaccggcctgctctccagggcccaccattccttccaggccatggcagatgctgagcagtgtcagcttagccaggagctcaaacgctgacagccccagagctggtctgtgccccagtggtactgggctgcagggcacacagcaccgtctacaccatcacactgtgtgcaggggctggggaggcgagaagctggcaattcccacctggcctaggacccagcttgctgtgtgaatctgggcacctcattcagccactttgggtttgagttgttttatccacaaaatggaactgctgagagctaccctttcctcactaggtcaatctaacaatctaatatggtggctacaggcctcagaatcaggcagacctggctacaacatctggcctttccactgccactgtgatcttgggcaagttcctgtacttctctgagccttggtataaaacagatgaacaatatcttcagcaaaggatttttgtgagtttaaatagaggatggctgtggaatttcatgtccacagtcaggtgtggcactattgtcccctctgtcaccagggccacagggaaatgatggggcaagcttaagctaccggaccccatgaacctttcgctgtccacttcatcctggaaagactcccagctttgtagctggaaccttcagggtcatgcccttgatgggggccacaggtgggggtgactgcaggtgatgagctgtggacaaaaagtattcatcttcggtcactagtatcagaacagcttgccactagctacagggctgtagctggaagaccagtagacaggggctgacatatctaggctctgtctgtttgggcctagtttccacatctgaaatgggcttaaactaggtctctgtggcatttgacccaagcccccctccaagaggggtgtctttgcctgggaatagtatggagggatgagaatgggggctgggtggctagacccacttcaaagtctcccaggccacagaagcaaggccagagcttccagagactttcctctagacttgcctccacctctccatcccccactgccctgtcagcaaggggaccccagcatggcagctttgggaggaggaggggctgagatatgcccaccttggccctgtccagctacactgcagccccccactccgagctgcaggagtagagaggggctggtgccagtgggctggggtcaagggtgctgtaaaggagaacattaccccaaatacgtattaaccaatcaggaagattaattattaataacagcttatcaattaataatggtttgtaatttattgaacactcctctacccattactaagcactttatatgtataatttagtccttttgacagcccactcagataagaatttttatcaccattttccagatgagaaaacatgatcagagaggttcaaggttacacagctaggaactgggtaggacctgggcttgggatcaaggtctgcctgaacttggggcctgtgagcctgtgccgcttcctctgcagttccgtggctaccgtgtgtgagtcttgagaatttagtgatagatttagggaaacacgcccctggcatgtctgtagacttttggttccctgaggagcctcaggctggcaggcttttctccctggtatcctcacaccccaggaaagctgagaaagtggcttctctgcccacttctgggctgcatggggctccaggtgtccttccacatgtcctggatggctagacctttcaggaagaccccccatctgtatagatgccaggagatgtccctctgggaccctgcagcctacagtcttcctcttccaagacctagactgacgccttcccatcccacccccagcctggatttgcactgagtgggcgccctgcagagtccaggcagagcagtgcccaccagcagctccagggcagggaaagtggccgctggccctcctggccactcacctatcccagccaatttctcctcctctgctggcagatcttccacatgacctacgacctggccagcgccgtggtgcgcatcgtgaacctcatcggcatgatgctcctgctctgccactgggacggctgcctgcagttcctggtacccatgctacaggacttccctgacgactgctgggtgtccatcaacaacatggtggtgagtgcgcccagcccggtcctctctctgggccataggcgggctctccagaggtagggtggcgagatgtggacttggaacttctgagttccagcatgtaggaccctgagtgctgcctggggctgagggggcacatagctctacccagtacaggcccaatcgcttgctgccagtccagggatccattcacagctctgggttgggagctggtacctccatcttctcacagcctccattgcaactgggagcctcagtatttcatcttgattttacccagggagactaagacctgggcggcctcccccaggcatggcaatgctgggctggcagctcctggcctcctgcctctgccccttagaagccaagtccttaaaagctgaggctgaggctgggtgcagtggctcataccagtaatcccagtgctttaggaggccgaggcagggggatcccttcagcccaggaattgtaaaccagcctgagcggcatagggagacccctgacttcaacaaataaataaaatttatttttaaaaaattagctggtgtggtggcaagcacatgtgtcccggctgtacagggggatcccttgagctcgcttgtacttcagcctgggtgacagagcaagatcctgtctcaaaaggaataaataaataaaaataaaaaacaaaaagctgagcccaagaaaacagacgccttcaagggtactatttgcagcccacgcagactcccaggtcatatgtggtcactttctactccaacagcagagctgggctgcccccaccccccaacatatcctgatccgaggtggagtcccgatagggagggcaggcaggatgaagcctgaccccaccctatccctccaaccttgcaagtgggtcagggtgggtgagagaagttgaacttggggcctcggaagccatagggcagagtttccagtccccctgtggatgaggtgggttccaggcaggacagaagacaccctggatctgtgagcctttctgtgtctctggtgaacccctgcctctcccaggcttcctcccagtcagtttggtttggtctgaaggcaaattcccagggccccaggggaggaaaaattggctttgaaagaggtgaaagagaccctgaggcatctttcagcatcaaacaggcctttacaaaacagccttttgatgagctaagtgtaaatgaatcagccatatggattgaattccctgttcccagaggctcagcagtaaaggccgctgggggcctacccctgttccccaaggctgggaacccaggtctcttccacccctggggatgagccctcctggtccccactccagtctagactgagccatcagacccaaggagccagctcagctctgttcagggcagtctggctgaccttgaatatggctcgaagctcacgggctcctgcgccttcccctgggggctgggcctctggcaggtgctctgtgggcctgggtaggtttctgcactgtggctcatgcatctgccctgtgagcagaaagacaccagggaggtggccagtgctggcattcgtcaggttcaatgggccctcatctggggcagtgtcctctctatgtgagggtggcaggcccacacatgcactaaattcaagagatggcccttccgatcccagtgttcccacgctgagccttccttgagacaccgactggctttgtagacaaaaatagccaagagcttccctcctcctgtccccacgccttgtgtgttccggagagtctgccttgggggtagtgggaggagaactggtggccgcagccctagcagaggcgggcagggttcatgcaggaggcccgttagctcacagctttaacttttgctcatccaaaatgaggacagtgtttttcggctcagtccgccagagcttgtccccccaagggaagcatatctggttttataattgaggtcagtggggaaatgggcttcacttggcagctgtttagggggttggggggtggagctgttttagcaagggaaggacagcacggtggctcagcccggggcctttgctacccagccaggaggctccaagctgccccatgggggctgggccacgctggctcccgtacctttactggggcttccagtctgatctctgcccccattgcaagaggaaggcacaagaggaggactcgctggcagcacaggctgcttctcacccaaggctttcagccaacagcaaggttagggagccctgggcccagccactgagaaagttaggttgaggtgaggaggtggcagggccttttcttgctagtgagaagggccttccctctcatccactgtccccacccatccgtctgtccacagaacaactcctgggggaagcagtactcctacgcgctcttcaaggccatgagccacatgctgtgcatcggctacgggcggcaggcgcccgtgggcatgtccgacgtctggctcaccatgctcagcatgatcgtgggtgccacctgctacgccatgttcattggccacgccactgccctcatccagtccctggactcctcccggcgccagtaccaggaaaaggtaggtctacccagggagcacccgcacattggtccctcccaagagggagcacaggccaccagccagtgggcccccagcaggaaccgccccctgctcccaccccacaggatcggaactcccagtgtgagggaagagcaggaggagggagacacctctgagatgagaatctgagtttcagctccctggcctggcccctccacatgtctttttttctgttcccaccttccccgtctccagtgtcactggggcctgtggctcctggctgaggccctgtgccctccgtgctgctccagtaggcatttgacagtcaccacgcccttcctggctgctcactcgttctccaggaccgcactctcgcggtgttgctcctgcccctctggccagtcccctgcccccatttgctggcttctcttcccagtcactgccactggagtccccagtggcccgggcctcgcccctgaccctccctctgtctggggccccggtgctgtggtttcaccacccaggcccacaggctctgtgcccatctttgcacagtggggcctgcacagcatcagcagccccacctcatctctcagctccaggtggtttatttcatccctctctggacaccccacgcccctcatgtctgtaatgagaaggctgccctgttctctctactccaagtctctgctcttcccagatgcccaggccagagactaggagccatccctgacctctctctgtcatcaatgcctacctcaaagccacagctccttctctgcatcccaaccaccttcccccgtccccagcttcatctctccctggggtctcaacagcagccccctcaccacagagaatgagtcctgtggcctggagtcaggccacctgggccctaccccagcttctctgctgccgagctctgtttgagcgtgggcctgtgcctccacagcgtgaggccccgtttcctcatctgcagggcgggggtggtactgggcatcaggctgtgggggttgcaagtaagctcccctgtgtttatcagctaagcaggttctgccctggcaccttccactgcacacctcacacagcagttggagcggcatctaaaacacgtcagcctcatcctctgcttgaaactcttcagggacttcacgttgctctgaagatgtagattaactcctcagcatgttttcccagcctggcatttgaggagcataaccagggatctgccctcatgctcagctcctgccctgggccttgcaccctttatttcagcctggccagacttctctccccatgcctgctcctgccatgggacccagacacgggctttcaccctcaactctcctccccaggtgtccacctgacaccctctccacgtccagcctcaccacttagagaagccgtctatgacctggccagcccctcacctgtcatgtgaccccatggcaccctctcctccttcaccacactcagcactctgtgatgatgtaattaaccataggcagccatctgtttaacaaacccaccttccctctccaggccacggctccatgaggggaggacccagtatgtcgttttctgttttatgccccatgcctggcacacagtagggtcagcatttatggattcactgcctgcctgcctgtcccaggcactgtcctttggtggggtgactgacaggtgggggccacccaggtgtggaggtccaggtcccatgatgccaagaagagagctcaggagagcctacagagctgggaggcaaggagagctcactgtggggaagcagaggaaggagaaggtggaagagaattctaggccaggcatcaggatgaggatgagcataggggtggtggcagagaaattagcctggctagaacacagggtcctaggttagaggacccttctctacctcctagggaggtagagaaggcatcgagctacaaaggtcagggcttagtccgggcccagatgagggatcattctggagccagcaccaggacccagcctgtgactggggtggggctcagccaggtgagggatccttctggagccagcaccagtgcccagcctgtgactggggtggggctcagcatgtgagtggggtcagggctcagtgtgtgatcaaggctaggttttagtctggggtcaagatcagggattagtttagaaaaagcatctggggccgggcgctgtggctcacgcctgtaatcccagcactttgggaggccaaggtgggcagatcacctgaggtcaagagttcatgaccagcctggccaacatggtgaaacttcatccctactaaaagtaaaaaaaaaattagctgggcgtggtggtgcacacctgtagtcccagctactcagggaggctgaggcaggagaatcacttgaacctaggaggcggaggttgcagtgagctaagattgcaccactgcaccccagcctgggcaacagagggagactccatctcaaaaaaaaaaaaaaaagaaaaagaaaaagcgtctgggaggctgggcatgatggctcatgcctgcaatcccagcactttgagaggctgaagcgagctgatttcttgagcccaggagttcaagagcagcctgggcaacgtggcaaaaccctgtctgtactaaaaatacaaaaattagccaggcgtggtggcatgtgcctatagtgccagctgtttaggaggctgagatgggagaatcgcttgagcccaggaggttgaggctgcagtgagctgtgttcatatcactgcactccagtctaggcaacacaacgagaccctgtcttaacaaaaaaaataaataaataaataaataaataaaaagaaaaaaagaaaagaaaatgcatcagagtttattttagggccagagtcaaggcgtctgtggcttttcatttgagactttaaaatgtttgtcctttggctaatatctaagtctgcccaataaatttctcttaaatgtcttccctcctctccatccccacgtctgtctctcacctggaccacttcaaccttttaactcctgccccatgtccagaccctgcctccctacccctacctgttctctgggggtcaggggagggactctctaaaacacagctccaggttttccagctgcctccatccctgtaaccagccaggaagtcactgtcccctgggactttgcataacttggagcagtcagaggccagggtggctggaagaagtttaggaaatgtcatttctcagccctcatttgcccgtgggtgtttctgtgcagcagttgtgcgttcccacctctttggagcacacatagatgcaaacaggctgccccgtttctgattgctgctggggtgatagggacttcctctacttcccatccgggaggagtctgtgttgttgcctaatcaatacctcccatccctcatcctgctcttgggaatcccactgtccacccacaatctaggatggtgggagcaatgtccactcctctcagtgagggcgggcaggatcgtttcttatttgtttgagccccagggtctgaggctcacaaatcttttgtacccgagcctctatttgaaggtcccctcaaattagtctaccctgcttttcccttacctggagttgctctcaacgaaatgacccgaggtctcagctgaggccacgtttggattcatagcatcgagcagccaggcatccttgcttctgcctctgagcattctgatccatcgcacccttgcctcctgactgtgccagttgtcactgctgggaggaaacagcttctttccccgcagagtcggtgaggcctccctgtccccagtgtaacattccaaggaaatgtgatcgacctccctggagatacagttgatgtcctgtcactgggctttggacattccctgccgccctcacccacctccttagtattgaacacagcgaggagcagatgctggtgggggcccctcctccatgccaagcagctgggagcccgggcagttgttttgagcacagtgaggtcatttccacactgtagacctcagatctcaaggaaccaagtttagccaggaaatcccccggggtgggtgcccggatgtggtgcctgccgaggtggtggggctggctgctgacgccccctggtggggtggagctgacgcccccttctcccggcctcagtacaagcaggtggagcagtacatgtcctttcacaagctcccgcccgacacccggcagcgcatccacgactactacgagcaccgctaccagggcaagatgttcgacgaggagagcatcctgggcgagctaagcgagcccctgcgggaggtgagctgtgtggcggcccggcgtggaggggagccaggccttcctggcagccagctcccctcaccacctccttcccgtgtcccaatccaccctgtccggcaggagatcatcaactttaactgtcggaagctggtggcctccatgccactgtttgccaatgcggaccccaacttcgtgacgtccatgctgaccaagctgcgtttcgaggtcttccagcctggggactacatcatccgggaaggcaccattggcaagaagatgtacttcatccagcatggcgtggtcagcgtgctcaccaagggcaacaaggagaccaagctggccgacggctcctactttggaggtgaggcagccctgggccctgggggacagggcagctgctcccaggggctggtttggggagataccgaggggacagaggcagtgagcacccttcttggccacagcctggagggaggtgtctgtgagcccagggtaggggtgtcttagtcagtctgggttcttgtaacaaaagtgccgcagactgggtggcttgtaaactgcagaaatgtatgtgtcatggttctggaggctggccatctgagctgagggggccagcatggtcggggctggtgagggccctcttctgggctgcactgctgacttctcgctgtgtcctcatgtggcagaaggaggatgagccagctccccggcctcctcctaaaaaggcactaattccatccacgagggctccaccctcgtgatctaatcacctccctaggccccacctccaaataccatcatgctgggattaggggttcaacatataaattttgggggaacacattcagtccagagcagagggtatgtcccaaagatgggaaagtctgtccagcccccatttggtggggaagaggcatccagtgtggccgcagtctgggggcagggccttgtgagcctgccaaggcttctgtgccaggcagtcagggccaaggtcagggtgggcagtccccctggcctgggcgggctgtgcatgcctcatcctgagtcctgatgctctggcagagatctgcctgctgacccggggccggcgcacagccagcgtgagggccgacacctactgccgcctctactcgctgagcgtggacaacttcaatgaggtgctggaggagtaccccatgatgcgaagggccttcgagaccgtggcgctggaccgcctggaccgcattggtgagggggaggggccacaggcggggcaggtggggggtgttgggggaggagggcagggctcctttatgcctaagccaggtctgcacctgatctccttccccgctctgccctgagtgcctgttcttgttctgtggcccaggcaagaagaactccatcctcctccacaaagtccagcacgacctcaactccggcgtcttcaactaccaggagaatgagatcatccagcagattgtgcagcatgaccgggagatggcccactgcgcgcaccgcgtccaggctgctgcctctgccaccccaacccccacgcccgtcatctggaccccgctgatccaggcaccactgcaggctgccgctgccaccacttctgtggccatagccctcacccaccaccctcgcctgcctgctgccatcttccgccctcccccaggatctgggctgggcaacctcggtgccgggcagacgccaaggcacctgaaacggctgcagtccctgatcccttctgcgctgggctccgcctcgcccgccagcagcccgtcccaggtggacacaccgtcttcatcctccttccacatccaacagctggctggattctctgcccccgctggactgagcccactcctgccctcatccagctcctccccaccccccggggcctgtggctccccctcggctcccacaccatcagctggcgtagccgccaccaccatagccgggtttggccacttccacaaggcgctgggtggctccctgtcctcctccgactctcccctgctcaccccgctgcagccaggcgcccgctccccgcaggctgcccagccatctcccgcgccacccggggcccggggaggcctgggactcccggagcacttcctgccacccccaccctcatccagatccccgtcatctagccccgggcagctgggccagcctcccggggagttgtccctaggtctggccactggcccactgagcacgccagagacacccccacggcagcctgagccgccgtcccttgtggcaggggcctctgggggggcttcccctgtaggctttactccccgaggaggtctcagcccccctggccacagcccaggccccccaagaaccttcccgagtgccccgccccgggcctctggctcccacggatccttgctcctgccacctgcatccagccccccaccaccccaggtcccccagcgccggggcacacccccgctcacccccggccgcctcacccaggacctcaagctcatctccgcgtctcagccagccctgcctcaggacggggcgcagactctccgcagagcctccccgcactcctcaggggagtccatggctgccttcccgctcttccccagggctgggggtggcagcgggggcagtgggagcagcgggggcctcggtccccctgggaggccctatggtgccatccccggccagcacgtcactctgcctcggaagacatcctcaggttctttgccaccccctctgtctttgtttggggcaagagccacctcttctggggggccccctctgactgctggaccccagagggaacctggggccaggcctgagccagtgcgctccaaactgccgtccaatctatgagctgggcccttccttccctcttctttcttcttttctctcccttccttcttccttcaggtttaactgtgattaggagatataccaataacagtaataattatttaaaaaaccacacacaccagaaaaacaaaagacagcagaaaataaccaggtattcttagagctatagatttttggtcacttgcttttatagactattttaatactcagcactagagggagggagggggagggaggagggagcaggcaggtcccaaatgcaaaagccagagaaaggcagatggggtctccggggctgggcaggggtgggagtggccagtgttggcggttcttagagcagatgtgtcattgtgttcatttagagaaacagctgccatcagcccgttagctgtaacttggagctccactctgcccccagaaaggggctgccctggggtgtgccctggggagcctcagaagcctgcgaccttgggagaaaagggccagggccctgagggcctagcattttttctactgtaaacgtagcaagatctgtatatgaatatgtatatgtatatgtatgtaagatgtgtatatgtatagctatgtagcgctctgtagagccatgtagatagccactcacatgtgcgcacacgtgtgcggtctagtttaatcccatgttgacaggatgcccaggtcaccttacacccagcaacccgccttggcccgcaggctgtgcactgcatggtctagggacgttctctctccagtcctcagggaagaggaccccaggacttcgcagcaggccccctctctccccatctctggtctcaaagccagtcccagcctgacctctcaccacacggaagtggaagactcccctttcctagggcctcaagcacacaccgccacctctggggccgtcagtttgcccatctgtacagtgggaggtgagcggaacttctgtttattgagtctgctctgtgccaagcactggtttcgcactttacacacattaactccttcagtttcacaaagaccatggggtgggtactttgattctccccatttagcagaggaagaaacagttttgggtaatttttccagaatcatgtaactaggagtggcagagtggggactgatttgaggttcgagtccacgcctccttgaggcccaagtctgtgttccttccatcagaaaactgtgttgaggggggctgaggtagatggtccccaagcatggtacagaaggaagacaccagattttggcagcagtcaggcctgggtttgaatcccagccctgccacttcttagctgtatgatcttgggcaagttatctgacctttctgtcacctcatttgtaaaatgggaataattatggtactgcctcacaaggacctatgaggaccagatgagaaaaatctatatgtgaaatgcccagcccagcgcctggcacataccatggtaggtgctcaataaaaaatcacatttcttctgcccctcatatgcccagcctattgctccagcaaactatgtgagagcccagggagctttggctgagggctccaagacttaaaatctcaggactcaggaggtggctgggcctccctaagggcccaaggaaggtgtgtggccagaggtgggtgggagccaggccttgagaagtgggaagacttcaacagggagagagggagggaatggtgggtgggatggagtgtatggtggggagattcctgaggtggatgtggagtggtggatcagggctttgggaggggatccccaggctgaggggtcagagggacggccttgggtgatagggtaagggattgtctgggcttagtcctggcaactaggagccataagcaggttccagattgcgggaacgagaaagcagctcagatgcctttggaggcaccatcctccctcctcccagatgggatcttgccagagccaaggtcaggggtctgcccctgcctatagggccagagcaggtatggctgcaatccccaaataatgagaagggctggtcccacattatccatccagaaccttccatgctccaagccagaatgttggcaagatcgggttttgccttgagctatcctgggatgtgagacaaaccgatttctccatagatgggctgcagggagtgggaggcagtactccaggagagaagtgggtgaaggttcctgggatcttaggtaaagactagacgccgcctagtactggtctctactgtgctggctcaggagttctgagaactggaaggacttagcctcaacctgagttctgcacacaccccttccccttaaggaaggcagctctgagaggcagcaggacttgatccaaacccacagtcttgtcctggaggcagcaggggtgaaggtggagggtccagggccatgaggagcccccttgccatcagagcctggcctaaccaccctcttctctacttacacacacatgcattttataatagctctgacccaacctggccactctgcagagactgggacagacaggtgcaggcaatgggccctcccacacccagtcacctacaaggaattttcaaatccacttttaaaacagaaaccggtaaatgcgccgtattgtatattttatttaaataaaaaaaattccagcagatgctaccttcttctaggggccagggataggggtgggggtgaggtcattgggaaatcctggagtcttgggaactcgggtgtggaaggcaggggacatggcccagagggcacttgtgtatgtgcaaacctatgcctgcaagagcatggagctgtgttctgtgcatagaggtgtgcacgggggatgtgcaaggcctggctatggacacaggtgtgcacgtgcttatggactggtgagaatcattgaggagggtgagagcgagtgggcatgtgtgctttgctagtggaggggagaaacgcaggagtgggggaggtgtgagaccct

SEQ ID NO: 16643 - DNA, 18075 bp, Human
ttctaaatggaaagctcttgagtttcaggatgtgttggttgggaagggaatacaggatagggaaataatccattaagcaatgactcagcacaggccataaaatcagaatcacctggagaacttgaacaatcccaacacctggggtccatccagaccaatcaaatcagaattcgtaggggtcaggcacaggcaccagtggtttggagagttgacggacacatgtcccatccatcattctcattcggctgccaaggtaggcatcgttgtcccattttgcatatgaggagactgaggctgaagtgaacctgcttctttccccatatcagttgaggacagcgatggggcagcggggaggcagtaaatactcctacaaggctgcctctaaagagagtcttataataacaacagctttattgtttgccatgattagaaaagtattcaaggtcattgcgaaatagtttttttttttctaggcagataattatataaaggcaaaaatggtgtgtgggggtgggggacaaggggagggagagcattaggacaaatacctaatgcacgcaaggcttaaaacctagatgatgggttgacaggtgcagcaaaccaccatggcacacgtatacctatgtaacaaacctgcacatcatgtatacctatgtaacaaacctgtacattctgcacacgtatcccagaacttaaagtgaaaaaaaaagtggtgtgtagaaaaatcacctgcaatctcagcatagttaacgcttagtacatttcagagagagagggtgacaggaaagggaggatgagagtgggtttaagacacaaggtcatattataaaatcagggcttctggaagtttagtcccaaaaccacacatctcataatcccctgcagtgcttgattaaaatgcaacatccctaaggccacagactcagactctggagaaagatccagaaaactgcccgtttaataaacatttgggcgattcttacggcctctaaagaccaagaaccactgctgcctagagctctgctctcttcattgaacaatacaagaggagtgtgtaggtagacacccaccacttccaacagcttaggagagcccttgagtatggattgatgtattaaaatttattgaatcacatgctgagattttcaccagctgcccgtggggatctgggcatttattcccatattgcactggctggctggaagccagcagcataaactccagggctgttctgtcaacccccaccagactcacccccctccaccagccccggcaggcttctccttccatctctctgaagcaacttactgatgggccctgccagccaatcacagccagaataacgtatgatgtcaccagcagccaatcagagctcctcgtcagcatatgcagaattctgtcattttactagggtgatgaaattcccaagcaacaccatccttttcagataagggcactgaggctgagagaggagctgaaacctacccggggtcaccacacacaggtggcaaggctgggaccagaaaccaggactgttgactgcagcccggtattcattctttccatagcccacagggctgtcaaagaccccagggcctagtcagaggctcctccttcctggagagttcctggcacagaagttgaagctcagcacagccccctaacccccaactctctctgcaaggcctcaggggtcagaacactggtggagcagatcctttagcctctggattttagggccatggtagagggggtgttgccctaaattccagccctggtctcagcccaacaccctccaagaagaaattagaggggccatggccaggctgtgctagccgttgcttctgagcagattacaagaagggactaagacaaggactcctttgtggaggtcctggcttagggagtcaagtgacggcggctcagcactcacgtgggcagtgccagcctctaagagtgggcaggggcactggccacagagtcccagggagtcccaccagcctagtcgccagaccttctgtgggatcatcggacccacctggaaccccacctgtgagtacaaggtgccccaggtggactgggctggggctttgaggccttcagggttggatggccatcttgcgtatttgtgtgggatatgcacacacaggcagcacatgcgcaggtgtgtgggcacctgtgtgtctgtgcaaatgccctgaggtgggaatgagcttggtgtgcatcaggcacagccagccagtgtggctgcagcaaaacacacagggaaagaatggagggggcatcaatcactgcttcagtaaatttttattgagcgccttctacgagaacacaagaggagcttccattctgaggaggaaacaggcaggaaacaggcagatatcctgtataatttcaagtagtgataagtgctctctagaaatatcaagcaaggtgaggagacacagagcaccggtggcagtggggctctatttccaggttggatggttgggaacatcctttctaaagggaacctggagtgggaaggaaccatgcaggtatctcaggaagagcttcctccaggcaggaagatcagcaggtggaaaggccctggagccaccattcagtaaacatcatttgagcatctctaccagctaggttccattatgggaatgggaatatggtggtggacagggctgcctggtcccttccatacttctcacactagggtggttgagagagcttgggagctaacgaacaagatgggctgagaacactgcctagcccagaggacctgagcttagtgtgtagacattgctgctgttactgcctttgtcattgtattatttatttatttatttatttatttttagacagagttttgctcttcttacccaggctggagtgcaatggcgtgatctcagctcactgcaacctccacctcctgggttcaagcgattctcctgcctcagcctcctgagtagctgggattacaggcacccgcaccacgcctggataatttttttgtatttttagtagagacagggtttcaccatgttggccaggctggtctcgaactcctgaccttaggtgatccacctgcctcgacttcccaaagtgctgggattataggcatgagccactgcgcccagtgattatagaaagttaaaggcacatggcaatgcacacgcctatctacgtcttccctgccaaagcaaagggcagcctctgggctcactttcttgcgtttctacttccaaaaggcagtcagaactggcagggccttggagaccacttcatccacctcctagggtccctatgggagagttgaggtccagagcagggaagggtcctgacaggctctgaccagggcctctgatccctacaaacccccaatcggtgtccctctctaccaggacccaagcccacctgctgcagcccactgcctggccatgaccatcacttacacaagccaagtggctaatgcccgcttaggctccttctcccgcctgctgctgtgctggcggggcagcatctacaagctgctatatggcgagttcttaatcttcctgctctgctactacatcatccgctttatttataggtaaagctggcagggctgggccggggggcctgggaaggatgtggctggggctgggagctcctgggggcctcccagccagctcaggggccagtgtaccagttcactacaagactaagctgagctcctgaccaggtcctgggcactggagctgaggctggggctgggggctggggagagaaaagaagtcagactgagaggctgctcaagccaggccagcagggttttagccacccttcctccaaccccaggaggacccctggagcccaggctttgtctggccccactcaactggcctgttttactgaatcccacacagactcataggcccacatagtacattaaaaaagagagagagagagagagagagagagagatggagtctcactgtgttgtccaggctggtctcgaactcctaggctcaagcaatccccctgccttagcctcccaaggggctgggattacaggtgtgagctactgcacttgaccaaccacatggtactttttttttttttttttttttttgagacagggtttcactccatcacccaggctggagtgcagtgggggcaatcttggctcactgtaacctctgcctcccaggtgcaagcgattctcctgccttagcctcctgagtagctggaattataggcacacaccaccacgcctggctaatttttttttttttctgtatttttagtagagacagggtttcatcatgttggccaggctggtcttgaacccctgacctcaagtgatccacccacctcggcctcccaaagtgctgggattacaggtgtcagccaccatgcacagcccacatggtacattttttaaaattattttttaattaaaatgtttatctaaggccagtagcagtgactcgcgtctgtaatcccagcactttgaggggccaaggtgcggggatcacttgagcctgggagttcagcgtgggcaacatagtgagaccccgtctctaccaaaaatttaaaaaattagctgggagtggtggcatttgcctgtggtcccagctacttgggaagctgaggtgtggggatggctgaagcctgtgaggtcgaggctgcagtgagctatgatcacaccactgcacttcagcctgagtgacaggctatctcaaaagcaaacaaaataatgtttatctaaacaataaaatataatcacagaatatatgatagcattttaaattgaaaaagcattaatgattacatggattgtaaaatatcaaatacatgaaattcttgtgttcttaataatgctagcaacaaggcacatttggtttttactagggcaccaaggtactttaaaaaaagttagggccagccacaggggctcacacctgtaatcccagcactttgggaggccaaggcaggaggatcacttgagcccaggagtttaggacctgagcaacatagggagatcctgatcttgtctctataaaaaattaaaaaattggctaggccctttggcttacacccgtaatcccagcactttgggaggccgaggcgggtggatcatgaggtcaggagttcaagaccagcctggccaacatagtgaacccaatctctactaaaaatacaaaaattagccgagtggggtggcacgcacctgtagttccagctactcaggaggatgaggccggagaatcgcttgagcccgggaggcagaggctgcagtgagccgagaccatgccattgcactccagcctaggtgacagagtgagactccgtctaaaaataaaataaaaatcaaaaaatgatctgggcatggtggcttatgcctgtagtcccacccagctcctcaggaggctgaagcgggaggattgcttcagcccaggaggttgaggctgcagtgagtcatgactgtgccgctgcccttgagcctgggtaacagagcaagaccctatctcaaaacaaacaaacaaacaaacaaacaaacaaaaaccaataaaccaaaaacatttatctaaacaataaaataaaggacagatataatcaccgaatatatgatagcattttaaattgaaaaagcactaatgactacaatggattataaaacatcaaatacataaaattcttaagttcctcctaataccaaatacaaagcacattggtctttggtttttacttgggcaccaatgcatgctgaaaaagagtcagacttcattttttagagtagttttaggttcacagcaaaattgagcagaaggtagagttctcatgtgtctctttgctcctccccctgcccccagcctccccactatcaacacccccacactacagtggtagatttattacaatccctgaacccacagtgacacatcactatcacccaaagttcatagcgtacagcagggttcactcttgggctgtacattccatgggtttggataaatgtgtaatgatgtctccaccatcacagcatcaggcagagtagtttcactgctctaacaaaatcctctgcctattcacccctctcattaaagccaaacactctgtttctttttttctttttagagacagtgtctcgctctgtcacccaggctgaagtgcaatggcaatcacagcccattgcagcctccaactcctgggctgaagtgatcctcctatctcagcctccagtggctacgactgcaggcatacggcaacggcacccaactaattttttgtagagatagggtcttgctatgttgcccaggctggtcttgaactcttggtcctgccttagcctcccagagctctgggattacaggcgtgaaccaccgtgcccgtcccaaacactctgtttcgacctgcttttaaacaactgacccttggatgcattcaaaggatcagggtgtctgaaactggcctctgcagcaggaccttccttcctacacatctcccagtggccagtgtgaggattctccccacaagaaaccactggagggggcctcctcctgtccgggtttggggctgtacaaggagcatcatggacctggctcaggcctcaggaggggccctgggctggggaaaatgtgggatagcatcgaggcagtcccactcctacccagggccgggctagacctggggacagtctcagccatctcctcgctgcgtccacacaattccacccccacccccacccccaggctggccctcacggaagaacaacagctgatgtttgagaaactgactctgtattgcgacagctacatccagctcatccccatttccttcgtgctgggtgagttcccccttctggctgttccgggtccctgtggccgcccaggctccagacaggccaggggaggatcacgaggagctgcggcaaggggctggggagggggcgggggaacgccagcggcaggtcggcgcctctctgtagggaaaggtgcggactgcagccagagaaactgaagttagacgttaggtaagacgtcctgccgttagcaatgaaaaccccattttctgagggaagcgctgacatcatggtccctggagcccctgcgcgggaggggagggggtctggcggatttctgggaccagcagggggacccccgggtgacagaacccttggggctctcgcgcctccatgcgaggctctgcctgcctctcgctcccgagcgccttccaggagggctgggggctaggcccgctcgcagcagaaagctggaggagccgaggcatcgccgggcgctgggccctgggctctggccgcagcctggcccctcgcccctcgccccccgcccctcctgcccaggcttctacgtgacgctggtcgtgacccgctggtggaaccagtacgagaacctgccgtggcccgaccgcctcatgagcctggtgtcgggcttcgtcgaaggcaaggacgagcaaggccggctgctgcggcgcacgctcatccgctacgccaacctgggcaacgtgctcatcctgcgcagcgtcagcaccgcagtctacaagcgcttccccagcgcccagcacctggtgcaagcaggtgggcggaccgggagcaacggggaggcaccgggcagagccaggggccgagatgggcgcggcaggaatggaagatgggtggagccaaagtcccccggactcgggggattgggtggagccaggagtggggtgtggtcaagatttgggggtccaattgggcgggacagagtcgggtgtctgaaggtggggcgaggccaggagcccaccctccgagagtaggagtctgaggcagggctaaggacccttgagggataatggaaagaagggtgacggcttgggaactggtgaggtactagggtctacttccctctgcccttgcccctcttgatctccggtttccactctggaggtatgggacattggtctctgacaccccctcagcctggcctgacctggtcctggttaataagacagacccaggctaggcgtggtggctctcgcctgtaatcccagtgctttaggaggcaaaggtgggaagatcgcttgagcccagctgtttgagacgcccctgagcaacatagcgagacccccatctctacaaaaacattaaaaattagcagggcatggtggcgtgtgcctgtagtctgaggctgagtatcgggaggctgaggcaggaggatcacttgagcccagcagttccaggctgcagtgcgctaagatcgcaccgctgcactccaacctcggtgacagagccagaccctttctctggaaataaataaataccctgcccacatgctcagcccagaacagcacctagtaggtgctcagaaatttttttgttgttgaaagaaagaggatggcaaaggagtgctgaggttcctataggtcagcaggtgccggccatcccttctgcaggttctcccacccaccgccttcttcactccactctgcaggctttatgactccggcagaacacaagcagttggagaaactgagcctaccacacaacatgttctgggtgccctgggtgtggtttgccaacctgtcaatgaaggcgtggcttggaggtcgaatccgggaccctatcctgctccagagcctgctgaacgtgagcccactgtacagacagggctgccgcagagtgggaagggttgtggtccacaggaaacaaggtttcctacaaagagaagccttgggcccctgagggtcttccgagagccggaggtggggttgcagaatcttttccaacagcaatccacagcccgaggtggtcccttctcagaggcccctccctcttctccaagtctgtgaggtcctggttcccttttgatagatgaggaagctgagacacaaagaggtttagtgagcttcccatggccacacagccaggaatggaccataggtaccaggccctggtacctggagaagaggtgggggcgagcccagggtgggggcaggtggtgttcagaaccccatccccctcttctgccccccaggagatgaacaccttgcgtactcagtgtggacacctgtatgcctacgactggattagtatcccactggtgtatacacaggtgaggactaggctggtgaggctgcccttttgggaaactgaggctagaaggaccaaggaagcagctggggtgggaagggctcacctagaggctaagtggctcccctgggagttgggtccacactttgaagttgggtctggactttgaagtgccaagttctaagagtccaggctcctgcctggcccagtccagtagaggcaatgtgattatccccatattaaagagaggttggccgggcacagtggctcatgcctgtaatcccagcactttgggaagctgaggcaggtggatcacctgaggtcaggagttcgagaccagcctggccaacatggtgaaaccccatctctactgaaaatacagaattagctgtgtggtggtgcacgcctgtaatcccagctacttgggaggctgaggcaggagaatcgcttgaacccgggaggtggaggttgcagtgagctgagatcatgccactgcactccagcctgggcgacacagcaagactctgtctcaaacaaacaaacaaacaaacaaacaaacaaaggggttaacagagcccctaagtcacataagtgtgcaagtcagaacaaggccttggtctcctgtctcagactcccagcccctggagcatcctgatttcagggttcccacctagccctttgctaccacatcctcctcctcctcctcctcctcccaggtggtgactgtggcggtgtacagcttcttcctgacttgtctagttgggcggcagtttctgaacccagccaaggcctaccctggccatgagctggacctcgttgtgcccgtcttcacgttcctgcagttcttcttctatgttggctggctgaaggtgggcctctccagggccctgctgggctggaggcatggccagaggggtcatggccagcagctgcctgagacgaggatgcagtgtcaggaaaggaaggtctcacgggtagaaagcagccaggcgtggtggcgcacacctgtaatcccagctactcgggaggctgaggcaggagaatcgcttgaacccgggaggcggaggttgtggtgagttgagatcgtgccactgcactccagcctgggcaaaagaatgaaactctatctcaaaaacaacaacaacaacaaaacaaagccctaaggttcagaagcccctgccctttagaaggcagagcggcaccacctctccttattcaagatgcctgttgggctgtcttgttcctcacctcaagtggcttgtccaggtattccctcccaccacagccaatactccgaacagatgttctgaatcacacagttttctctccacctctttatctttccttccttctgttgcccacccactctctctcccttcctaccttcctttattttttggtaatgggggtgtaagtctctgtctctgcccttcctgtcactgtgacacacacacacacacacacacacacacacacacacacacacacattcctattcctctaaattccccctgcccccccagttatctttggtttctgcagatcaaaacaaatcacacttttatgcttgaaattctccagggtgccccagtggcctgcaagatgtcccctggacccctaaggcagacgcgtgtcacctcttcggggctttgttagggcattttagaggttgctatccaggaatctgcccacctagactgccctttagttcagcccagcttcagtatatatctctgttgcatgaatgaataaaattatgcaactccaggtaagatacatgaggtgagataaaggcagtgactcagccgagtgatacactcagggacagctgtgggtgttcagggaaggactggctcagaagagttagaggggctgtgtccagaagtgtgtgggtgcccacaagtgtggggggctggagccctaaactctgcctttgaagacagtggtcaggcaggaagggcttcatggggtgtggaaatagcagcagctgaggtttaaagggggaagctggctttgaggagttctgcctgagggtttacagagcctcacctgtccccaaggtggcagagcagctcatcaacccctttggagaggatgatgatgattttgagaccaactggattgtcgacaggaatttgcaggtatggggagagggagagaaaccataccatggaccttccccaaagtggacccaaagagaggaccccactgttctgtagggaggcctcacagtgaatgatcaacccttcccctcctccctcctgcagccagtcattcactcacaggattctcacctcaatctttgaggctgcaggcaggcacccatctccccatttcacaggcagggaaactgaggtccagagagagggagagattcctccaagtcatcaggcacatacaaggtcctgcctgggatgatctttctgtgggacttcttctgtccctggtgaccaggtgtccctgttggctgtggatgagatgcaccaggacctgcctcggatggagccggacatgtactggaataagcccgagccacagcccccctacacagctgcttccgcccagttccgtcgagcctcctttatgggctccaccttcaacatcaggtgtggccagagccagggggctgggtgggaagcccctcctagtgcaggggtctgcctaggaacttagaatagcactagttaatgcatacaggttgcttcagtaagtgtcaggcactgtactatgctctttataaacattaactatttttttcctcccaataattctggtttgttatcccaagttttcagataattaaagtacaggttcagagagagtaagttgtccaaggccacatagctaccaaatggtgcatttgctactcgaaggacagcctatgatcagtgatgcagtggaacgttaggacctggctcttgtcatccagaactatgttttcttttctttttgagacagtatctcgctctgtcgcccaggttggagcgcagtggcgtgatcttggctcactgcaacctccgcctcctgggttcaagtgattctcctgcttcagcctccccagtagctgggattacaggtgcccacaaccacaactggctaatttttgtacttttagtagagatgaggtttcaccatgttggccaggctggtctccaactcctgaccagtaatctgcccgctttggcctcccaaaatgctggaattataggtgtcaaaactatgttttctgataagctacgatgcttggatgggaagtggaagtggggttccctgggatgggggaggggcagcaaagtcccagcaggcagccaggccatcacaggtacctcctgaattgactttgtcctaccgagtaaagggctcaggccacccacagcagccagacttatccccacatggtcccacttccctgattccatctgaatccctcttgagctgcagtgggctgaagggctatcccagctggtcctttctccccaggacaacagagttgaaagtgccttggagagtgttgggcacatgtcagggttcatactcaagggtttcttccacggtatccagtgctgttctcgcttgttcttttctttttttttttttaaacggagtttcactcttgttgcccagagctggagtgcagtggcataatctcggctcactgcaacctccgcctcccagattcaagcaattctcctgcctcagcctcctgagtagctgggattataggtgccagccaccaagcccggctaatttttgtatttttagtagagacagtttcaccatgttggccaggctggtctcgaactcctgacctcaggtgatccaccctcctcagcctcccaaagtgctgggattacatgtgtgagccactgtgcctggctgcttgttcttttaagaaccaaatatcctactagactgcaatcgagtttaactacagtctatagatagtgtgaggaagggttgggaaggtgatcaaatgaaggctggaggcttgcttaggtcagaaacatttctggaggatgactttgagccctacatggtctgtaccccagcagctgaaggttgttgaggggtggggagggctgaaaacagaacgataaagcatagaccttgtctccaaggaatgcacaatttatggagggagctcaaacccaagtctcaaactctggatacaaggtacaaagtactggatgtccagaaaagggacagaacatggaacacagtcatctttgtctgcctgggaggcggcttccagctgggtctggagctgagccatggaacatgggaagaatctgaacttgggcaagggcaggccatactctctggtagataagctttcccttgcagggtaaaggtctggggctcccgggatgcctgttgctaggaagtcaaatttctctttgtggatgtcactcccagttggaaccacaaattcctggcattgcccagagtcactcatgggcctcatctgaaccactcatgccagggcaccagtgtttctgactgcctggagtgaggggttttacaggggaagtgaatgatgaggaggcctttacacgccaggcggggtggttgcgggggttggatgttaactctggtcaagagggaatcaacaaacagtgaggtgagctgggcctggagggatcaccgggaggtacaggacagatcaggagagaggtgagagctggggcatggtgaggaagacggtgtggccttggcttgggccaactgagagagaggagcgggggtaagggagaagtaaggccaggtgttggtcctttgtccactggctcagccctgcatctcctgtttctttccagcctgaacaaagaggagatggagttccagcccaatcaggaggacgaggaggatgctcacgctggcatcattggccgcttcctaggcctgcagtcccatgatcaccatcctcccagggcaaactcaaggaccaaactactgtggcccaagagggaatcccttctccacgagggcctgcccaaaaaccacaaggcagccaaacagaacgttaggggccaggaagacaacaaggcctggaagcttaaggctgtggacgccttcaagtctgccccactgtatcagaggccaggctactacagtgccccacagacgcccctcagccccactcccatgttcttccccctagaaccatcagcgccgtcaaagcttcacagtgtcacaggcatagacaccaaagacaaaagcttaaagactgtgagttctggggccaagaaaagttttgaattgctctcagagagcgatggggccttgatggagcacccagaagtatctcaagtgaggaggaaaactgtggagtttaacctgacggatatgccagagatccccgaaaatcacctcaaagaacctttggaacaatcaccaaccaacatacacactacactcaaagatcacatggatccttattgggccttggaaaacaggtctgtcctccacctgaaccaggggcactgcattgccctgtgccccaccccagcttcccttgctctgagcctacccttcctccacaatttcctagggttccatcactgccagagcacactggacctacgcccagcactggcttggggtatatacttggccaccttcacagggatcctagggaagtgttcgggaccttttctcacttcaccctggtatcacccggaagacttcttgggaccaggtgaaggaagatgaggttgtgctgaccagaatgctgctggagaactgccccagggctgacaggccaggcttagctgagcagatgttatcactggccccaacttactttgagcaagggtggctgacccaaaaccatgaggtggcagtcagctggatgacagatgaacacttcccccataactatttagggtagtacccaagcactacaggaaagggtggcaggaactgcctcactcctaggaactggtagatggtgaggttgagggtgtccagcgcccttaggtcattttctcactgcctgggaacctcaccaaaatacttcttgcttccttggggtcagcccaaagctgtcacaaaatcagatatttccctttattccagatttcctggacactttcacccaattataaacaccccacttcagccccaatcacgtgggaggaagtgtaacttcccttttctggattctcaagcagttactttcacggtcagaacacgcagctattatgattgaaaacttaaaagggcaacaatttcagtcttgcttctagggctagacaggaacttggcaaacatctgtggcctgttcagcaaaggatgttaatatttaagaatcttgtcttgggctgggtgtggaggcaagtggatcacaggaggtcaggagtttgagaccaacctggccaacatgatgaaaccccatctctaccaaaaaaaatacaaatcagctgggcgtcgtggtgtgcctgtagtcccaacgcaggaggttgaggggagaattgcttgaacccaggaggtggtggttgcagtgagattgagcaactgcaatccagcctgggcgacggagtgagactgtctcaaaaaaaaaaaaaaaaggatcgtctcaacctttgccctcctactgcaacattttggtatttgaaatgaaggtaccttccatacttatgctgttaatactttcattctcactagggatgaagcacattcctaacctgcttcctaatggggatgcttcgccagccaggtcctcacctgtgtgtacaccagcaggacactgatccagtcacagccatacagctgtccacactgaagaacatgtcctacaacagcctgaatcaaatggttagcttaatagataaaaatcccagactacttcagcctttaatgccttttattcataaaaactgtgaaagctagactgaaccattggaaacatttaactcagactctggattcagagtcgggaacccttagttctatctgaatccaagacagccacaccttagtatactgcccaaactaatgagtttaataaatacaaatactcgtttctttttgattagtgtgattagaactgaacaacggcacttaaggaatctggaagatagcctggatagatttctgattcatcccaagacctcaaagacaacacctgggtaccaaatttctttatttgaaggaatggtacaaatcaaagaacttaagtggatgttttggtacaacttatagaaaaggtaaaggaaaccccaacatgcatgcactgccttggtgaccagggaagtcaccccacggctatggggaaattagcccgaggcttagctttcattatcactgtctcccagggtgtgcttgtcaaagagatattccgccaagccagattcgggcgctcccatcttgcgcaagttggtcacgtggtcacccaattctttgatggctttcacctgctcattcaggtaatgtgtctcaatgaagtcacacaactgcaaaacaatggggaagacagttagtgggcagctttcccaatccctaaggcaaatgatttcctccatttatttcctggggttccaatactcacatgggggtcatttttgtcagtggccagtttgtgcagttccagtagtgactgattcacatttttttccaaatgtaatgcacactccattgcattcagcccgctctcccagtcatcacagtctggtttctgaatgagaataggttaatgcatctctaccaactaacctagaagtcagcaagcccatcatctctaaccaccacgttttggcaaaagggacattactatttgcctaatttagtttagatggtaagcctaaaaaagcacaaaaggcaaaagcccagtgtatcatcactttataagggcaattgctagtttaagtgatttctgatacccgaacactgccagatgatgaagtatgacacccctaggatcttttgttcaccttgatatcctgaaggaagattcggccacctcgttggttctgcagcttcatcagtttctcagcatgttccctctcctcatgagattggtgaagaaagtatttggcaaagttcttcaaagccacatcatcgcggtcaaagtagtaagactgaaaggggaacactgaatgtgttatactagggatccccagagacaggtagctgtgacgatctacagggaggcaagatggtctcgtcagcctaggcttcctttctcaaagcacagcatgaaggaatcagtgcctaaggagactggggggcagatgagctactggattgaacccaagagtaatgtttctattctaaaatagaaaactgaaacttgatccttgaaacttaacttcaaggaacctttaggatattatgggcattgcctggggcaatgtcttaaggatctgtattactgcacagaaaacttacagccagtgtcagaattcattgtctgatgagagggcgctggagtactgaccctgcacttagtccttttctcctccctgctcctgtattaaccatgttaaagcatggttaaaactgagctcaggagtctgccagctgtaccacatatttatttataaaattaaaaacccctgctgggtgcggtggctcagcctgtaatcccagcactttgggaggccgaggcaggcggatcacgaggtcagcagatcgagaccatcctggtcaacatggtgaaaccccgtctctactaaaaataaaaaaaaatagctgggcgtggtggcgtgcgcctgtaattccagctactcaggagcctgaggtaagagaatcacttgaacccaggaggcggaggctgcagtgagccgagatcgcgccactgcactccagcctgggcgacagagcgagactctgtctctcacacacacacacaaattaaaaacccccatgcaaggtggcaaatgtggacagtatgttgatgtaaacatacttttataatagttatatcacaaaaatttgattttcagttttagacatttgatgtagtcaagtgtttgtgaaaggcagtgacagtcacagaaatacaggcctgt

SEQ ID NO: 16644 - DNA, 7609 bp, Human
acctctttttatggaacacaaccctgcccgatcttgcccctattctccaccctaaccagcatcccccaacataaactgtactttccaggccaacattctttctttctttcttttttttttttttttttgagacggagttttgttttgtcttccaggctggagtgcaaaggcgcgatctcggctcactgcaacctccgcctcccaggttcaagcgattctcctgcctcagcctccagaatagctaggattacaggcgcatgccaccacgcccggctaatttttgtattttcagtagagaagggtttagccatgttagttagccaggctgatctccaactccgacctcaagtgatccgcccgcctcggcctcccaaaatgctgggattacaggcatgagccaccgcgcccagccccaggcaacatattttcttaaggcagctttaacaggccatgcatttccacatttccacacctttgcatatgctgttcactctgctccaaattcccttccctgtttctctcccgcacttcaccttccttttaactttttcttcaaactcagctcacgtgtcttgcttagggagggcttccccgacctcctcctatcccagactgggtaaggtactcctggtctagcagcatccttctgtttaccttattcttgtagctctagcaccactaaaacgtttttcctgtaaataacataggtgcatttttaaatgaaaccgtgaacaagaaatcaccctaattccgtcggcaatttattttagtatttcagtagagttgcttttttaaactaaggtttggaagtctagcttccagctgcaggtttgtgagcatcctgaaattcagttcttccaccgatgcgtcaaaagacgcgacagaacagtggacctcgaagccaggacctaggtaagggcagggcctagctctagctctgccacccataaattcacatccaccctgtgcctgggactcagcttagccacacacaccggccccacccctccggggtctctttcacctgtcacccgccattaaccccgtcagcttctctccaatgacaccccagggttgtcctacagggccaccgaagcctgaagctcctgtgagtggggccgataagaggccattttgaaaagtcctcagcatgggcttcgcctttagatccacgtcgtttctcctttctaacccgagatgtgtcccttgggtgcgaagcgacaccagcgattctctcggaggccccggtggctcacccccacgactccccggggaggcggtccccatccctagggaaacccggcccgcccagcctttgttgcagaaaccgcacacggagccatatttgctttcagccaaaggcagacgtggtcggaggagtcggaagggcaggggcggacccgaaacccgccgtgcgccccacttctccatcgcgctccttcctggactctgaggaagagaaaatgcgctcgaccacctaaggaccgcgtctccaccttccaccttcccaatcatctgcagcttcccaatctgcagcttcccaatctgcagcaaggtgtcacaagggcttctccgcagctatgatttctaacaccatgccccgggccaggagcctcagggtgcccgttcgggaaaatgggagccgaatcaggatcaccccatgcgcccccgcacccttcccccgccggttccaacgcccgggcgcccctagaccggggggggggttctgaggtggacttcctgcgcctcctcgcagcttccctccaactccactaaacgggcacagagacgccaccgctgtcccagaggcagtcggctaccggtccccgctcccgagctccgccagagcgcgcgagggcctccagcggccgcccctcccccacagcaggggcggggtcccgcgcccaccggaaggagcgggctcggggcgggcggcgctgattggccggggcgggcctgacgccgacgcggctataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatggtgagcgcgggcgggcctaagcggtggcgggggccgggcgcggttcccggggcgcgcgctggggcgggccgggggtgtggccacccgcgggctctcccgcctccctgcgcccttctggaaaatggaggctgctcgaggtttccgaggacttctctggcgcagaaagtcggggcagctggttcttctcggctgtaccctgagaatgctccctcctaggccagggccgcctctgcacacccttcttttttaaggagaccttggtgtcctgaaatcctggggttgcaagactgccagcctgtgtgatcaatcctgcggttaggaaggtggagttttgctttcccatcttttcctctgcctccggcatttggccctaaatgccagcgttttttgcttaggtatccagctcccgtccgcctgtgtgtggcggagctgctgggtaacggtgtcgaatagcaaaccttgggggctggcgggaggtggcttatcttgtgggtagatccctctcgagcagccgtatccacctctcggctctgcttatctctaagtcccacttgctttgaagcatatctctaggaatcgccccttctgcagtcaccgaagtgtcacctgaccttgcgcctaggggacctaatttatcttttatgtatcttactgtaagaggtgtggagtttggcctactaattgaacccccagttcttggataaagtccaccgacagttactgggcaagaaatttttcagtgatcagtggaatcaattttcccaaatcttggtcttaggcagtgtcgtgggagtcttccttagaattgccttgtgattgtccaaactatcccaagaataaatgtgttccaaatggatttgaaaacaggcctgtatttctgtgactgtcactgcctttcacaaacacttgactacatcaaatgtctaaaactgaaaatcaaatttttgtgatataactattataaaagtatgtttacatcaacatactgtccacatttgccaccttgcatgggggtttttaatttgtgtgtgtgtgtgagagacagagtctcgctctgtcgcccaggctggagtgcagtggcgcgatctcggctcactgcagcctccgcctcctgggttcaagtgattctcttacctcaggctcctgagtagctggaattacaggcgcacgccaccacgcccagctatttttttttatttttagtagagacggggtttcaccatgttgaccaggatggtctcgatctgctgacctcgtgatccgcctgcctcggcctcccaaagtgctgggattacaggctgagccaccgcacccagcaggggtttttaattttataaataaatatgtggtacagctggcagactcctgagctcagttttaaccatgctttaacatggttaatacaggagcagggaggagaaaaggactaagtgcagggtcagtactccagcgccctctcatcagacaatgaattctgacactggctgtaagttttctgtgcagtaatacagatccttaagacattgccccaggcaatgcccataatatcctaaaggttccttgaagttaagtttcaaggatcaagtttcagttttctattttagaatagaaacattactcttgggttcaatccagtagctcatctgccccccagtctccttaggcactgattccttcatgctgtgctttgagaaaggaagcctaggctgacgagaccatcttgcctccctgtagatcgtcacagctacctgtctctggggatccctagtataacacattcagtgttcccctttcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaaggtgaacaaaagatcctaggggtgtcatacttcatcatctggcagtgttcgggtatcagaaatcacttaaactagcaattgcccttataaagtgatgatacactgggcttttgccttttgtgcttttttaggcttaccatctaaactaaattaggcaaatagtaatgtcccttttgccaaaacgtggtggttagagatgatgggcttgctgacttctaggttagttggtagagatgcattaacctattctcattcagaaaccagactgtgatgactgggagagcgggctgaatgcaatggagtgtgcattacatttggaaaaaaatgtgaatcagtcactactggaactgcacaaactggccactgacaaaaatgacccccatgtgagtattggaaccccaggaaataaatggaggaaatcatttgccttagggattgggaaagctgcccactaactgtcttccccattgttttgcagttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggtgttgtctttgaggtcttgggatgaatcagaaatctatccaggctatcttccagattccttaagtgccgttgttcagttctaatcacactaatcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcattaaaggctgaagtagtctgggatttttatctattaagctaaccatttgattcaggctgttgtaggacatgttcttcagtgtggacagctgtatggctgtgactggatcagtgtcctgctggtgtacacacaggtgaggacctggctggcgaagcatccccattaggaagcaggttaggaatgtgcttcatccctagtgagaatgaaagtattaacagcataagtatggaaggtaccttcatttcaaataccaaaatgttgcagtaggagggcaaaggttgagacgatccttttttttttttttttgagacagtctcactccgtcgcccaggctggattgcagttgctcaatctcactgcaaccaccacctcctgggttcaagcaattctcccctcaacctcctgcgttgggactacaggcacaccacgacgcccagctgatttgtattttttttggtagagatggggtttcatcatgttggccaggttggtctcaaactcctgacctcctgtgatccacttgcctccacacccagcccaagacaagattcttaaatattaacatcctttgctgaacaggccacagatgtttgccaagttcctgtctagccctagaagcaagactgaaattgttgcccttttaagttttcaatcataatagctgcgtgttctgaccgtgaaagtaactgcttgagaatccagaaaagggaagttacacttcctcccacgtgattggggctgaagtggggtgtttataattgggtgaaagtgtccaggaaatctggaataaagggaaatatctgattttgtgacagctttgggctgaccccaaggaagcaagaagtattttggtgaggttcccaggcagtgagaaaatgacctaagggcgctggacaccctcaacctcaccatctaccagttcctaggagtgaggcagttcctgccaccctttcctgtagtgcttgggtactaccctaaatagttatgggggaagtgttcatctgtcatccagctgactgccacctcatggttttgggtcagccacccttgctcaaagtaagttggggccagtgataacatctgctcagctaagcctggcctgtcagccctggggcagttctccagcagcattctggtcagcacaacctcatcttccttcacctggtcccaagaagtcttccgggtgataccagggtgaagtgagaaaaggtcccgaacacttccctaggatccctgtgaaggtggccaagtatataccccaagccagtgctgggcgtaggtccagtgtgctctggcagtgatggaaccctaggaaattgtggaggaagggtaggctcagagcaagggaagctggggtggggcacagggcaatgcagtgcccctggttcaggtggaggacagacctgttttccaaggcccaataaggatccatgtgatctttgagtgtagtgtgtatgttggttggtgattgttccaaaggttctttgaggtgattttcggggatctctggcatatccgtcaggttaaactccacagttttcctcctcacttgagatacttctgggtgctccatcaaggccccatcgctctctgagagcaattcaaaacttttcttggccccagaactcacagtctttaagcttttgtctttggtgtctatgcctgtgacactgtgaagctttgacggcgctgatggttctagggggaagaacatgggagtggggctgaggggcgtctgtggggcactgtagtagcctggcctctgatacagtggggcagacttgaaggcgtccacagccttaagcttccaggccttgttgtcttcctggcccctaacgttctgtttggctgccttgtggtttttgggcaggccctcgtggagaagggattccctcttgggccacagtagtttggtccttgagtttgccctgggaggatggtgatcatgggactgcaggcctaggaagcggccaatgatgccagcgtgagcatcctcctcgtcctcctgattgggctggaactccatctcctctttgttcaggctggaaagaaacaggagatgcagggctgagccagtggacaaaggaccaacacctggccttacttctcccttacccccgctcctctctctcagttggcccaagccaaggccacaccgtcttcctcaccatgccccagctctcacctctctcctgatctgtcctgtacctcccggtgatccctccaggcccagctcacctcactgtttgttgattccctcttgaccagagtt

SEQ ID NO: 16645 - DNA, 8074 bp, Human
gagcctggtgctgccgtgaaacagaggctgattttagcccggaaatgtagctgcagatcaatggcccttattagcattttctgaggccaataatctgaccactatgaaaacgtgactaaaggtacgaactctctgcctgagaaaaaccacatacaagaaaaagtttgcctacaatttccggagctttgtggaccagtgtctatagacaccaagctgagaacccccgctataagtcactgactggtggtacccagatctcaatatcttttttttttgacggagtctcattttttggacggcgtctcactctgtcgcccgggctggagggcagtggcacgatctcggctcactgcaacctctgcctcccgggttctagagattctcatacctcagcctctcgagtagctgggactataggattacaggtgcgcaccaccacatctaatttttgtatttttagtagagatggggttttgccatgctggccaggatggtcttgaattcctgacctcaggtgatctgcctgcctcggcctcccaaagtactgagattacaggtgtgagttgccgcgcccaggctcaatttttttttttttccagacagtcttgctctatcgcccaggctggagtgcctggagtgcagtggtgccaactcggctcactgcaagctccgccttctgggttcaagtgattatcctgcctcagcctcccgagcagctgggattacaggcgtgaaccaccatgcccggctaattttttgtatttttaggagagacagggtttcaccttgctggccaggctggtcttgaacttctgacctcctgatccgctcgcctcagcctcccaaagtgctgggattacaggagtgaaccaccgcgcctggccctcaatttctaattcagtattttcctcactacctatgctattatggaatcttgtgagctatggtcaagacattcaagttctggttctgagtaatctgagtctgagtaaagcgactgtaatatctatttcacagaactgaaaaataagaaagatgatgaatcaaagcatctagtgcctagcagggagtattttgctcaacaggtatttgcttccttcctaaggctgtagggaagatgatgagataatgtcttttatgaaagagggctgtaaacgtaaagatctgtacaaatgttaacttcattgtcaccggtcagccaatgcttctaaaatccagaacataacaactctagagaagtaaactgcccccattgttctgagacactggaattcaattcagtaaacaatcacggcccccttcccccaaaatgataaagacaatcactgccatttattgagcttccaattacgggccctctgtttggcactgagaatacaaagatgaatagacatcatcccagagctagatgcgcgtcagacggtggtcactaggaggcgtggccgaaaacaaagaagtccatggaacgtggccagagatctgtacagaggctgtgggcgctcctaggaaagtctggccaagtgcctgagagttggaagtgcttcaccaataaacatttgcccagggcattgtaggatgggcacgggttcggcagaagaactttccaaataaagataacacaccaccgataacagagatatacaaactggaaggtattcaaaattcgccccacgcctctcgcccttagaaatcgcgagctgagaaacctaaggagttcatggcaaggggcttcccccttccccacccttcagcccaagccggaggttccaggagcgtctagccctctggatctccggcgtctgaggagataagcgcggtgtgggtcagaccccgaggggtcctcgcatctccgtctggaactcccctcaacgctctcaccattttgccccgcgaaggctaatccgccgctccgccaccggaagaacacgtcggcaggagcaggcgcctagcacaaccggaaaaggaagtgcctccggcgcaagtggcattgagggacttgtagtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccaggtgagaccccatgggaagcgcctccgggagcgacggggtccgcttggcgctgggggccgtggggagccggggtctggagtgcgcgggattcgcagtcaagaggtcccgccacttttccccctgtgagccttgggccagtcgcgtaagctccgagcctctctttcctccattgtagaaaagcggtaataagttccaccttatggggtcgtgttgtatttttcctaagaccttggacgagaaacatttctgacacttgagttgtttaggcccctttcctgcctacctgtctgtgggacgccgtgaggggatcaagggctacatggtctggtcctcagtccacactccagcagcgcggccggcttgaggcaagagccgaagggttgaacaggcctggagaggggacattagaggtttctgtctgttgtctcagttaaccctggcagcagccctgagagacaggcatggtaatcgttcttcttctgtagacgagaaaataaacctcagtggcttggtaatgtcacacggatggtaaatgccgcgcctagattcaaggccagagcttttgccgctgcagttcacaggggaattattcatattaatcaaatgaataattcattgtcaattaattattaattgattaataatccagggatggacctggaaggacgcgtgagaggatggcgagaggagggcacagctaaggaaaagtgggaaaaggcgggccttattccagctttctgttgagatcccagaatgtagggttaggttgggaaccagaacatgaaagatcgtgatgccatgctgaagtgtttggactgaattagaaggaagaattgaacagtcattgatgctctagaaagaaccctgtgaagaaagagtgggaacaatgaaaaggcctgatggagtctttcgtttcttctttctcttttcttttgtcttcttttcttttcttgacagggtcttgctctgttgcccaggctggagtgtggtggcacaatcatagctcactgtagcctggaactcctgggctcatgtgatcctcccaccacggcctcccaaagtgctgggattactgcccagagcctctgtgcctggccccagtagaatatttcttggagtattggacacataccaacagtgggcacaagatgagttttttatttttttgagacggagtctcactctcttgctaggctggagtgcagcggcacaatctcggctcactgcattctctgcctcctgggttcaagcgattctcctgcctcagcctcccgagtagctgggattacaggtgcacaccaccacacccagctaattttttttttttttgtatttttagtagagacagggtttcaccgtgttggccaggatggcaagatgattttaaattgcaccccctaaaaatcctttttaatagttatacatttaatacatattaaaatataactaatagaacacaaatattattgcttatgagttttccagtttagttttttaaaaaaaattctaagtgaatgaaagtacgggttttagttggaagtagcaaaaatcgtgagggtgatttgggaaacactgctatctgggaaacactgaactctgaagtgcaatactcttttgagcccagtgactacagcatgccagacccctaaatcaggacctggggaggagccatggagttaacatttcagactgagtggtggcgagaaaacgcaaagggaaagacttgaaactctagcaacattataataaaagtagaaactcttatgtgctgaggcgatgatgaagagagtttagagaagcttgtgagaaagccacatcacctccattcagatatgtttgcaatcctttttcaaggctgccttattagtcagggttctccagagactcaaaacaaatcagatctgtttgtttagctggtgtatttgcctgtctttcaggtctgccattatggtccctggactcctcaagccaggccaagcatcctggccttctgtggtccttgatggagacctatgttgcaggttttttttgtgtaataaataatgctgctaccttagaatatcaacagtatcttatttctctaagcacgtggttcaatttctggtactcgttgagccttactattgagtaaattctcctgctagactgagttttttgagaatggggaccttgttcatctttttatctttagcagtgctgacatggtgtcctttttgttgtgtggaatttagttgaaggcatgaagttggtgagataacaccagttataacctttctcctttcctccgtctctgacttgcctttcttttttagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggatacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaccaaaatgtcatgttctttgagaacatttgaaaatatcccaagtgaccatggctccaaatagctttccttttcactcttaacatgctgtaattgcacttgattaacaatgggtggtttgagagtggccacaagatggcaccatgctccataaaatggccatagcagctagatggaacttcagccattaggaggaggatgttttgtttattttattttgctgggagaggagttttaatacgttgaatagatttctagtctctcactccatgagatcaaaggagtgcctttaagaaagcctcacaatttagatcaactacctcataacatccaagcatttactttgccactacttgtaaactgaaagctgccattcagaaaccattttcttgttccttttgtaacatcaaatccaagatactgtttcccatagagatggcatgtttttgagctttgaaagttttataatcctgataaagcttggcccatttgaatgtctgacgttttagcattcctgtcagggccatttgaagttaacagggacacttatgtaactgtccgaaatttaagctggcaatgtcttgacagattaaacaggtagggagcctgaagaccagtagttttcaagtcttttaatggagaaacctattcttcaagtgtaatcttatgtgaaactttaggatgtacaggttcctctggttgaagctggaatgggataaagtttacccagcaacggcctcataactagggtactttttgaaaactggtgttgacaaaaagttctatcccaagggcaggtaacttttgaaactgattttcccagattataccaagccacacaacttatttgagctctattttctgattcaggtagattgcttctaaatctgcagtaatggtgataggaactaaagacggtaagatttcttttttttttttttttttgagacagagtctcttgctctgtcacccaggctggagttcagtagtgcgatcttggctcactgcagcctcagcctcctgggctcaagtgattctcccacctcagcctcccaagcagctgggattacaggcacaggccaccatgcctggatgatttttcaattttttgtaaagatgggatctcactgttgcccaggctggtcttaaactcctgggctcaagcaatcctcccgccttggcctcctaaaggctaggattacgtgtgccattctctcccagtgctgggattacaggatgagccaccttgcctggcgaaatgttaagatttcttaggagttattgcctcagtgcagtagctcttaataattaagggcttataccctgtggtggtcaagaatgtagtggttttcttttgtcttttgaaggtaagtttgtctcctatagaattttgttaatctgactttctgtgtgcacactgcagggaagattaatgatgcctacaaatgtttttgctcagagctgttctagttggatggttaagaggcactgctctgcagtcaagctctgagggat

SEQ ID NO: 16646 - DNA, 21978 bp, Human
tggcctccacagtgatcccttcgaggaggacttggccaatagggctgtgatccctgccctcactcacggctcttgcatgattctgtggcccccccttcatcttccccatctcttctgggggcagctggggaaagtggaggttctaacctatcacaacccccaaccacctcacacacaggggctgagaccaggccagggctggctccaaggaagaagcccctaggatggccacatctgaccactcagggctgctgaaggtggggccagggccaggtccatgccttcagtggattttggtgcaggggatgcattccttcaagaatctgccttctccattcctgtgctgtgtgaacatggtacggggtaggggtgcctgcagcccccttgggccagggccaccagccatgctcttgcacccccacacacatgtgccaggttggggttccaggatatggtcagtgggtgcctcagtggagagggcccaggcagccccggtgcctgatgacatcatgggccttgctggatgtcctgacaagcaaaggcaggagctcctggtaccagggagaactcgccccctctgcccttctggggatactggtcctctttagaccaagacaaaatattagcatatcagagaaatatacttagggttttctaagtgcatttccccaaccagccggtcagcatcacctgtgaactggccatgtaagtctctgcctccacaccagacccaccgaataaccctcctgggtggttctgatggaagcctttcaggtggttctgatggaagattgacgaccagcgctctggaagtaactttagcctgatttgaattccttgctgctgtgaacgcttaacttttaggaacaggtatatttatcacaaagaaatccgaagcaattaggggagctacctacactttcaaaaggacttgaatgtatttaaattaaaaaaagcggatggggcccgggtgcagtggctcatgcctgtaatcccagcattttgggaggcgggagggtcacttgagtccaggagttcaagaccagcctgggcaacatggcaagacccatttctacaaaaataaaataacaccaaaaattagccgggtatgatggggcgcgcctgtagtcccagctggggactcccgagactgaggtgggggtatctcctgagcttaggatgttgaggctgcagtgagccgacatcatgccactacactgcagcctgggcgacagagtgagactcctgtctcaaaacaaaaaagaggggcggggaagcagtaacaagcacaggtgtcctcagcccatggatggcagcgcccgcctccacgcgccagtgccctcctgctcccctacctcccccttggccacccctgggcatccccagccctgcagcgccgagggcggaggggaggccacccgcccccagcagagggctccgagagagctgcagcggcggtgggggccccgcagagattggggcccatggtttgaaggctgttcacaggcaccccgagacagcgtcccccctctgggcgcactggatttgacgttgcaggacgcgcggctggaagccccccaggccccgctgctcacagaccgggactccgcctccggttcccgagggcgtggcgaggcgctgcgggacgcccaacaggtgcgtgttgtgtccccaggccccgcgctccgggcggagtcaagagcctggaagccggcagcccgggaaaagggggcgggacggtgccccggggcagggctgggtggcggccgctgtcctcccgggaggggcgggccgcctcgacgccgccctccctggcggccaatggagaccgaggccccgcgcctggattggagcggacgcggggggtcagccagccttgggggccggggcctggccgggggcgggggggcaggcgaggcgaggcgggcgccgtccgcgcggttataaggcggggagttccctgcgccgcgagccgggaggcgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggtaaggaagccataaggaagccacccaccggcgggtggagcctggagctcggtcgtgggcgtgatgtcccgctccacctgtggggccttagcatcctccctcccctcgctgacctttgacctccacgccgggacccagagttggggtggactagccagggccagatgtggggtagggagggcagttccctgcgtggaggacccgcagctgtccacggagcaggtctgcgggggaggagggggcctcagaggtgggtgtgtcatgctgcagagcctgccctgggtgaggggctgccctgttgctcccaggtccctgtttcagttctgggtccccatgctgggtgcttgctgagtgctaggggtagggcagggcagggtccccaggggccggtaaggacatgccattagaggctgggggctgggccggcctgaggtctgtggctttcccaagagcttctgtaaagggctcagggacagtgactcacctctccgggctagcagctgcacgtgggagggctttgccagccaggctgggtgggcctctcctggaagcacagtcaccccaggaacaggctggcccctggggaccccaacttcccaatcccagcccctgtctagacaggcagggatgtagcctggccccagggtactgtctggctggagtccagtggtggagcagcccgaccagccccttttccttagttacccacctgcacaataggggttggggccacgatgccctgtccttgaccctccaaatttctaggttggccacactgggtatcaggaaggtcttcaagacctgaggacatgaatcctgaatgctggctttttgggcagcagcggaggttctgtccagtcccaggactgtcggcgtccctcttgccagggccacctgctctctgccgattgccatctccagcatgttggacaatcttcactggactctttgaggaagaaagcccctcttttccccttccaccccatgaagctgaggagtgagaataagaatcctcctgaaattctaaaaaaagaaaaaaaaaaaaaaagaacgccttgtccgtggctgttcaggcgccagacgctggcccgaggggacagcacagccgtgggatgaagcagcctgggggcagtatttgagcgtgcaggtgtttgcatgtctgggtgagtgtggtgtgtgtgcctgcctttctgccagggcgtggcgaggtgaggggcacggcttctccccaaaggcctggctgagccctggcctcccttcaaggagtcttgtggatgcctgctctggtctttttttaaaaaagtatctattttatttattattatttgtttaaaaatagagacagggtctcactatgttgctcgggctggtctcaaagtcctgggttcaagcattcctcctgcctcagcctccgaaagttctgggattacaggcatgagccaccactcccggcctgctctagtcttttgtaacctagaggacagtatggatacagaaaactttactccccaccaaccgccggagacagaatcttgctctgccacccagactggagtgcaatggcgccatcttggctcactgcaacctccacctcccaggttcaagcgattctcctgcctcagcctcccgagtagctgggattacaggcacgcgccaccacgcccggcatattgtatttttagtagagacggggtttcaccatgttggccaagctggtctcgaactcctgacctcgtgatccacccacctcggcctcccaaagtgctgggattacaggcgtgagccaccacgcccggctgggatacagaaagcttttatttcatcactgtttcctgcctggtgccaggcccatgctggggttcctcccaagtggaattactgacttaacatttagcttgggatcctgagacttccatcacacagttttctcattgattcgcagccaataatatctgttttaaaaacatctcaggccgagcgcggtggctcacacctgtaatcccagcactttgggaggctgaggtgggcagatcacctgaggtcgggagtttgaggccagcctgaccaacatggagaaaccctgtctcttctaaaaaaaatacaaaattagccaggcgtggtggcgcatgcctgtaatcccagcactttgggaggctgaggcaggagaatcgcttgaacccaggagacggaggttccggtgagccgagatcgcgccattgcactccagcctgggcaacaagagcaaaactccgtctcaaacaaacaaacaaaaaacatctctctgctccttggggccgggtgccagctctgctattggaggcactgagcgaccttgaagcaggcatgtcactcctctgtgccccagtttactcatctgtaaagtggggagagctggggcagacagtgagctggctgagggcaggactgtgtctcctcaagcccatggcccagggctgccatgtagtagtttgtattcggtaaatgctgctggcccctaagtgtgagcgtgccctgcaaactgcagtgtatggtgggacagccctgcacggctacccctttcctgggtgaccttatttggttacggtcctatctgaagtaggaaagggacactttaggctgtctcttagctccctcaaggccccacagcctggactagagttgccagaaatacttggtccattcaggccaaagggactgtgaggttgctgggatggtgcaatcagtctttgtccatgatgaacccacagggtagaccaggggttgggccagcccagtgccctgtgtagttgagcccaggccccaggcatcccatcccgggcggtggcctcaggtggaggtggggcagccagttgccagggatgtgttccagcggtcacctctcaccagccccggctgcccatcagctgttctcaagtccaggcaatgaagccttcctgccaggaaattcccagagtttctgtgccatgaagtcagcctgtggccatcttgggacacaaggccgggtgccctggggagagtactctgggcccttggccaggtttgtctgagagtcataggcagcctgatactagtggagccagccagggagggatgaggcccagccgctgctggccataagtatataagggccatgtgctgagtgcctactatgtgccaggttttgaaatcagtacttgatttattgaaaccctctcttttaatcctcaaggtgcccctatgaggcacgtaccatttattgttattgccacttgacagatgagaaaacagaggctcagagaggcaaagtggcttgaaattcagtgattggtctgggatttgaatccacagccatgttctcaagggcatgctatgctgccacctatcctgtttatttccggcactcattgattcttcaatgtttgactcattaaatccatcagtgagcatcttctctgtgtcatgcatggttctcacctctgaagatgtagctgtgagcaaaacttctacagggaatgagttcacagcagagggatcagctagagcaaaggctcagaggtgggaccgtgcgtcctgtgttccaggaatacagtatggctgcagcagagagcagtggagagagggcctggcagtgaggtctagaggcggccgggctggctcatgctggatgtttgtgtcctcggaaggactttggctttattttaaagaggatggggagccccagagagcacagcagggaagcctggggagtctgatggacatttaaaaggatccttaatggagagagtgaaggcagagccttccagaagggtaagagaagggaggatggagacctgccctcccccaagggaggccactcagaagaggtagagtgtggccagggcagagagcaagagaggctgtggacacaggcacactggtccagtgagagccattagacacattagatttagcttcatgttgtctttagagagggagccagcctggcctcgctctatgatcttggacacatcctttcacttctgggtctcagtttccccattagtgtgatgaggatgagaatgcttttgtcctgggcacactatgagggtggtgctgggcacctgggtgcctggttaccatgggcaacaaagctctattcatgggtgtggtgaatgcattgcccacagcaactcagggcggatgaggagtttcccagcagcccctggtgccctttcggctgaagccctaacaactgtgggaaaatccaagttccagcagaccccctgagccctctgccttaggaccctccttctaggtggttctctgagcctggcctgagctggaggagggagtggccagtgctgcagcagaggctgcttcatagtaattgcagccaacagttattgactaggcactgttctgaggggtttagatgtggtaactgattgaattcgcctaacaactttatgaggtaagtcctattgttagcccattttgtagatgaggagactgagtttgaaactggggggtgtaatggaaccttctcaggacccttgaagggtagggcctttgtactcgggccacgagggtggggtttgtgtctgggtgggagctggggagggacaggactaggattaggcagatctgaggccacaggagttggttggggggtggctccagagccactccactccctcctaccacattgactgccttgaaagtcccctaatggccactcccatgaagtgtgactgctctgggctccccgcaggcgttttctgcaaggccaccgcccacccaggccccttccccagaggggctgcagtgccttgctccttccttgtgggaagagttgggattgtctggcgtcagcaggatactgcccctgggcatccctcccggtctcttcctgcgggtttctgatgaaacagccaggctccagtagtggagccagaggtcagtggtggagagaggaccaggagccagagggtatagctgctttggggctactgtggggtcagggacacttgtgaggccaagcgtcctggctgcaggagccctcacatatatgcccacccttcaccaggacattgaggggtgctgggggacaggggtagctttttgggggtgtctgccttcgacttgggctccgctacacaggccaaatttggatgtcccatgtttagagctgtgtttctttgggacctcttggggcctcagtttcctcatctgtaaaatgggatactgatagtgcttccccactggcctcctctgacgggcgccagggagaggatgggacggagcatggtgtgctgggcacgctcctgctgtacccacccacctgggagaggggagaggcaggaatgtcctgggggtgtcctttgaggcatagccctgtcaccccaacatcctacaaaggcatgagaaggcagcgaggacagaccccgaccacctgagccctcagcagccctgccacactccctgcttcacccccttcctgactgatctggcacattcttgattctcctagggagtgacccaaaatccctccctgccctgctgtgtctctggggtggaaggaggctgccagcccctcctctctcccagcctcaggcttggccaggacttaacaggcaggcagagaagcagcttctccactctcttccctgacacctgtaggcccctcctgcaggcacttacctctaagtggactctcaggaggaggctcatcagggctgcagggctcagaaagagctgggctgtggagctcttgccaaccgccaggccccttctaagtgctttagcgccaccgactgcatcctcccagcagccttgtgagatggggatttgtggttcccagtttactgatgagaaatactgatgagagatgggtgtggtcttgtctggggctccctggctcctggatagcagctcaggttccatcctgggcaggctggctctgggacacccccccgaccagctgctgtgtgggattcacggtggggcttgggcagggcgtgggatcttggggccaactgagccactctaggcttccagggaccaaggccaggctgagctgtctctgtatcctgagagagcatgaacatcacagaagatgggcccgggttcgaatcccagctctgccactactaactgggacctgggcaggggtcccttcccgctgagccttcatttcctcaccagcaaaatggttcgtgcccctgctttgggggctgtggagggttggctcttgtctacttgttcatacctgctgttgagcagctgctctgtgccggcctctgaggatgccactgtgaacagagcctgtcgctacctccaggagcttgtgtttaggggtgccgttttgattccagcactttcacccagctctgctccggtacccgatgagagacgtcgagtgccgctttccactcgcttgggtgcgtgtgggggttggggggacagggctttgtgcacgtagccctgggtggatgttcctgggtgcacttagggtgtgtgagggtgggacctcccacagttccctgaggctccactgatgaggtccaagaaccgccttcctgccccccagcccaggctcccagcagctgggcccttggcttcttgagatagtgactggcctcacggcaaggacccccgcacaccacctaggagaactgctgcttcccctctgttccaggagtggcgacaagcacagtttttcgcttttgtttttgttttcttcactttaagttccgggaaacgtgcagaatgtgcaggtttgttacataggtatacatgtgccatggtggtttgctgcacccgtcaacccctcatctaggttttaagctccatatacattaggcatttgtcctaatgctctccctccccttgcccctcacccgcccagtaagccccggtgtgtgatgttcccttccctgtgtccatgtgttctcattgttcaactctcacttatgagtgagaagagacctggactctgatctaacctcggtcaaatggaactgtgtgaccttgaagaagtagcttaacctctctgagtcttagcttctgcctggcacccccatccttaaggagaggcccacagaggaccaggtcacatgacctcagccagttccagagaaggctgtttgcttccaggtttcggcctgagtccaggcccctgccctactcgcactccctgatagcatgagaagcacagccccagggtgcccacccagctctgagagcccagcctgcttcccagggaactgtcacagccccacctgtcccttccccagctggagccctgtcaatggctttggggttctctgacacagccctgagggggctcacacttccccttatcattgcaaggggtagatctggcttgaaggccctggggcaggcttggttctgtcctcccctgtcagtgcctcgacagggctggcctgggtgaatcaggaccaacgggaaaggaggcgaggagaccaatctggacccaagatcctcagctcaataaggtggccccagaactgacatggggtgatagagggaagggctgggagggaggagattctggggccgcagccacagcttgcacgttgcgccgggtgtgtctgtgcgtgccagctgcatctttgcgtaccatgtgtgcaaggctgtgtttggctgagtgttcatgtgggccgtgattgtgggcatgtttctgagtgtctgagtgatgcctgctggtgtgggctggtgggtgtgtctgcatgtgcgtgtgtgtctggggagtttcaaaggagaaagagggactcaccatcacgctggctcagccttaaaaaggtaggacatcctgacacgtgctgcaacatggatggaccttaaggacattgtgctgagtgaaacaagccagaggcaaaggaacaaacatgtgatttctcccagatgaggtttctggaggaggcagatctgtatggacagaaggtagcatggtggttgccggggcagggggaggagagaatggagaattagtgtttaatggggacagagtttcagttggggaaggtgaaaaggttctggagctggatgatggtgatggttggacaacactgtgcatgcacttaataccactgagctggacacctaaaaatgcttacaatggtaaatttcatgtatattttactacaatttttaaaaaattggctgggcgtggtggcttatgcctgtaatcccaacactttgggaggccaaggcgggaggattgcttgagctcaggagttcaacaccagcctgggcaatatggtgaaaccccgactctacgaaatatacaaaaattagcctggtgtggtggcttgcacctctaatcccacctactcagtaggctaaggcacaagaatctcttgaacctgggaggtggaggttgcagtaagccgagatcatgccactgcaacccagtctgggcgacagagcaagactctgtctcaaaaaataaaagataaataaaaaaattagaggccaggtgtggctcacacctgtactctcaacactttgggaggctgaggtgggaggatcgcttgaagtcaggcatttaagacatgcctaggcaacatagtgagaccttgactctacaaaaaaattcaaaagttaatgagacatggtggcatgtgcctgtagtcctagctgctggggaggctgaggtgggaggatcacttacgaccaggatttcaaggctgcagtgagctgtgattgcatcactgcactccagcctggtgacagagtgaggccctgtctcaaaaaaatttttcagtgtttttctgggctgggcgtggtggctcattcctgtaattccagcactttgggaggctgaggtgggtggattgcttgagcccaggagtttaagaccagctgggcaacatggcaaacctcatctctacaaaaaataaaaataaaaaattagctgggcatggtggtgcacacctgtactaacagctacgagagaggctaaggtgggaggatcacctgagcccgggaggttgaggctgcagtgagccatgattgcaccactgcactctagcctgggcgatacagcaagaccctatctcaaaaaaaaaaaaaaaaaaaaaaaaaaaacacccagtggggtcagtagaaccccaagagtcttcttccctcccagctcccctgtacaccagccccagctctgcaggtagctgggggcccagacagcttcctggggacccccagccttccctctgcccttttttctaccagttttgctgcccctccttcaagactcatgtccagagggggtgagatctgcacttatacagccccctcctctgtaatgagtgagccaagtcagcccaggttattccagaaggggcaccctaccagccccccagtccccaagctgccctgggcctataaaagcaggcaaggggacccctagtagatcatgtaggtgttacctcttagtgggtgctggaggggcctgaagtgctttcttcccccagggtggtaggagaatgtcctggcagtgacttcagggcccgctgtcacttccgttttaagactcaccagctggtaggctcattagcaagaggacaataggaggcccctgtcctcagtcagctttcttcaaaggtgtttcctttagcaactgggaggcctcccttctccagacccatggggacaacaccacccagctactggttctataagctgctgtatggctctggctagcccattcagagaaagcctctgaaagtacaaggaaaaaaatcagtccaagagctgtgaacaattagtgagccgattacaataccaagaccacaggcagacctggaaggctaagtgagcccaggtgtgaagttcaagcttactttacttctgggccacttcctggctggtctctttccctggcccttatctttctcctggtctgtcttctcttctcaccccctttctttactctttcttccttctcctgcatcgtactccacccccactccagctattacacagaatcgcgagaatgttggattattcattttatttatgatgttttcttttttgtaaaaatagagacaaggtctcactatgtggcccaggctggtcttgaactcctggcctcaagcaatcctcgtgccttggcctcttacagtgctgggattacagatgtgagccaccatgcctggcccattttatttactttaaaaaaaaaattaggctgggcgcggtggctcacacctataattccagcactttgggaggccaaggtgggcagatcaactgaggtcaggagttaaagaccagcttggccacctggggtcaggagtttgagaccagctactccggaggctgagaccggagaattgcttgaacccaggaggtagaggttgcaatgaactgagatcatgccattgcatgccagcctgggcaacagagcaagactgtctcaaaaaaaaaaaaattatgttttgtgctcctgcttcctgctttgtaagtcaaatcagtttaactgttcaagtgtcttccttgcaaacccccaaggactcaatgtgtgtcgcccttgactgatccccccgccccgtgacccagtggtcctcagttccaggttttcccacctacccttcacccactgcttatgtttataaaaacggggtaaatcaaatgttcgtgacccagatcttattctacatgcagtggaaacttgtatgacttaagctttttggaaaagcagaaccttttttcgtggttcaagaaatcaaagtcttcccgggaggtctttctgtaaatccagagctgcagatgtttgaccgtgttcagagaggggcccttgtgctgggtgaagtggatggggcacagcaggcaatgggtgaaaagcaggacaacctggggccctgggaggaccagggagggcccatgtctttgactgttcatcagccggctgacttcctgtccgcctgtcgtctgctctgcccatccatccgtagtccttccgcctgtctctgctggttgccgctgtgctactcagctgtgtctgtctgtccgcctgactgtctgctctccttcaggatgccttccgtgccttccatcaagatctcaattttgtgcgcaagttcctacagcccctgttgattggagagctggctccggaagaacccagccaggatggacccctgaatgtgagccagagccctaggagaggctcagcccctgagggagggggatggctggagggctgggagacattgccacatggccaggagccgctccctcggcattcgcccaaggggatgcagagccaggggtgagcctgccctcccctcccagggggcaggcagttgaaagtgaagctgtagggatgccctgagaagtccagggctccagatctggtttagccaggcactcgtttggatcccgaggcaagctccctccctgttgtcgcccagtgtccccatcaaaaggaggattttgatgaactgatttctctcctggctgtagcgtcttacccaccccataccttttgggagggagaggaggcttcaccaccagccagtgctccagctcacaccccgggctgggtactcttgtcacttcattcctctttgcccacaccccttgggcctggcgatgggaggagcggctggggctccaggagaatgggggtggggaggaatttcttccttggctgatcggcccctctgctatggcaggcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggtgaccccagttctgtgttgcagccaccttaactgcccaacagacgtgggcccccatgcatctgggcattgtgaacatatttgctaaatgaatgaatggacctatgaaaggatgaatggatgaataaacagatgaatgagtgaacagtctgaaggcccatcaggcatgtctgtgggtcaagctgcattccagatgagccaagaagttccttcttgaacagattccgatcaagcacagggccactgagccagaggctgctgccctgcagcttcatgacacttacgagcccctccacctccctgggactcagttctcatctgtaaaaagaggacactggcccacaagggtcttgaaatggagcattagcacgggggtaccctgcaagctgaaaggattcactggggccccaggccctggcgggctccgtccttcccaacagcttctgaccctgcctctctccccaggctcagtcctggtgtctgcagcatgacctgggccatgcctccatcttcaagaagtcctggtggaaccacgtggcccagaagttcgtgatggggcagctaaaggtgagggtggggtgggtggtcagccaggtgctgggtggcgctgggtctgcccaagtgtgtgggcacagtcgggggcacagcctgccctgagagccccctcctcctccacagggcttctccgcccactggtggaacttccgccacttccagcaccacgccaagcccaacatcttccacaaagacccagacgtgacggtggcgcccgtcttcctcctgggggagtcatccgtcgaggtgggtggggagggacgtggacaacctctggctgggcctgcagctgagggggagctaatgcactgggtccccactctgcccctgacctagcccctgatctggcctccactctggctgggccaagctctgcccccgtgtctttccttcccacctcccaacctgctggggacgaccagcccgcttgctagaatctagagttgcctttgacccttggccccagccagccccgtgaccttgcccgggagaaggaggtggcctggagagctgctgtctccagccgccgcctgtctccacagtatggcaagaagaaacgcagatacctaccctacaaccagcagcacctgtacttcttcctgagtgagtgtccatctgtccttctggggtgggggagtgcctgggcctgcactgtcctccctgctgtcctggaccactcccagccacttcctggggcggggcacgtctgtcaggtctccctggtcatggcatcctcccagcctctgcagtctgtacacactctcccagcagcatgcctttgccccagctgtctcccgtgcctgggacaccttgcagccacgggccatcacagccctgctgggagcttccccaagccccacgtagaatttcttcttgccctcactagagtggtccggagccctagagtctttgggcagttgttggggcggacagagtgaggactcaagtctggccctgacttgcggtgaagggtggtgggaggtggtggggtaagggcagcctggggaggcttggacacagaattgggggtgatatggggtcattcagctggatgtgaccagcaccaacgtcccaggggcattcctggagtaacagagcccctcactctggcgcccactcaccttggcagcccagccccactcctgaacactctcatgccccttcttgcagtcggcccgccgctgctcaccctggtgaactttgaagtggaaaatctggcgtacatgctggtgtgcatgcagtgggcggtgagtggggttgcccaggaccccgggcatacggctgccgtggcaggaggtggtgcctcgggggacagtacctgcccatgaaggcaaacagggtgcacatgtgcgtgcaacagtgtggctcacatgtatgcgtgcaacagtgtggctcacatgtgtgcgcgcagcaggagagcgagtgtgcccgtgactgtacgtgtggtgggggggggttgaggaacagggggggtgtgggtctctctcggtgagggtgtcttcccaggaggagttgctgggccgactctgccaggcatctgtgtccctggcagggtcttccccaacacaccctgcatgacaccttcgtcactaaaatcagcctcgtgagctggcagggcaaggaccctgttcctttactcagctgagaaaaccagagagggtggtggcctgtcctgggctctgaggcaaatcaggcagaagggttggatgcctgaggtcctcctcccacccaccaggcctccagacctccgggcacctggagacctctcggtatcgcctctgccctcctctgcaggatttgctctgggccgccagcttctatgcccgcttcttcttatcctacctccccttctacggcgtccctggggtgctgctcttctttgttgctgtcaggtatggcagggagtggcgaggtcacacacaggcgacaggtgacccccactgcagccccccaccagagcttcccttttcccgtctgcagaatggggccagtggtactgcctccctggcttgctggtggaatcacataaacacaagcgtggcaggagcccagggtcggtgggtttagggagcgtggcctggcttgtaagtggcccggtgggtgtcggagctgctctggactcagcctcacagtggacactgctccattcagattctttaaacactggcaagggggcgatggccacaatcctattgtacagataaggaagtcaaggccacttggggacagctgctctccagcctccactcagggtgcctaagtggtgagctggacctagggcagtgcccgagcctccccacagggtcctggaaagccactggttcgtgtggatcacacagatgaaccacatccccaaggagatcggccacgagaagcaccgggactgggtcagctctcaggtgggcagcaggggtggggcccatcctgggtggggtggggggtcccagctaggagccagatggcaaagcagggatgaggccctgacggggctgccaggtgggggatggtgccgtggggtcagggatctgcaacggcctcctcacatgtgccccgccggcttccggcagctggcagccacctgcaacgtggagccctcacttttcaccaactggttcagcgggcacctcaacttccagatcgagcaccagtgagtgtgggtgctgggggccagtgggaggtggggagggggtcctgggaggggatcctgggaggggacccgtgggtggggcctctctctggaatctcccacttcaggtgccagcatacgctccccacccccagcctcttccccaggatgccgagacacaactacagccgggtggccccgctggtcaagtcgctgtgtgccaagcacggcctcagctacgaagtgaagcccttcctcaccgcgctggtggacatcgtcaggtgaggctgcagcccggcccctctgttctggtggcttccccagggcctatgcctacccttgtccaggtcagcctcatgctgagcccccagggtccctgagcctttctgtccacgtcccatgcccttcctcccttccccagccttcacgcacacagtgagaatttctggagcacctactgcagactcacaaacagcagtgcctgcggtgagcaggtctatgcaaacctacccccaaaggctgagggaaaaaagctaacagatccagtttctcagaaggaaacacttaacagggactcataaacagaagccatgtctcagggccgggtgcggtggctcacgcctgtaattccagcacttggggaggctgaggtgggcggatcacttgaggtcaggagttcgagaccagcctggccaacatggtgaaaccccgtctctactaaaaaaaaaaaaaaaaaaaacaaaacaaaaattagctgggtgtggtggcaggtgcccataatcccagctacttgggaggctgagggaggagaatcacttgaactcgcaggggcggaggttgcagtgagctgagattgtgcctttgcagtccagcctgggcaacagagcaagactctctcaaaaacaaacaaaaaaaccatgtctcaggcagccaagagttgggacatcccctcacacgccctctagaaagaaccctctatatagcaagcttttagggtgaaccccatgcaggtggttcttatgaacctggtgaccactggaggttagataagcgtctacaagaggaggttatctatgccatgagcttggcattcagggtcaagcatcggtcatcagacagttttgcttgaagatggcattgcccttgtagcaatgcaggctctagagagcttcctgccctcttggagctgatgttccttccagcaaaggaaacagcaagcaattaaaataacaaataagtacattacagaagatgggcaaaagaacaatgaaaagcccctcagggtggggacaggggaggggaggggggcggccaggcaggggcggcagtttctaaataggtggtagggtgggcagtattgacaggctgacgtgtgagcagggacagggaggaggggagaggtctcgccacagggacatctggcaaagagcgttcaggcagagggcacttgaccctgaatgccaagctcatggcatagatagccgaggcaggcatgcaggcactcagagaagggacacgcccggcttgcatcttggaaagctgcccctactgggaatgactggcgggcaggagtcgaagtggaaaaggagagcagaggacactgcagccatccaggcgaggggtgatggggctcagcccttgtggtcaccttggaggtggggaacagaggccagattccaggtcttatacctctgcgcctttgtacacgctgttccccttacttggttgcccttccttcctgtgctggtgttcagatgcccacttctccttcatgatctctcccagcctgatgctctgagcccctgccatttggcacagccctttagagcgcctggcacagggcttcctagcagattgttgacatttctggctccactgcccaatatcaggcccaagatcgggtgggcaggttccacgtcctctctgtccttgggttgcagcgcccagcaggaggcagcaatggagaactgggtgcaggagggacaggcccacccaggctcatgcctggacttggccttggctgccctccagctcccctacccgacacccgtcaacccggtctagattccattccagagaatgagcattcagctgttctcccaacccaccctccagcccgcatcgctgcctgcccccagggaagggaacccacagggaatggggatctccgctcacacttaccatgggggatacaggggtgttaggatcttgcaactgagctcctaacacccacccccactgccacccccacctcccaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgtattatggagtggagtggtgaatttgcatgagttttgaagctggggtctgcccagactccccaacagcattcaggccctcggccatcaatgtgtgtgttggggccggcggcggggttgagggggagcgctaaggagctccctttagctctagatgccctgggcctgggagcccagggatgcctggactcggacctgcccgagggcctattcacttcctattcatgctgggcttcaagtcacttgacgcttctgcatggtgggatgagcgggcccagcagatgaggacccagggctgggggccatgtctgcggacgcttctggacatggactgggaaagacggttgtgcctcttgacctgcactggcctcccacagccctccatgatggggggcctgaaagggccccgcgcagcgggccacctgctgatcttagcgccacatctggcatcacaccagtggtggtggtgcagcctgtgcctggtggcccaaggaggcaacgtcgatctccctcaagcccacctgggaccaggtgcttgtctgtagttactgcagtgaataggctggacccccgaggcatggccattcctgtccctgagtccctggagtcaggtcttaggctctttgtctggcagtgggctggactgtgcctgtgggtttcggacagttctggggagggctttgagttgcctcttggggcacccagaattgggaagaagatctggctggaccaatcagtccccagcatccacacagcctgacagctccaagctgagctgagggtttcatctgaagtgtcggcagtttgaaaaagaaagctgagtgaggatttctatgaggcctttctggagtgggagctggggtcgccctaccagctgcaggggttgccccctactttttgggcttccattggcctggactgggttctctttgggaggtggaaaaggcgcaaattctgccaatttttgttcagcccctccaaggcccatcctccgtgggacggagctggaggggaagccccactgccccatcaacccgccccctactccacacacatacaaggtggcgctgagtgttgctgcccatgaacttctcttccgagacagccagaaagctcctcagtgctaaagctgatcaccgtagtctcacacctgcttcctctctgtgaggaggggccgtctgcacattcccatggactcttgcggctcttcccaggggctccccttctagaaagttctctctgacccgcagggctcctccccttccctgcccagcctgtgactagggtctctgtgacagcacctggaatactgacatcatttgctgctggaggctggtggcagcccagagcctggcccgggagaccctggggtgtgttttctgagaggatgacagacagggtgtttgggtcctgcttccctcaccctgatttctggggcaggagagcactgggggaggtcctgttcggctcacataatctcccagacccaggagcagacagcccaaagctccctgtggcctcccggcccagggcagtgccagcagaggcctcctggtagggccagggaagcagagggtggcagccccttcagcttggttgtgagtgagatgcctgccctcctccgggtgccacccagccccaccagatccactcaagtcagacagacttgggggtggggtggggtgggggcaagtcctgtttctgccaggacgcaggctgtgtgaccttgggggagttccttgaccccgagcagcagtacctagggtgatggaagaaaggctcttagcaaagggcacagcagcaggctcagtttattcacaaattttgtgcacacaacccaattccccaggatgaccatttgctctgtcacctagggcaagttcttttttgccttccctgagcctcagttttcagccgagggtaagattggatgctccttgaaaggtacttcctgcctcagacacacgcttctcatggccagggcgtgccttgcattcagggtc

SEQ ID NO: 16647 - DNA, 32039 bp, Human
acaactccggacgcaccatcttttagagctgtaacactcactgtgaaggtctgcggcttcactcctgaagtcagcaagaccaggaacccaccagaaggaagaaactctggacacatctgaacatcagaggaacaaactccggacacaccatctttaaaaactgtaatgctcaccgcaagcgtccgcagcttcattcttgaagtcagcaagaccaagaacccattggaaggaaccaattccagacacactgccatgaggtagtgctttcatgagagcatcagctgtggtatataggggaggatcaggtggtgggtgggacactagaacttccaagagaatatgacctttgtcttcagctaccagggtgggtagggaaggaccatcaggtgggggcagggttaggcatgtctgagctcagagtcttcttgggtggggcttgttgtggctctgtggggaatgggggtgtgattcccaggttaatggagttaccttcccaggaggattatggctgcctcttctgtgtcatgcaggttgtcagggaagtgggggaaagctggcagttacagacctcacccagctctcacacaacccaacaagcaaatctcacttctactgtgttcccccaaaaagcaccgaatttgtttccaggcagtaggggagcaggattgagaacttgccccaggctactagcctcccagccgagaatgcaagccagacttttgtgcctccctacctgttaagtctgcacaccagattcacgccctttcctgagttctggacaggaaagtttgtgttcggttggaattgttactaagttcagctggaggtttccttctccctgtggtcttttcccagttcctccggcagcccctgtgagacaagtcagaaatggcttctctggggacccacagagacgacggggctttaccctttgcttcctctacccctgtatttcgctcagctctctaaattgtctgagctccaggtaaggtcaaatccttctcctgtgatctagaccttcaggttccccaagggtgtgtgttcaggggtggacaatacccctttcacacttttcacagtttgggcattcacagtatgtgggctattttctgggtcatgcaggagcaatgtactttcttcagagggtctgtggattatcttggctttcctgttatatccttgcagcagttcttggagcaaaagttcacaatgcgagtctccacatcctgctctgtccatccaagtgggagctgcaagttagtcctgcctcctatccaccattttttcctattttgtattttaaattaaaactcattagaatgtaaactccatgagggcaataattttaatccagttttttcactgctaaatacctcaaaactgttacatgtgctgccattatcatggacgttctaaacatttctcatgaatgaatgttgatatagcacagtgctgatctcaccacctgccacaaagtaaaaactctctaaatgtcaaacactactattataagtaatactattctatcattgagacaactatggttctgtatctctttaaggagtgcagtctaggcaacaacatatttcaacatcaggtatctgttatctcatgttcctaagttcatctttttacctgatcaatattagtaaagatctatggcctcaagtgaactttactctatgaatttacaattgggaacttaggttgaaaatttacctagtattatttattctgctgctataatttattatttattctgctgctattgttgccctaatcagttatcatgctcttactggactctgacatggtaagtaatgtcaattaatatagttgtgttattttaacattatttcaaaatattttaagtgaaatataagactcgttacaaaaggacttagacagaggttataaattattaactttttcctcaagagaagtattgtgtacttaatgacaagttcctagtgcttagaattgttaaaatctttgtgaagcacaccactgaagatgaggttgaaaaacctgacttttatcatcatattgataatctcaggagaactctatgcagaaggtaaaattaattcttaatattctttattctctaaaacatacaaatggagattctaatatttatacaactcaagttttaatatactcttctattttcattatcaattttataacatattttataaatataactttttataatatttagaccttttcctttgagcaaaattagtaaagtgttcttacagtagcataagtcagaaaagcaaaacaaaacaaaaacccttgtatctctagggggcataggagaccaggatctaaatacttcgaaaaggttttcaggttaacaatatgtccatttcgaagtcacatgttaactttaattctaaatttatgctagaatccattcctaatactgacaaaacttgtacaattttaattctgttcataaggtgagagtttaatgtgggaaatttgaaaaggaaatagccataaatattttttacttttgagactttgatttttatcacaatgaattattcatttgttggagacattaagtagtgattagtaggtgaaccatataattgcttgtacaaacagggacacttagagagtaaaagaggggctctattaataactgtttggacaacacatgtaaatcaggactttccaaacaaaccaatacctatggactccctattagaaagctttatagtcagattgcccaatgtgtaagattagtgtgcgagtggaagctaggcagtgtacatgggtatgttgttcaggaacattatcaatattatcaggccgtaggatgaagaatccagggaggacacttagcattagcaagagtgaacatacaaagaaggaagctacagcaatacagcttttctaaaataaacatttttgggaatttgttgaaattaaatacataagttttaactgtgttttagttgaatagttaactataaattttctaccaaaacatctataattaaaattataaaagtgaaagacacagaattaatcttattttatacttttaattctataataggatgatttttgcatgaatttcttttgattttatttttctgtctaaatagggaaataccagcagatataattgtctgttatctataccataaagacattgcaatattctagttaattttctaattattataaggttataatgctattttacacaacaaaaaaaaaagtaagctgcttgaagaccaagacaatgattttatttttgcatgcttctctcaactcccattgtgcacttcagggacaagaattgaattaattgtgtttctcatttcatggtatgcaagtattattggcctatgaaaggtctcactcttgctttacttacacattttatccccttattcctaatcttgaagtccatttcccctgggacctactacaatgttttaacatgttactctagctctctcaaccacaaatagctctggaatgaatattgtaatataaccaacttatctttctgtaagaatgtcatcagtctgtattcactcacagatagcattattgagtctattcttgtacttgatttctgtaatgagagattacttttgcagaatggcagttttgaagtatatcatctctgagagaggatgtaaattgttgctcctcatcattctcaccaacacctcatattgtccatttttgtactggttgctatatggttattcataaagtgatatcccatttttatttatttaccattctctgatcagtagtaagtgtgtccatcgcttcatgtactttttttaatatgttcagacatctgtgatttcctggtttatatgtgattagtatattcctcacatttctcattaattttttgtcaggaattcatattctccaaggcattccagctaccttaacaaataatgtgcctatcctggtggtggagggagatgtcccaggacagagagtctttaaagccacaacctaggattgttgtgcagagaatactttgctgcccctccctgacaagcaactgtgcccctcagggaaatttcttgtgtattcaccattgcactgctattttggaagactctttttattgtaaattcctttggtgcttgggtgtgaaaaaatggtgagaataattctcaaggaatggggactatccagcccatgtttttctgtctgctccatcagatagtggaagttttgttgctcatcattccacatccatttccttcaaacctaggctagcactactagtattttatgtctcatagtagcattaaggtatacagtgatcaaccaaggcattgaagccgtagtaatcacactggatccaggccttcttccatccatgactgcccatgtttcttcccaccacagctcctaggattgttcgagcatttctttcttttaagtgtttttatgactttaagatcttcaacataaagatatatttttaaaatatatgttttatttggagtataacatatccagaaaaatgcaaaaatcacaggatacacttatatagtttttacaaaattttacaccatccagatcaagatatagaacagtgatagtaccccagaaatatgatccttctaaggcactaaaccccaaaggtaaccattctgacttctattatcatggattagtttgttttcttttaaaaagttatgcaaatgtatacattaattcatatgtgattggcttctttcactcaatattatgtttatgagattcaccatttgttcatttctgttgttggataatattccattgtatgcatagtctaaaatgtgtttatcttttctattatttatgggcatttagattgttcccagtttgggactatatgaatactgccactataagcatttttttccatgtcttttggtatacaaatatgtgctttttttattgggtaatatggtttgtacatgttttaccccaatatatattgcaaaggtgttctctcatagagtttggactgatttatactttcagttgtagaaatatgcgagttccagtttcttcacttcttcacaatcattgagatagcttgtctttttcatttcagcagttctattggatatgcagtagtatctcatggtggtttaaattttcatttccctgatgactagtaatgctaagtaccaggtctctaaccatttaaatatcctattttgccaagttcttgccaagtattgctttgttttacttggttgtctgttttttcttttaatgctatttatttcaaaattttttatgagttagcatatgttaaggagaaactttatctattcctgaactgtactgtccaatacagtggccatcagccacatatagctattggagacagtacttaaaatgtcactagttcaagatcagatattctgtaagtataaatatgtagtggattttaaagagttagaaaaaaaaagaatgtaaaatattttcaatatattgggttaaataaaaacctattattaaaactaacttcaattgttccttagtatttttatgaatgtgactattagaaatttttaaattacataagtgacttacaatacatatctattaggaagtgcaggcagggtggagtggttcaagtcttgtaatcctagtgctttgggaggccaaagcagaaggatcctttgagtccaggagtttgagaccagcgtgagcaacagagtgagacccctcatctctacaaaaaataaaacaaaaattagccagatgtggtggcatgtgcctgcagtcctagctacaggagaggaggcttgcttaagcccaggagctcctggtggcagtgagctatatttcagcactgcactgaagcttggataactgaggaagactctgtgtctaggaagaaaaaaaaaagtactgttctacgaagttatgcaaagcttccctgaaaaagtggtctgctaaattttatcatgactgttggatgtttaaagtcatttgcagatcaattatgataaaaggactgcttgagttgtcacaaaagtaccttaaaaatttaagtaagaaaaataagtactagttgaagtgtctctaaaaacttttagtttgtattgtcacctgattacaaatttatgtttttagatttgtttttccattttcagcttgacatttactcatttcagagaaaccctgtggttttcctcatgtggaaaatggaagaattgcccaatattactatacttttaaaagcttttactttccaatgagcatagacaaaaaattgtcatttttctgcttggctggttataccactgaaagtggaagacaagaagagcaaaccacgtgtacaacagaaggctggtctccagagccaaggtgcttcagtaagtcagctggatatgtcactcaatgtttcaatactcaaagaaatttgtatataaaaataggggtccaataaaaatggaaagcggttaaaccttttagtagataagaacaaaatcactagcaatctgtctttctacaaaatgaaggcataatttgaaatccagtaaataatgcttttacattaaaatgttattttctgtatctgtttttaataatactctgttgaagggaatagggtaataactgaaattatcatattgcaaggcaaagagaggtaatttactttaagtaacaagaaacttattttgataattaagcataggatgccagaaaaatgcttgaaactctggcctctggaagggcaagattgctactctaatgctttatcatttgtaagactcatctctcttcatgtgccaacttctctcatgatacccattgaaaaatgtgtttttcaattttgaattgaaagtttgagttcaaagttgtgagaaggtaatctaattgactcatttcattattttatatcaggctacactatcatcaaactatcaatgatcttccactagggcaggtgacccagagtaaggggctttggttgagccagtttcgtttaaaagaggatgttgaatatggctattgtggttgatatatctagtaaacctatctagaagtagatgtggtaggggtagaaattactataagaactaaaattagtaaatacaaagagagtcagtgttaaattgaatccattttcaaaaaaattatgcagatatttccaaaatgaaatcgccaataataacattatacttttggcttaattttacaatttagtaaaagacaagcttagtttcatcattaagttaaataattttttttcccatagaaaaatgcactaagcctgacctgagtaatggttacatctctgatgtaaagttattgtataaaattcaagagaacatgcattatggttgcgcttcagggtacaaaaccactggagggaaggatgaagaagtggttcaatgtctctctgatggatggtcttctcaaccaacctgtaggaaagaacatggtataagaatcatttcctaaaactgaagataagtgcttatcaagcttatattgaatatattgaagcttatattgatatctattatttaatagaatttatttttcattatgtctacaatgcaggaagttgatattacattgcttttctcaagtactaggtgattccttaatccaaatgttctcaatccctacaacccacctacgccaatagttcctactttgcatcaataaaaggaattggaatggaataaaatgaaagaagctttttctttatatgtcactatttcctttattacagaagaatttaagatcatgtacattattttatattgtgaaccaatgtcagatatacttaaaaatagttcaataatttaaatatatgtatactttgttagtaagttgtttaaattgtaaaaatgcatagacagcacatactttcacaattgctactgcacaagcctttagttgaattttggcctttggtcaagcacttgtagactagaattttaaaaacagaaaactggtagagttaggtcacaaggtgtatgaagaagagaatagaggcaaagaaaaattggggctatttttcaattttgccaagagttgattttaccatgtattcttaagatttgtaaaaccatattttgagattttttataatctaggttattaaaaagtttataaaataaataatttttataattttagaaacgtgtttggctcctgaattatataatggaaattattccacaacacagaaaacattcaaagtgaaggacaaagtacaatacgaatgtgctactggctactacacagctggaggaaagaagacagaggaggtagaatgtctcacatacggatggtctctcacaccaaaatgtaccagtaggttctcatttggaataaaatctactctcactctgaaagctttttctcatagagaagtgtatataagttgtcatgctcattatgtttcaccttttcatgcatttttgcctttatttttaattatgttgatagcagtctttgataattaaagctctcaagtagaataaattcattttagctcacagaattaaattagaataagcctaatgatatttaacaaatatataaaatgaattcataagctttttggcaaatttaatttctattctagttatgtcatgtaaatagtgcattttgttgtagcagaaaaaataaacatttgtttgtaattttattcattcttttatttgcagaattaaagtgctcttctttaagattaattgaaaatggttattttcatcctgtaaagcaaacctatgaagaaggagatgtcgttcagtttttctgtcatgaaaattattatctaagtggatctgatttaattcaatgctataactttggttggtacccagaatctcctgtatgcgaaggtaaatttttaaatttaatactcgcaaaatgccatgtctttatcagctttaatctctattagctctgacaaaattcctgtggtcatatctattttttttcctgagtcctatttttaaaataaatattatcttttaaatcagtgctatttttagcaatctttaatatatcccacctgaataaatcttgttttgtcttagtttgtaaatgactatatcttttaaatttattattttaaaatatctattatacattttaaatcccttattataacgaataacttttcttattgggaattattaggactaattaccccaatctggcagctttgcaaggatattttctcttaatttgccacatatttccagatgtaaaaattaatctccaaaatagtgaggtagaaagcagagaaagcaggaaaagcagaagaataatgcccagaagtgaaaatgggaaaagaggtcatcttgtaaaagctgcccaaaaatgtaatatctatggtcacatttctattactggaagtgtccaaacaggtaatgcaattacctgtcagaagacatccatagttatttaaacaaacctacaatttaatatgaggagggtcctatactagcagaagatatgaaaacagtaattgcagatatgaaaaaaataattgctataatgtgacaaatggtacaatcaactcaggtacaaagtgcaggaataaacattagagattctgattggtatgctgtggaatagcattcacagaagtgatggacaatatttaagttgggtcttaagagataagtagcagtttgagaattgggaggatagggtgaggcaaagggtttgatagtcattttttattttctgtaatatgggatataaggtctattgacaggcaggtgaaagacatgaaggtagaacttggaggaaagtggtgaagatttgaaacaggtgctaggggaaacaaatgagggctctgaccatgggtatgcagtgggattgccagaactatcataattccctaaatgcactgtacagtaactttaaagattttatgatttttcatttgtgctcgacatccttggtatagtagtagagaagtagattttttaagcaaatttttttaaagtctattattccttatttattttttatttttttgagatggagtcctgctgtgtcgcctaagctagagtgcagtggcacgatctcagctcactgcaacctccacctcccaggttcaagtgattctcctgcctcagcctcctgagtagctgggactacaggtgtcggccaccatgcccagctaatttttttgtgtttttagtagagacagggttttgccacgttggtcaggctggtcttgaactcctgacctcaggtgatcagcctgcctcagcctctcaaagtgctacttcaaaaataaatggcagacctacttaaggccttttatacccttctcctcttccaaattagccagcatgacaacatgcctgttttttccggtaaacagtcattaggcatacaatggctaatataattcagcccacaacaatataattcagttgtgggctgaattatatctctcttactcctcccaaaatatagccacattctaatactgagaaccattaaacgttaccttacacggtacaagacactttgaggttaacaatcttaaggtaggaatattatctggaactatctatccagactctaaatataatcacaaatgcttttataaaagggaggcagagggagattgactgcagaagaggaagcaggagatgtgacaatggaagccacaggttgaaatgttttgaggaaggggttgtgagccaaggaatacaggtgatttcaagaagctagaaaaggcaaagtagctgattctcctccaaagcctccagcaggaatgtggctctcctgatatctcgattttagtccagtgaaactgactctggacttctggcctctaggactgtaggaggataaatctgtgctgttttaagccactaaattgtaattcatcaaagcagcaataggaaagtagtgtggtcagtattttagagcaggagactttaatttagacagacgtgggttcaagaacagatctgctacatgctattaatttatttacttcataagttttagtttgtctataacatgggagaaataatagttcctacttaataaagttattttaggactaaaagaggtaatgaatgtaaaatgcctgctgtgttagtattctattggtgcgtaacaatgtcaccacaaactcagcagcttaaaacaacacaaagaaattatttcccattgggtgtaggttgggggtctgggtgcggcttaaccgactccttgcatcgatggctatcaaagctgcaatcaagatgttagctggactgcagtctcatctgaggcttgactgggcaagacttcttccaaactcactgtagttattggcagcattcagtgctttgcagactgctgaactgagagcctctgtttcttgtggctgttaactgaaggcagccctctgccccttgccttgcagccgttctgctttggaagctcatgatgtagcctcttgtttcttcaaaaccagcaaggatagagagtctcttggcaagaatggcgttaaaaactgatgttacataattatgtgtgcataatcacgtactaatccatcacctttgctgtattttgtgggctagaagcaagtcacaggtcctactcatggaaaggggtatcacacaaggaagttaacatcaggaggtgaggatcaaaggaatgctcctagaatcagtctgccattctctctatgatgcttgacatgatgaatattttaatttaatctttattattttttgtaattatatgactaaaggtgctgattaattttttccataaggaagaagaaacagatgtcctcctccacctctgcccataaactccaaaattcaaacacattcaacaacttatcgtcatggagaaatagttcatatagaatgtgaacttaattttgagatccatgggtcagcagaaatacgttgtgaagatggaaaatggacagaacctccaaaatgcattggttagtaacaccttgaagaagctttgctaaaatgaaatctgcatgtgtagctaaatggtcagttctctttcaactgtaccttttcagaaggacaggagaaggtagcctgtgaggaaccacccttcattgaaaatggtgcagcaaatttacactctaagatttattacaatggggataaagtgacatatgcatgtaaaagcggctaccttctccatggatcgaatgagataacttgtaatcgtggaaaatggacacttcctcctgagtgtgttggtatgtatgctacatttaccatcagtagctaaacttatggtgtaaaattttccattctgttactttaatctgaatattcctaggaaaagaccactgcttaggcaaattagaaacacattgctacagcacctactcttctgctttgcatgtgtgcatgtgtgtgtgcctgtatgtgtagctatctgtagaatttaagtcaatgtaaagaattcttaaacaaaagttttttttgaacgctagtgctaagcacggttatctgatctgtgtcatgccattacctgtaagttctaaatgacaacacataaatgacgatgtgcttcattagataagtaaataagggcatggtggattgagtgacgggccatgagcattatctacttcttctccccatatgtcctgcaaagttagggtagtgcattctgttcttgaccttgggtaagtcctgctgatattttgcatctggccattctgaaccttatgcccttctgagacatgtccctggtctttcattttactgaaaggcaccaccaggctacactatcattcctggagactactcttcctgtcatctatctcatttcttaatcagatcagagcaacatctccacacacatgtttatctaggatatttattaaataagacaaaagcaatgaaggatgctaaagaaatagataaagtgagagaaagataccaaaaagaggaaaaaaattgatatttccttcatgggtctattgagacctgagatgaagaggaatgaaaaagaagaaaataaaagtggggtaatgccaaagagcaattttagaattgaccataatctttaggttgaagaacagtttctcattctataggtttaagaaatgtgtatatcataattccttcacaattgagaaaagagaaaaatacgtatagttgtttttaggtaacatatttgctgtcaactcttgcttagcaaattttaaaaatatttgagctgaaaaaatttttcatatttgtaatgaatttataaaacaattgtcctaaattatataatacaaatatcgagacactatagtatgagttactatagtatattgttatgagctcatattaattttaaaacaacctcttttcttagaaaataatgagaattgtaagcatcctcctgttgtaatgaatggggctgttgcagacgggatattggcaagctatgcaacaggatcctcagtggaatatagatgcaatgaatattacttactgaggggatcaaaaatatctcgttgcgaacaaggaaaatggtcatccccacctgtttgcttgggtaagaaagagaacacatggaatgtctacgtttgtacttttatgtgattttcttacagtgttttatatcatgaaaatgatgattttgtacaaatcttttttcacaagtgttttctctctcatttctttaagtagaaagtccctaaaatattagtgtattttttctattgtggtaaaatatacataacataaaatttaccactgtagctatttttaagtgtacaattcagtggcattaagtatattaacatttttgtgaccaattagcttttgggttgtctttctcctagctgaaattccctccctggtatacagccctcaatatctctgcttgtattgccctcagaatgtcatttcaagaagaataattagtcctattctttccttggtagagtatattgctaatatattatagagtatattatatagagtatattgctaaattttaccaccgcatcctcatctgaatggacacgtttgttacatcttgttgattatataaaagtgtttgctaatgacttagataataaatggtcttctaaatgttttacacacacaagcacacactccacaaaatgctatgatatgatgcagaggtatatatcttagattttttcactcaaaatatattgtaaacatggtttgtcatacttctacaatatatactttaatggctgcatagtattccataatgcagatatacatatgtaatttaaccagtttattgatggatgtttagtgttcaacatttttatattccaaacagtacactttcaagtaaatctttgtacatgttaaacatatttatttttgttaaaaataattatcatgagatcaggaattttaattctttttctattaattggcaaattgtctatcagaaagtttgttctgctttgttaaccctaccataagtgaattaaagtagtaatcatcctaatctttgttaactttgaatattttaatcttgacattttttgttaagcaggcaagcacaattattttaatttgatttatttaagaattaattaatttggaattttttaactttctagtagccacaggtttttttacatgaattaattattcatagtttagccattttttcatacttataaatctatatataaattattttatccaattgagaatcatgtttattgcaattatttttaatttatttttatttatagtgtttttaagtatatataagtgtatgttttaagtcttgagctctttcaaccttttgttagtagtttccacctttcaagtaattcttaggagtcgattcccattcaaattcagatacagatacatattcacatagaattttgctattggtctcatatttttataaatgtttttgatattaagtttttgatgctttggttgatattgcattgagtggagatatagtaatctctaaggacaaagactagattaaaatatttatggcaaagctggtaatgaaacaagctcataaggaaataacaacatttaaggaaatacatcattctatatctggaacaactgcctcaagagagttaggtttggtcctaatgaatcaaagcaaataccaaatgaagattaatcattgttatcagggcaagagaaaggggctttgtatatcttggtaactattgaaactggaaaggctatcagtacaaattcacaacagtatgataaagcgtagaattttctctgtaggaattattattccagacattaagagtctctctaacctctccatactctcttccctgctctaatcactccagtctttctggtctccttacttttccacaaacaagccaagaatgctctcacttcagggcctttgcactggttgttccctttgcttgggacactctttcataagaaaatgacatggttcactcagtctccttcaagcttttgtgcaaagtccccttcaagcttttttacttcttatttaggcctaccctaatcaccttactgaaaagtgcaacttctcttcacctagctcttttgttaccccctcctgctccagtactctttttttcatctaatttatcttatgctgtagtttaaagatggctactgtgttagtctgttctcatgctgctaataaagacatacctgagactgggtaatttataaaggaaagagatttaatgcactcacagttccacatggctggggaggcctcacaatcatggtagaagacaaaggagaagcatggaacgtcttacaaggtggcaagcaagagagcatgtgcagggaaactcccctttataaaaccatcagatctcatgagacttattcactgtaatgagaacagcatgggaaagacccaccccaggattcaattacctccaaccaggttcctcccatgacatatgggaattatgggagctacaattcaagatgagatttgggtaggcacacagccaaaccatatcagccacaaattatacaattcatgtctttattatatttattatgtattgtaggtgtttctcccagttagaaggtaagctccatgggagcaggagtcttggttttattcattagcaggttttctattattttctacatggtagttaaaggtttttattttatagaaagaaaattattattaatctaactgattgatgcccttaaatagtatttttgatgttttaaattaagtggttttagtttatgacaataatgtatagattcatttgatagtaataaagtatatattttcttatatatatatgtgtgtgagagaagccttaattatgatttcaattataaaatattgcttttgaaacttgtcataatttttgttttaaaaaatatcacttttatatttgtcagacaagtaaagaatttaaaagagcattttgttttacagaaccatgtactgttaatgtggattacatgaacagaaataacatagaaatgaagtggaaatatgaagggaaagtcttacatggagatttaatagattttgtatgtaaacagggatatgacttatctccattaaccccattgtctgaattatctgtgcagtgcaacagaggagaagtgaaatatcctttatgtactagaaaaggtaaaataataatgttctctgcaagtatctttacttgaccaatatctgctacctcggttgaaaatttatttatagtttgttgctatttttcttattattattctttttaattttgttttattttattttattttactttgagttctgagacacaagtgcagaatgtgcaggtttgttacatgggtatacgtgtgccatggtggtttgcaattccagtaatggaattgctgcgtcgaatttcatttctggttctaggtccttgaggaatcaccacactgtcttccacaatggttgaactaatttacattcccatcagcagtgtaaaagcattcctatttctccccagccttaccagcatctattgtttcttggctttttagtaattgccattctgactggtgtgaaatggtgtctcattgtgattacaccttatacaaaaattaactcaagatggattaaagatttaaatgtaaaaaccccaaaccataaaaactctagaagaaaacctaggcaataccattcaggacataggcatgggcaaatacttaatgacgaaaatgccaaaagcaattgcgatgagagccaaaactgacaaatgagatctaattaacctaaagagcttctgcacagcaaaagaaactatcatcagagtgaacaggaaacttacagaatgggagaaaatttttgcaatctgcccatgtgacaaaggtctaatatccagaatctacatggaacttaacacaaatttacaagaaaaaaacgaacaacaccatcaaaaagtaggcaaaggatataaacagtcacttctcaaaagaagacatttatgtggccaacaaacatatgaggaaaaagctcaacatcgctgatctttagagaaaatttatacctatgaccccaattcaccaccatcatattctaatctataaagttgagaggagtgatccaacttccaaacttcaatcagcatatatacctatataggatggccatgctgacatcttttaattccaataagtcaattttatgaagggaaaaaatcaagaggttttataaatgttgccagactatcagagaattgatcaccttcttgtgagcactcaacaacaaacactgtaaagcattgctctacttagggctttctggggacccattgtctcagtactcactggctatagggactattacttttaataaggaagaaaaggaaaataatatatacagaaatcatggcttctagaaaaatcccatatacacttagggagaaataaaatcatgattgttaatactctcatagttttaaatatgcatgtaaacactataacgtgggattctaattataaaaatacattgtatggtataatattattgcaaaaacatcttcaatattttaaaaatatttgagaactgcctaaaaaatggctttatggctaggtgcagtggctcacgcctgtaatcccagcactttgggaggccaaggtgggcagatttcttgagcccaggaattcaagaccaacctgagcaacatagtgagaccctgtctctacaaaagaaaaatgcacctgtagtcccaactagttgggaggctaagacaggaggatcacttgagcctgggaggcagaggttgcagtgagtcatgatcatgccaccatactccagcctgggtgacagagggagactctgtctctgtagcacttataaagtactggatgttcattatagcaattcattgtatactttaaaacttatttttgcagaatctaaaggaatgtgcacatctcctcctcttattaaacatggagtcattattagttcaacagtagacacctatgaaaatggctcttcagtagaatacagatgttttgatcaccatttcctagaaggatctagggaggcctattgtttagatggaatgtggactacaccaccattgtgtttaggtatgtactactaaatatgcctctaacaaagtaaaactatatatttttaatttgctgtcatttttgagttaacataacactaatataatgctatatttgctacatttgtgttattttattcatgtgcttattttatcactgctttctattctttcctctagatcataaatacctatagttcagtttgttgtaatacatatttttttaaagacaaaccacacatcaggttggtatgggctataagttgaataagccatagtggtgtgagtaaactttaacaattatcattcattgtgattggtactataatagaaaacattagggaaacatgtataatagaaaacaatgcggaaataaagaaatggacaactcaatatggaaagatgaagcaagttaatgttttattagcaaggcatcctagtaagagtaacaacatttactaaggccctcagaggcatgaaatagcacatctgtaaataataagaaaatattttttatttccaattctgacttttatttacttctcttatcttctttcactggctaggacttcagtacaatgttgaatggaagaggtagtggatatctttatttgcttcccattctcataagtaaaacctttgataattcacctctatgtgttgttataaatatttttttaaaaatcaagttaaaggtataaaaacctttctttctattttgccgaaagtatttttaaagaatcttcaatctgtgtttaatttttagcaatatctgttgaaataattacatgattattacttttgttttttcccctgcaaatttaatgaattatattgcttcttttgaatgttaaagcatgattctattcccataagaaattccacaaggttgtgataaattatgcatattatatgttatatttttatttatcaatattttactcatctattttcatgagaaagactggttggttattttcctttctggtttgatatcaagtctgtgctgacctcatcccatgaatgggaagtgttccgtcttttctggttctctggattgatgctatttcttcctttataattttaagagttaaccagagaagccatctgggacttgagtttttccgtgaaaagacaaattgacagcttcgatttgtttaacaaataatggtaattatttcttcttctgtcagttttggtagggagtggtttcttgatggttcattacaactacattgtcaaatctactaacataaagtagttatgacatcttcctatcctctttttgatgtttttattgatgtatcttttgttattacttctattaatatgtatctgtcttgacatgccttgctaagggtctatacattttattagtgttttcaaaaaaccaacatttgcatttgttgattcatcaaattttgctttctattttattaattatgctgttatctttattatttcctttcttctatgttcttggatttcttttgttactctttttctggcttgtttagatgaatacatagattactaattttcagcatttatattttttctaatacatgaatttaaaaatagaaatttctctctgagcacaactttaacttcatccaaaccatttttatatcttggatttttactgtcattcagctcaaaaattttatagtattcattttgatatattctctgtgctctgaatcatttagaagtttctttttaaagttctgaatatttaggggattttctagttttcttttggttactgatttctagtttaattcaattaagacatactttgaattatatctgcactttaaaatttgttgatatttgctttataacaagcatgtatttgctttaggtaaatgttcttttcattgaaaagttaactttgtcattgttgggttcactgttttatatatgtgaattggattgagttttgtttttgatgtttaagttaatccaaagctgtactgatttgtgtgtgtttgttttctatcaatcactgagagaagcatgttaaagtctcacttggcattttaaaacattactaattttagttctgtccatttttgcttttgtattttgatactatttcattaggtacacacacaaattgagacactaaatcttcgtatcttggtgtattggcattgtctaattttaaaagacctccttcatatatagtaatgctttgcctttttttttgccttgaggtctcctttagctgcaccaaggggcttttgacaagcattcatgtagtacacatttttccatcccttaactttcaaccttctgggtttttacttttagtgtgcctctcttataagcaatatataccttattttaaaatatacttatgcaatttataattttttcccttgtaatggaatagtctatttacatattcatgtaattactaatatatttctgtttatacctaccaaccctaccaactttctatactaggtgtatgttactatactccatgtatatcccattggtcatctccctctttctctctctctctccatataggtgtgtgtgtatatatatatacacatatatatatataatattttaagttctagggtacatatgcacaatgtgcaggtttgttacataggtatacatgtgccatgttggtttgctgcacccatcaactcttcatttacattaggtatttctcctaaagctatccctcccccagacccccacagacaggccctggtgtttgatattccctgccctgtgtccatgtgttctcattcttcaacactcacctatgagtgagaacatgcagtgtttggttttctgtccttgtaatagtttgcttacaatgatggcttccagcttcatccatgtccctgcaaagggtatgaactcatcctttttaatggctgcatagtattccatggtgtgtatgtgccacattttcttaatccagtctatcattgatagacatttgggttggttccaagttttgctattgtgaatagttctgcaaaaaacatatctgtgcatttgtctttatagcagaatgacttataatcctttgggtatatacccagtaatgagatcactaggtcaaatggtatttctagttctagatccttgaggagtcgccacactgtcttccacaatgattgaactagttcatactcccaccaacagtgtaaaagcgctcctatttctccacatcctttccagcatctgctgtttcctgacattttaatgatcgccattgtaactggagtgagatggtctctcattgtggttctgatgaccagtgatgatgagcattttttcatatgtctgttggctgcataaatgtcttcttttgagaagtgtctgttcgtatcctttgcccactttttgatggggttgtttttttctcgtaaactttttaagctctttgtagattctggatggtagctctttgtcagatggatagattgcaaaaattttctcccattctgtaggttgcctgttcactctgatgatcgtttcttttgctgtgcagaagctctttagttcaattaaattccatttgtctattttggcttttgttgccattacttttggtgttttagtcatgaagtacttgccaatgcctatgtcctgaatgatattgcctaggttttcttctagggtttgtatggtgttaggtcttacatttaaatttttaatgcatcttgagttaatttttgtataaggtataaggaagtgatccagtttcagctttctacatatggctagccagttttcccaacaccatttatgaaataggaaatcatttcccatttcttgtttttgtcaggtttgtcaaacatcagatggttgtatgtgtgtgcattatttctgaggcctctgttctgttccattggtctatatatctgttttggtaccagtatcatgctgttttggttactgtagccttgtattatagtttgaagtcaggtagcctgatgcctccagctttgttctttttgcttaggattgtcttggcaatgcgggctcttttttggttccatatgaactttaaagtagttttgtccaattctgtgaagaaagtcaatggtagtttgatggggatggcattgaatctataaattaccttaggcagcatggccattttcacgatattgattcttcctatccatgagcatggaatgttcttccatttgtttgtgtcatcttttatttcgttgggcagtggttagtagttcttgaagaggtccttcacatcccttgtaagttggattcctaggtattttattctctttgaagtaattgtgaatgggggttcactcataatttggctctctgtttgtctattattgatgtataggaatgcttgtgatttttgccattgattttgtatcctgagactttcctgaaattgtttatcagcttaaggagattttgggctgagacgatggggttttctaaatatataatcatgttatctgcaaacagggacaatttgaattcctcttttcctaatttaataccatttatttctttctcttgacagattgccctggccagaacttccaacactatgttgaataggagtggtgagagagggcatccctgtcttgtgccagttttcaaagcaaatgcttccactttttgcccattcagtaagatattggtggtgggtttgtcatgaacagctcatattattttgaggtacattccctcaataccttgtttattgagagtttttagcatgaagggctgttgaattttgtcgaaggctttttctgaatctattgagataatcatgtggtttttgtcattggtcctgtttatgtcatggattatgtttattgatttgtgtatgttgaaccagcattgcatcccagggatgaagccatcttgatcgtggtggataagctttttgatgtgctgctggatttggtttgccagtattttattgaggattttcacatcgatgttcatcaggaatattggtctaaattctgttttttgttgttgttgtgtctctgccaggctttgatatcaggatgatgctgacttcattaaatgaattagggaggattccctctttttctattgattggaatagtttcagaaggaatggtaccagctcctctttgtacctttggtagaattcggctgtgaatccatctggtcctgggctttttttgatttgtaggctattaattattgcctcaatttcagaccctgttattggtctattcagacattcaacttctttctggtttagtcttggaagggtgtatgtgtccaggaatttgtccatttcttctagattttctagtttatttgcatagagtgtttatagtattctctgatggtagtttgtatttctgtgggattggtggtgatattccctttattatattttattgcatctatttgattcttctctcttttcttctttattagtcttgctctcagtctatgtagtttgtttatcttttttaaaaaaacagttcctggattcattgatttttttgaagggattttttgtgtctctatttccttcagttctgctctgatcttagttatttcttgccttctgctagcgtttgaatgtgtttgctcttgcttctctagttctttcattgtgatgttagggtgtcgattttagatctttcctgcattctcttgtgggcatttagtgctataaatttcccactacacactgctttaaatgtgtcccagagattctggtacgtagtgtctttgtccttactgggttcaaagaacatctttatttctgccttcatttcgttatttatctagtagtcattcaggagtaggctgttcagtttccatgtagttgtgcagttttgagtgagtttcttaatcctgagttctaatttgattgcactgtggtctgagagacagtttgttgtgatttctgttctttttcatttgccaaagagtgttttacttgcagttatgtggtcaattttggaataagtgcagtgtggtgctgagaagaatgtatattcttttgatttggagtggagagttatgcagatgtccattaggtctgcttggtccagagctgagttcaagtcctggatattcttatttaccttctgtctcgttgatctgtctagtattgacagtggggtgttaaagtctcccattattattgtgtgggagtctaaatctctttgcaggtctctaaggacttgctttattaacctgggtgctcctgaattgggtgcatatatatttagaatagttagttcttcttgttgaattgatccctttaccattatgtaatggccttctttgtctcttttgatctttgttggtttaaagtctgttttatcagagactaggattgtaacccctgctcagcaatggtagacgaccctccccccataacgctgtcgtgtcacaggttgatctcagactgctgagctagcagtgagcaaggctccatgggcgtggaaactgctgagccaggcaagggagggtatctcctggtctgtcggtggctaagaccttgggaaaagcacagtatttggtcaggagtgtaccatttctcactgtgctgcccaggctggagttccttagaaacaaatcagaaacaaatctctccctctctctctttctctctctctctctatatatatataaatatatatatatatgagttagttccaagatggccgaataggaacagctccggtctgcagctcccagggagatcagtgcaacacaatgagactctctttgtacattttgttcttcaagttagtagcattccttgaaccttgatgtacttgatatccttcatgggttttagaaatgtttggctaatatcttttaaaatgtacatttctcacctcttctgtgatgccatattacatatattacatctttttgctatgccattgtctctttaaatctatattttctctcattttcttcttgtttcactgtagtaattttttggtaattttctcattgtatcatttctttgtttctatttggtaattttcttctagtttaacaatcctctctttagatgtatccaatctgctttaaactcatcttttgagttctcaatttcagttatcatctttgcatttctattttatattttctttttgtagatttgagttatctgatgaaagatcctagcttaacatcaacttcttgaacatataattcatactttttattaaggcttgtctgcaaactccaatatctggatctattttttagccccaaattcttgatatttttgttaacagttgattgaattccaaatattatacgtggaaaatttcaggatgtttggatgatgtcagcttactccaaagaagactcatctcatcctctggctgatgattagtgtagaggcagttggttttaatacaattagaaataaagctttctctatgtttgttttcagacctctgtttgccttttctcacagactgtaactctccagggctctttacagagggtttgttgtgtgtattaaagctttttctccttgactgtctctgatattactgggagactgccaaatgcccactgtaactttttatttactttctgcttggcttctcatcctatgcctctatacaagtcaaggataagcagtaccttagggaaaagctggtgcagagcctcaaactcatatctctacacttcctatccttctaaattctttattcttcaagtcctggctgctttggtttaccgaaattctcatttttctatcttcaactccatgagattttcagaagttctgctggctgtatgcctaagcttaccattctctatcatctaacctctcaggtcagacttagagtcaacaaacacctcaagagaaaaaaatggcacatagaatttttttttttttttagacagtctccttttgttgcccaggctggagtgcagtggtgcgatccctgctcactgcaacctccaccttctaggttcaagagattcttctgcctcagctttcccgagtagctgggattacaggtgcatgccaccatgcccggctattttttttttttttttgtagagatggggtttcaccatgttggccaggctggtctcaaactcctgacctcagatgatccgcccgccttggcctcccaaagtgctgggattacaggtgtgagtcaccacgcccagcctcacatagatgttgaactcacctgaatacattttttccagaaccttacttccttgactaagttccttggaggttttctgatacctcgaaatgcttcctgtttttcagattttctggttcttaatagaagtgctggtttgatataatctcctctgtcatagctgaaagttaaaggtccatgaatcaacttttaaatttattttaatttaaatctcatgttctgtagaacagtgacatcgtaaattatagtgctattcgacttcattttcacaactattttgtaatgagtgtaataattcttgttcattttcatcacctgtagcacttccagcataatgtttgacacataggcatttaataagtagttgttgaagaaagtaactgaacacagtgctctcagctgcggtttcactttctgtggtttcagttacctgctataaactgcagtctgaaaacgttaaattgaaaatttcagaaataaacaacttataaattttaaattatgcacttagtagtataataaaatttcatgccattccatccttcctgccccagatatgctaaaaagaagctgtaaagtgcttcctttaagtgaaagggcggaaattcttaacttaaaaagaaaggaaaaataaatgtatgctgaggttgctaagatccatggtaacaatgagtcttctgtctatgaaagtgtgaagaaggaaaaagaaatccatgctagtttcgttgttgcacctcaaactgcaaaagttacaagccacagtgtataataaatgtttagttgaggtggaagaggcattaaatttgtgggcagaagacatgaacagaaacatgttccaaaagaatgacaacagggtttagcattatctgcggtttcaggcatgcactggggctcttgaaatgtatcccctgtaggcaatcagggagggcatactgtaagtaagtttgttaatgtactacaggtatatgattgatatgccatattagcaactctggacctttttacctgtctcagaagttattccttaatgctaggtcatccaggagacaaataaggacataagaaatcccattttctgaaataatttgatatttgatattttagaaatattaatgtttttattctgtaaaaaaaatcgaagaggtttttttgtgtattttaatacatactttaccattctctttggtttacgatacatgggaaaggacacaactatactttgtatgcttagaatttaaaacgtcttaatccagtcttgatatttcttaactagaaatttgaaagagaagtaactgtcaaccattttggatggcatgaggttataaagcttgggtcagtgttgagaatctacatttccataaaatgttatttatacagcaattaataatttgtctcatgagaattttatttgaactttctgaagaaggaaaagggaaaagagcatgatatcaatgaccattagtaactgtcaatgcttccccccaaatacctttttgtttgtttgctatctttgaaaaagctaatgacataaaactaaaataccttttagtttttaaaactggaagaaaataccttttctccaaatccaggaccacagagagaaatggctcactgttttctgtgagatttgaacatattttctgactcaaatattaattctgattaactgacttgctgctcttaggcctgagaattttaaggtcctcatgagtaggcaacacaacgattcctgttcttaccaagatgtaacaagatagttttcttctttttctttctttttttttaaattgttgttcccagagccatgcacattatcttttactgaaatggaaaagaataatttacttctgaaatgggattttgacaacagaccacacattttgcatggtgaatatattgagtttatttgtagaggagatacttatccagctgaattatatattactggatctatacttagaatgcaatgtgacagagggcagttaaaatatccaagatgtattccaagacaaaggtaagaagttttttttttttggtcagattattttttttggtcagattgttattcaacatttcagaaatgttatgttctataccactcatactttatggcaattgcaaagaaaaaataataatattttcttcattttttttacaccaaacaaacaactggaagtggtaatcaattcaacaggccttctgaattgtctgaagtgaaagcaacgtttgccatttgatatttgtgacactttggcaaatggaaaaataaaccaatttatacgtgcaatatttcaatgtgcaaaaattaacctatatgttctgtgataaggacaaaaatcacactttctcctacttctcaatataagttcaagcactactaataaaggttggaaaatgtggtatttattttcaggaccacatttttgtgtaacttttggaaattacatactaaagtgtttcctcatatgacagtttaaaaaatatatcctctgctacttacaggaaataatttaacaattttcttagagaaatgttaaaaaagtataataaaatgatgtaaaccattttgtaggatcacaattttaaccctttttgaagacactatatataaaaaatggaaattatattttttgttcaactaagaatattaaaaatataagtagtggcaaagtgcatgtggtcctgttttaaaaaatgcaaacaatgaactgtatgaactacataaagtcagttttttagatgctttgaccactctagtaaaaaaatatttaaaagacacacaatagtgggaaaaatttttatttttatttctaattgtggtagcatcagggtggaaaaaattttatatgctatttaaatgttttggtacagtatgaatttctcacttttaagagaaaaaggtaaacacgtagaaaatatttaaaaaatcatgagtagtgtagtaaataatattgcatttttaaaagggaactggtggtattatttactaagtaagatcatttattcttattagtacttaataaaaacaatgactcattatatgaaaaattgaaaggctgagattgtaattaacacctgactgcaattgatgcttatttcaaaaatctctctttttcccctcaagcactctgtcttatcaagaacccttaagaacatagaaatgaatggcagaaagaggagtcatatttcaatacatcatgaaattccttataaaatataattttgaggaaataagttaaaaacttcggagtttttccttgcttaaatatttgaatctaaattatttgtgctgaacatttcgttatttataaatgaaaaccaataaatgtctaatttttagtttgtatgatttgatgtagaacttaatctcttttgtatgtcttccatctgttacaaattaatctacacatcatattttcatttcctaatgcccattgactagactatatagttgttttcaatatactgtatgtgcaaaaatttcacattcacattcgtcatcatctttattaatattaaggcttttgttacccttaattcaaagtttatgtcactattaaagggccaaacacactagagataagaaactatatgctgtattagaggatctgccttattaaaggcagaagagactgcccttcagactttctaaatgtaaaaaacttttaaaattaactgtaatatttgctacaacgttaataaccaaattgtttatgaggtggtgtactaccatatttgaacatgtgctcaaatattgttaaagagacacaattaaagaaagaatgacccttggaattttatttaattttatttatttatttatttatttatttatttatttagagacagagtcttgctctgtcgcccagcctagagtgcaatggcatgatcttggctcactgcaatttttgcctcccgggttcaagcaattctccttcctcagccttccaagtagctgggattacaggcgtgtaccaccacgcccgctacggtttttttttttttttgtatttttagtagagacaaggtttcaccatgttgaccaggctggcctcgaactcctgacctcatgtgatccacccgccttggcctcccaggactcttggcatttttacattttacactttcaagtctttttttatatcaaataatttttggaattatgcagactacaaaatctgaaataagagagtcctacaagcatcaaaaaatgagtgtcagtattatcaaggtctgttagagacatgaaacagcaacactgtcactttttcatttgaagtgagagttatacttctaattatttcagctcattcataagcatatgtaatagcactagtacccagatactaggaccccgattaggattggttgttggtattagaacgagttttcctttctagaaactactcagtttttctaactcaagatcttagtttctcattacgatgatattctcaaatgcccaatgtacaattctctactgctgggtatgaaatagcttcttttggaaatgatgccacagctgacctaactctgtggattaaataagtattaattcattcaatgttaaacatgtatatttcagaactgtccttgagttcatattcattattttaattaatctcctgtagtaggttcccacagtggatctcataaaaatggaaatttaattaaaattaaatatcaacagaaaagcattaatctttttaaataaatttcccaatctatcaattaaataacattattgagcacctgctatatcccagggaacatgctgggtagtacaggattcaaaatgattaaaattcacctcgttatttcaaagaactcacaaagtaaaaaactacttacttagtaaaagagataaacttgtactagtgattgcagactcaaaatgggtgatgattgtggcttatctagtgatatttctagtgaactggagatggcatgcactgtttaacctggacaactacttcgctcaaggtgaataattgtcatgggggaatattgtatccagtattgccatatgttctgatttgttaattgtgaaatgcactgatttttatatgttgcgaggagataaaaaattatttaggcagtgcagctcaaagtaaactccacatgctaaagaaataaaaattttgaaaagtgcaacagtggaagcatgtacgaagtaaagtggtggcacaaagtaggtagtatttaacctttttttttttttgtatgaatgtggtataggaagcttcttggaaaaaagttaaagtaaatctgaggtttacaaaactagaaaacacacttcaagtagaaggaatggcatttgcaaagtcaaagctcatactctatgc

SEQ ID NO: 16648 - DNA, 8246 bp, Human; identical to SEQ ID NO: 11923
  misc_feature (1)...(8246): n = A,T,C or G

SEQ ID NO: 16649 - DNA, 20229 bp, Human
ccagcctcatcttccaccatgtaccatgtattggatatatattgctgcataacaagtgactttaaaacttaggggcctaagacaacatttattatcccacagtttctgtgggtcaggagtccagggagggtttacatgggtcctctggcttaggagggtctctcccagggctgcaatcaagatgtcagctggggctgccttcatctcaaagctcactggggaagggttcttttctccctgaatatcggctggaggctactctcaggggccatatgtgggcttctccataaggcagctcacacttagcagctgccttcatgagagcaggaagggcaagagagagaaggcaagcaagagggaaatcggtcttttgcaaccacatcccatcacctttgctgcattatattcattataatagaatgtggccccaggccagcccacactctagggaagaggactacacaaggcatgaataccgggaggtgaaaacacagggccatgttagaagttgtccagcacaccccagtatgtaccctgtgctctcatctcacaaaactcacccatgtttcccaagggggaaaaaatgctttattacccatgtcttacatttgctcattaattcactcattcaaaaagtattttatttctactgtgagctaggtagtgttgtaagggctaaggatagagcagtgagccaaagagacaaagcccctccctcgtggagcagacattctagtagggagataaacaaacgataaacaaccacacacttagtgcgacagagggcaatgagttatagcaggcgaggggcatgaggggtgtcagtggaggtgaggatgtaggatcttatgtagggtggcctgggaaggcgtctctaaaagcttacctctgagcagagacatgaaggatgtgaggaagccaccatgaggctatttaaaagaagagggtcctgggctgagggggacatcatgtgcaaaggtagctgatgtgttcaaggggcacaagaagttctgtgtgatgggagcggtgtgagcaaaggggaaaacgcctggagctgaggtcagaaaggaaaccaggagccagatcttctaaggtcttataggtcatgaaaagggctttgacttttatgctaagatgggcgccactggagaatatccccttaaaatgagctactttacatgcaggaaaaaaacaaacaaaactcctttctttataatttcaacataccattttcagttctcccttataaagaagtataatttgcattataatgtagctacacatctgaaatatgtattcttaatggatctcacattttctaattacttactttaaaagataatatctgaaagctttgggtgtttgagatggcttttatctccagataaggaaagagaaatcaaacaaaaccatttctgggaaaccgaggtccatttcttgcctaaagtcaaacaacttcaaagagtctaggctagaatccaggtccaggtagacatcattaatttcacaaagccagatgtcacctggcagatccctgcctgagagcctaaaaggacatgttgtaaagcaggtgtctaggatcataaaatgagctgatgcctatgaatggcctaaatcccagtgaagtagttactaaaaagcagcctggtaactgattggatacaataagggctagaagaggtcttgttgatactagcacattatccaaacttcctgatgtctgacccaggcctttggtaaaggacattttctcaacattgccttcactgcatacccagccccaggtttctcatatgactgtgcaacctagaagtcaccttcagacaccttggagggtctatagtcggtaaacttagataagcaaatgaaaatttacttacttgtatcaggaaaggagaggtcagcacaggggcagttaggagaggctgggttggggacagattatttaacaaagggaagcacatataagagaaggtaaagaaatattccacttgcaaatcgcggtacctgtggatgagagacatagacgagagagtgagatggcctggtttgccctctacctcctgagccttctctgggctacagctgggactagtacccagacccagagttcatgctgtgagtatgatgtttttccaaggaggtcagggaagcagttgccctggggaaggggctgtgacctctgacactgagtggttgaaaatagcaatcactataggaattccaaaatgggtaagtctgagtgtgattgtgtgctgttcatccttcctgacttaatagcataagttctttgagagacaagtctatatgttttttattaagagagatggggccaggtgcagtggctcacacctgtaatcccagcactttgggagactgaagcaggaggattgcttgagcccaagagttcaagaccagcctgggcaacatggtgagactccatctctacaaaaaaaataaataaataaaaataaaaaattagctgggcgcagtggcatgcacctgtggtcccagctactcagaaagctgaggtaggagaatcgcttgagcccaggaggtcgaggctgcagtgagctataatcacaccactgcactccagcctagatgacacagcagcaccctgtctcaaaaaatcaataaataaaaataatagagatggaagtactactgcaggaataatggttgatggtacaaagacagacactcagtggctattgtgaccagacaccactacatactagtgagagattttggtactcactgaggataaattatatcccaaatctttaatactcttcatgaaagagtaaggaaaaaaatgaatgcaaggaaatcagtgatttccaggaaagtgatagaaactatgagaaatgtcatgagccatattgcttgaagttactaaatttaaaaatcactttcttaaggatatggattatttgagaagatgtagaaactaattgtcctcaaaagtaaaatctcaccattttctccatttctctttagtgacttaggacactaatgctaatcaagtgttctcctaaaaggcatcaaagatggccaggcgaggtggctcacgcctgtaatcccagcactttgggaggccaagaagggtggattacctgaggtcagaaattcgagactaccctggccaacatggtgaaaccccatctctactaaaaatacaaaaattagcctggcgtggtggtgcacacctgtaatcccagctactcaggaagctgaggcaggagaatcacttgaacctgggaggcagagtttgcagtgagccgagatcgtgccattgcactctagcctgggcaacaagagtaacactgtctcaaaaaaaaaagaaagaaagaaaaagcatcaaagacacggggataatgtttttgagaaggaatgagggttagaaggtgagtaaatggctttcctcttctcagccgttccctcagcacaggagcccttggtcaatggaatacaagtactcatggagaactcggtgacttcatcagcctacccaaaccccagcatcctgattgccatgaatctggccggagcctacaacttgaaggcccagaagctcctgacttaccagctcatgtccagcgacaacaacggtgagacatctgagccgctcgcactctccctgaatctcacacatcacataccacctccagattccaactcagcgtccttcccaccccaatgctgcctctgactgtaaataaactacccaaacacctttccttacatacctggaaggtacctggaaagaaacatgtgtgaagtcagagcattcatggaggaggtcagtaaagcagggagagctctggactagacgtcgaaagagcagccttctggttctggctctgccacgtcataactctgggatctgagacaagtcactggatactgctcagcctcaccttgcagatgattgtagtaacaataaccctactactactaatagcaatgataataataataaaatctctgttctgcctatctcccaggagctgcctgcaggctcaagttagataaagtttaaattattttgcaactgtaaatttctgtatataaatctatatgagtattttgctgcttttctaatcaaataccagggattctcaaataccaaatactagagtcatcaagttacacagaggccactagattaaatattcccttacgtattcttccatatttttttctttggaaagacagatcaaagaactgctcatattattaaaaagtcaaaatgctctagataaaaagcagagaactcatcactggctcctggagagctgtcccctgaggatgtctctgtctaaccgttgtgttctcttctctgcagatctaaccattgggcagctcggcctcaccatcatggccctcacctcctcctgccgagaccctggggataaagtatccattctacaaagacaaatggagaactgggcaccttccagtaagacctgactggaagggagaaaagagtcaggcatatggttttacctaagaattttaaacccagaaaggaaaagggtgggggtggagagaaaggcaagttagggaagagacaatgtatccttcactctggtccttctgataatccagaccagaaagattcatttccaatccaaaatgaactagaaaaggtcatgatcccaaggacacaagcttgtccagccatcacctgtctaaagacacagagtcatcccttttattctttgcagatgcctgatgacattcttttgaaaaacactgaagttgctctttgcctatgctgtgtctctctttgggggcaggttttctagcaatttccttttcaaaggcttggcttttccttctttgcaaatgtcctcatcgtggtgactgtgagtctgatgaaggttctctatccccttcggaggccccaacgctgaagcatcagccttctatgggcccagtctagcgatcttggcactgtgccagaagaactctgaggcgaccttgccgatagccgtccgctttgccaagaccctgctggccaactcctctcccttcaatgtaggtgagtaggtcaccactaccccgagctgggaacatcagaggcatcgtgaactgaatggtggagctggcagggaagtgacaaaggagagcgtcccatggaggaggagctaaggatgtgaacgtgcctgtggatgggagatatttaccagatgtttgttgggcaggtgaattgaggagtaagtgaaggaagagggggtagtattatgtagaaacaaggacaattgataatacttgatatgtctggcagctacagaatctccgctgggaacaatagtaatgccattcaagtcagaagttcttcccaaattaaatatgaatgtcttgcttcagttctcctctgcatcctctctttaatcactactgatgctcccacactccattcttttcgatgcttctcctcattacatccaaatatcctctctccattaaacagctactctcggaaccctaactcgtgatatttcccttcatggcaactcggggaccaccttgcgtctttgttctgcaagcatatggctgcttgtgaatagaagcttttccctctacaacatcatgtcctccttctgtccccttctatggataatgatccttctctgtgggggccactgtcacagcccgcattcatgatcaccttttctcctctgccaactctctaagcaatagtattatctcaggttttcactcccttatgcatgccccatcagcaacctctcttgtttcagtttctgtcagacaaacaggtgaaccactgctctaggatcctccctgggggttaagaacagactggtctccctttcacatctgggacctcacacatttctggggcatctctgcctccaaaaatttggacttatttacttctggttgtcagtaacactagcacccttaacgaagttatgcaactttcaaatggagatttggccctgctgcttacttaatttttctgagcctccattttttgtctcttaaatggagatgattacaggtactgtttcacaggttgttctgaggagcaaataaaatcatggagccagaatataataagcacacaataaatgttagctgttcatattgctgtgatggtgactatggtgatcttataccctctgtcattcacagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggtaaacacgtgctggatgctcttggttgggttcctgccaataagcctggattgcagaatcaagaggccaggcttctactaacatctctgtgaaagtccagctagtatgacctgagatatattctttgtggtgcctgggcctcagtttctctactggtaaaatgcaggtaagtgttaattcctccctacctcctatgtaaagtgtgaaaacaaatctatatgaacttgtttctctttcttgggaaaaaaaatgaaacaaataaatcaagaaatatattaatttattattaataatgatcagtttatttgtaatagttacagactattacaattttgatgtataaataataagaatattaaagcaggccctctaaaaatatacaattttctgatgcaatcttaccagccaagtgttctttttcagtgttttaccttgatctaaaaatagcaagtttatactcaaaatgattaaggaaaataacctaaagttgacccagcctcacaaaaacccatagtaaatggtaaagcagatctatctgtcagccaagtccatattcaattctgtgctttcacagcatgcattcccaggcttggattctgtaagatgtgtttggtattcatagttccaaatccaacaacccaccctaccctagttgattagggcagcagcctccatagaagacagatgcaccaatggtggtgggcagaaataaccaactagaatcagaaactagcaaccatctgtggctgaatcctctaatcccaactaagaagtttgagctccagtgtctcaaaatgtcctatggggattaataggaccagggactcttcaactcagaaagcccactaaagggagaatcatggaatggtgatgccagccctaaacctaacatagttgcggactattagaaagaaattgtctcctggggaaaacaatggagactagtattgagatttcatacattaaaaattagaaaaggatataagcagcctaagaattggttcatgttaaacataagagcaaaaaaaaaaaaatttccacttcaatggaccacatatagaagtgactaataaaaatagagttcatttctatgtcacagtcaaggagactttgtcatagaacaaaaccctgttttttccatggctgaattttacaagaacattcccagtgctctggtctagaagctttttggaaagaaaaaggcagtctggaagagatataaaagatggtttggggattttttttttttatgtgtgactctctaaaaataaccttgcttcaatttatcaccagacagtgaagtgtttacttttgctaacttggtttgtgaattctgtttggattttatcacctgccaagtacactttgataagctgtacctgggaattagagcttttcctatcaaaaggcaggaccctgtctacatccaaataccacaggccatgtggatttcttgtcagaatacataatctctccctaccctttttactgcctctatctggaacttatttaggcatcctgaaatctggaatcaataggtgtctaatatataatattttcctaatctaaaatattctgatatagaaaatcaaagggctctggaactatcacaatttaggtttgactcccacacctgccaccatctcagacaaatattgaatttccccagattttattttccccataataataaggttgcaattaggttaaataaaatgtggtatgcaaaaaaatgcatgcataatgtaatgcttaacaattgttcaagatctgtctcagcagagcagtgatgctagtaaagttccttttcagcctttgttcaccttcttccaagatgtcagtacacttccagtggcccaggccacactcttccctacccaaagacgctcatgaggcatttcctctgttccagaacttctcatctttcttccatgaatatcctattgctttcaagtttcctctgataggcgcttatcttgaaaagggatctgataggccaggcgtgatggctcacacctgtaatcccagcactttgggaggacgaggcgggcagatcacttggggtcaggagttcaagaccagcctggccaatatggtgaaaccccatctctactaaaaatacaaaaattagcctggtgtgctggcaggcacctataatcccagctgctcaggaggctgaggcaggagaatcacttgaacccgggagacggaggttgcagtgagccaagattgcaccaatgcactccagcctgggcatcacagcgagactccatctcaaaaaaaaaaaaaaaaaagaaagaaagaaaagaaaaagagaactgataaacttcttgatggaaagttattaatgacgtctaaccacttaatgtgttatcctctctagagtgttggcattggtgatgtgtaatcccaatgaatataccttgcttagtgaaatttgggaggtgcatatgacaagtggacaagatattgttgctgaggagcacccacctgatggcccttaaagcaactgccttgtaaagtggcctctgtccagagccatgcttcatagatgctgaggttcagtgatggttgtccctgtcacaactgcccagttgtgcatactgaccctagctgagacagccgtttctgactcctctctctctcttctcccatttcctattccaagcttcaggtgaaccagtcattaacaatctcagcctattaacatgctctggtggccataatcgcactgtaaaggaagggaggtggtaatgacagcttccacatcacacatcacacatcacgaaatgcttttatacattagccccttggaaccgcaaatgactcccccaacaatagacagaagttattatttctattttattcatgcgatagataacgcagcaaaataggtgaatggctgaatggcttggtgtattactcaagactcattttgcaagtaacagaaacccaaatccttttagctcaagaaaaaaatgaggatttactattcacatacactgggaagtctagggctgaattaggtggtttcaggaataaccagaataaagggctcaaatcatgatatcaggagccactcttttttcatcgtccagccctgattttcctcattctttcctgctgcagggcttcttcaaagtggctgagaaagatggtcactagcagcttaccgtttatttgcatggtcccagttgaataaccttagcaggaaaaaaaaatctttgggtgtcccaatgtctgtatgtcggggaatgattctgattagtacatgtgtccaccaatcactgtcatcaaggggatggtgaccaccatcagcccagtccaggtcatgagtccatcctgggccagggttgtggagcctctgagagtcctgacacaagcacaaagtgagggaaaagtccatcaaagagggcacatggcaatatgaaacaaggggtctactccgtttatgtggctagactgtcctaggctaaagctccctctggagcccagctctcaccctcactctacattcaagagtcgttcgtaaatatgactgcctaatagtgttccctggatctgatcattgcacagttctgtgtctgctgtctgacagacactgtgctaagtggtggggacatagcattgaagacaaatgttttccaaaccttacatagcattggctttgcattctgggtgactacgtgatcaccatgattagtgatcaagtttatctcttaagacatgtaagagccaactctcagctatgcctaattactctttctctctctttctgtcttccttcccaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctggtaagacatccacctctccttatgtcataaagcagcaacttatgccagaaatgacatgtggatcaatgttaagtggcatataggcttgtaatgtccattattcccatgtgggcagagtacatctgactcccagtccttaagagtgtgtgctagcacacagacataccttcctgcactcagaactcagccccatatctacttcattcagcatatatttacctagctcctactatgtgcaaagcattttgtgggatactagaggtagaagaagctccatggtcccagctatcaaacaacatatagcttcatttattcatttcacaaatgtaccatcaaacactatgcatatcttatcatatctgcctttcacaaagtcagaagacagatgtgtaaacaaaaactacaatatttgggacaatcgagtaagtattaaatagaagttaaagccacacacagtgcaaatgccaaaaagaaaaatagtgaccagttgttgattttgtttgggaggcttcagagaagaacagaattcatatttaaatcgagccttaacgatctaaatatgaaagctcgatgcacgcaatatatcaatgagatggagtggaaacctagcatgccactttttaattaaaaatatctttattttatccaattatgcatataattgaaagacactaaaaattcaaacattacagaaatatgcatttggaaagtggaggtcttgcataaaaacttattactccagagattactagcgtttggtatggattcctcaaactctttttttttaataaaatgctaacacaaagcatcattcctcttgcattgcatgaacttcctaagacaagaagcaattaataagtttctcgtctatctcaatgcagaatgtggagaccaaaatcaagcaaactgatcccaatcctaccaaaaactaccacattcactcaaccccttaggctgcttcccagtgatgtcccaaccttaacaaggtggccatggagtttttgccggaattctatgctagttgtccaagtactttgttaaatggtatgaaactcactactttctcaaaatgtcttctggggtaagttgccaataacagagattttgcacctatgatacaaaccccataatctttgacaaatgtggcctctttgcccttcacagatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaagtgagtattacaaatgtcattcatcattctctcaaggcctgatctgaattcccattttttatccatcctgttttcctaatttttttccttttgataacagatttttatttaatagcgcttgagcagctttcaatctaataaataggtaaggctctcatgaaaacttaaatcatataagtcaacatatgatgaagttttaaaaacaaaaattcagaggagattcgaaagtccattgcagagtagaacaggcaaaagagactttgtagctttgaaacacaaagaataggtactatttaggaagatgtgggaagaggtaagtccagaaaaagaaatggccagaacaggccgggcgtagtggctcatgcctgtaatcccaacactttgggaggcccacgcctgtaatcccagcactttgggaggctgaggcatgcggatcatcttagctcaggagtttcaccaacatggtgaaaccccgtctctactaaaaacacaaaattagccaggcgtggtggcacgtgcctgtaatcccatctactcgggaggctgaggcaggagaatcgcttgaacctgggagacggaggttgcggtgagccgagatcatgccattgcaccccagcctgggcaacaagagcaaaacttcatctcaaaaaaaaaaaaaaaggaaaagaaatggccagaacaaagcatttgcgataagactgagcaaggaatttggggccaatgaataggccaggtggacataccaggttgggtgacagtgtaaaagtcttgaaataccaggttcaggagactgaacttcattttgcaagtttttgagtaagaaaatccacttggtaaaatgttgcttaggtcgtgagaataggagacaaggctaaaacataggacatgactccaataatggaggtgtgaagtgacgatgacttcctctgggatacacggacccacaccaaggctctgtgagtgatgggacatagaggtcaagagaaagaagcttcaaaactattgattaaagggtcaagaagaaagaatatctttcaaagaaaaggattaaattccttagatatgtttaatggtaggcatttgaaataggaacattagaaggcttttggcggtatagtccaggcacagtggctcatgcctgtaattacagcactttggaagctgaggcgggtggatcagttgagggtaggagttcgagactagcctggccaacatggcgaaacctcatctctactaaaagtacaaaaattagccaggcgtggtggtgcgtgcctgtggtcccagctacccaggaggttgagacgggaagattgcttgagcctgggaggtggaggttgcagtgagccaagatcgtgcccactgctctccagcctgggagacagagtgagactctgtctcaaaaaaaaaaaaaacaaaaaaaaggaaggaaagaaggaattgagagagagaaagaaagagaaagaaagaaaaaggaaggaaggaaggaaggaaggaaggaaggaagaaagaaagaaagaaagaaagaaagaaagaaagaaagaaagaaagaaagaaagaaagaaagaaagaaagaaagaaaaagaaagaaagaaagaaacagaaaggcaggcttttggaggcatagaggaagtactaggaaaagaggtcaggacatgcaaaaaataaattggacagtcatctcttagaggtgatgacctaagtcaagaacccatgcagtagatagcagatacttgcacccaataaaaccataagacatatttagttattctcattttacagatagaacccttaggcccaaagaagttagtaacattcctaagatcacataacatgtaactaatagagttgagagtggaacccaggttggactgaatctgatgctcatgttctttccatgcccctctcaaggtaggggaaaatacagaaataaatcacagaggagaaaattaacttttagggcatgtttatagtttgcaaaaagaggaagcagtaaagaaacatggagaagtctaagctataggaggagaggaggaaaaatgccaagtcatggaaaggaaaaaagcatcttttctttttcaaagaaaagatgatccaaattcttcaggaagatatcaagaaggaatactgacaaaggctaaggaattgacaactgagtgataccacgtgggtatctattccacccggttctgttgagcacattgtgtctgctgcttactgcacgactccataacttccctaacttccatagacaggtcaggataaaaattgcacttcaaaactatttaattttttttttttttttgagacagagttttgctcttgtcacccaggctggaatgcaatggcgcgatctcggctcactgcaacccccacctcccgggttcaagtgattctcctacctcagcctcctgagtagctgggattataggcacccgccacgatgccctgctaatttttgtattttcagtagagatggggtttcagcatgttggccaggctggtcttgaactccagacctcaggtgatccacccacctcagcctcccaaagtgctgggattactggcgtgagccactgcgtctggcccaaaaatatttaattttaaaaccctctgaatataccgtactttacttctctgaagttagctttaattttgcctaatttttctttttctgattataaatgtattaaatacatagagcagaaattttgagggaaaaagcaaaaagaagaaaaatcatctatagtccacacacaatatcacaattgttaatattttttataacttttgtaggtttttttctatgcatattacaaataggtgtgatccatcatatacatgggacagatatttcatgtaaaatttgtacctcatattttcacttaacgttattgcataagtagtttcctgtgttactgaaaattattgacaaatattttcatggcttccaaatatttaatcttggatattcattccatcactcatataatcatttacccatttgggggaatttacattttttaaatttgattattaataggtgttttcaaaatccattcattttcatttcatttcattctaagtgaagtaatttcatattcattagtcatttgtatgtttgcttttttaaaatttatttatttatttatttattttgagatcaggttatgagactggctaatttttgtatttttgttagagacggggtttcactatattgccaaggctggtctcgaactcctgggctcaagcaatctgccctcttcagcctcccaaagtgctgggattgcaggcatgagccgccacacctggcccattttctcttttttttaaacttaacttttattttaagtttggggtacatttgcatgtttgttacataggtaaactgtgtcatgggggtttgttgtacagattatttcatcacccaggtattaattctactacccattagttatttctcctgatcctgtccctcctcccaacctgtaccctctgataggcccctgtgtgtgttgttcccctctgtgtattcatgtgttctcatcattttgctcccacttataagtaagaacatgcagtatttggttttctgttcctgtgttagtttgctaaggataatggcctccatccatgtccattgcagcacgattcacaatagcaaagacatggaatcaacctaaatgcccatcaatagtaaactggttaaagcattttctcatttgattttatctgatcattttatcagataaaatcatgctcaaaagagaatatcatttaaaatatctgaagcatttatctgaagcatttaaagtgtctctatcctggcgggtggatgcttgagcccaggattttgaggctgccataagctaggatctcaccactagcctgggtaacaaagtcacaccttgtctctaaaaaattaattaactaattaattaattgactgtctctatcccttcatcttaccgcttattccctgacctaaagtgagatgttaatcatatataaacttttttttagatttgaaaccacaatgacatcttggggccttgtcgtctcttctatcaacaatatcgcggaaaatgttaatcacaagacatactggcagtttcttagtggtgtaacacctttgaatgaaggtgagggaagaaaagacataggcgttatcttccatagtctgaaggctacattctttaattattttttcatttaatttattcattcattcacttaattaataattatgagatcatgtgtatatacaataattctataaacagtgattgcttatatatgtatacacacatatattttgtgtatatatatatatatatataatcattacatagagaaagagattaattctgtaggcagcgataatacttttcacagagaaggaaagtaagtcttaagagacattaaagggtcttgtacaaggcatgcatctagaatgtaaaagtggataatcaaacccaggtttccaaactctaggacaaatgtgctttgtacaaaagtttcactcaaaatttatgcttcaccttctctcttaaaaaaatctccagagagaggaatgcctgcatatggatgttggtgcatgtttcccctgaaaaaattaggagaaagtgggaagaataaaactcagacttcagcaaaaccttaacatttgttaaagcttttgcacacatattaaaatattccccaatttaaagagcattgctgtatggttttggtctaagcatgacgttacctagttaacctgatgttaactgtcaccatgcagagacatgtaaaggcaaataaagtcacagtacagccaaggctataggttggtaaagatgcttcattatccaatattacagtggaggagatgtttttcttagaatcaatcatgtatttagcaaaatcttgccagtcagaatttgtggagttgtagcaaagcatataataaagatcttggaatcacagaggacttggctagaagctctttctcttatttaatagctgcattatattagtagtaaatctgtgagccagtttccacagctttaaaatggaaattgcattaatcatttattgggttattgtaaggattggaaataatatacttagaatgattaagtacaatgttttttgcatggcatgtattcaaaaatattaatcatcattattattattagttttcccatcaccttcatcccaagaaatgtctctatcaaaatatcccatataccccataaacatacacacctactatgtacccacaaaaattaaaaattttttaaacacccagaatttttttaaaaagaaagtaattcactttgggaggccaaggcggacggatcaggaggtcaggagatcaagaccatcctggctaacatggtgaaaccccgtctctactaaaaatacaaaaaaattagtcaggcgtggtggcgggtgcctgtagtcccagctactcgggaggctgaggcaggtgaatggcatgaacccaggaggcgaagcttgcagtgagctgagattgcaccactgcactccagcttgggtgacagagcgagactccgtttcaaaaaaaaaaaaaaaaaaaagaaagtaattgccccaggaacttaaatcaggcatattctcatgtctacaaattacttttcttccctgggagaaagaatggtaaaggcctctgagaaacaaaaatatttgggcctgaaactgtcattctttctgttgccagctacctgaaaggtaacagatattgccatcatctatctttcctgttctgaaagacaaaaattctcaacccactgctctttcttatgtcttacaaaatcttcaaaaatgaacaggaagttctcccttgaatgccctaattttggcctaaataagccattttaacaataaccaccacttattgcacaattattctgtgtcaggtactgtattaggtacccagcggtcattattcctaattttgaaaataactcttcagagtaaatattattaacaaaatcttgtatgtgaggaaaaagagactcgcgcatcttaaagggtatacccaaagacttactccatgaagtggtgaccagagactggaaacaagaactccctaaatctcagtttcattttctcttcataatcaaactgcttatttctctctaggatgattttactcctttaaaaacatttaatgggttcactgcatctagctcactgcatcccttgggggatggaggtggttacatgcaccacagtcacctcatgttattctctgcttatttccaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcctggtaaaaacatggagaaccactatgtagaataaaaatgcaaagttcactggagtctcaacatctatgactcatgaaaataaaattttcatcttctcaacacaatgactgccaatcatcatttaaacctaagctgaggggaaaagggagagtagctgatatttttggatatcattctgatttcttgattaattaaatagcacattccctatttctacaaatgatatattttttaaatttcatattttcttatcataccaagcactccttttcaaattgcctaacgtaaatatgcccacgtatgtacatacatgtatacatgaaatgaccaaacatttcaacatataaaactcccagatggttcaaaacttggtaattgatgttatgtcttaactctctccttccatttccaatttttttgttaaattcatatttaaaatatatatttagatcatttaatatgtacttagtaaactaacttatattcaatatattatacagaatttaatatatcatatattttacatgattatatataacttaatatatgttatatgattatatataatttaacatattatatattttatatgataaatagatatagatctttgaaaaaaaattaagctttcaaagataaacataactgtaatctctactggtaggagtgaacactggtacaaactttctagagaataatataaaaatttgtatcagaagacctaaaatgaccgggtgtggtggctcacgcctgtaatcccaaaagtttgggaggccaaggaaggtggatcacctgaggtcaggagttcaagaccagcctgaccaacatagtgaaacccgtctctactaaaaatacaaatattagcctggtgtggtggcacgtgcctgtaattccagttacttgggaggctgagggaggagaaccacttgaagccaggaggcagaggttactataagctgagatcacaccattgcactccagcctgggcaacaagaacaaaactccatctcaattaaaaaaaaaaaaaaaacaggcctaaaatatacacacctttggccaaaaaaaaaaaaatcccaattctgaaatttttatatatatatatgagaacacataaatatacaagaatcaaaaggtcagctgtaactattatagacaagagcttaggtgtacagccacagaacacttcctaaaactgaaccccagaatcagacagactgaactgcccaggcacagatgctcccatctgagcatctcagagcaagtacctgctctctggtaacagtctggctcctaggagaaggaggtgtgggccacacaggcccaggtcctcaattcaaacttatctattaggtaactctctctatcccagaaaaaggccaagactgtcactataatagaaggaaatctcaggggtggtgagcaaagtgctctcacataacataatgtttataatatgggaaaaaatagaacaatctagatgtccaacagtacgacaatggacaaactctggtgcatccatatgatgggatacttaaaagttactaaaattcatgttgaagataaattcttacagacatgaaaagacgttcatgatgaacatgaatgaagtgagtgaatgaagtgaatgaaggcaactccaagtgaatgaaggcaagtacatgacgacattataatattgtccatgctggagtgtttcagtggtaatctctgtgtgcagaattattggtgatagggtttttttgtttgcctctctgttttctaagttttagccatacaacacataataattgagcaactggaaaatggaaaaaacattattttatacaaagattatttctgcttgtttaacaataaattgggcaaccaaagagatttctctgtgtgtgtgtgtgtgtgtgtgtgtgtgtgtgtgtgtctgtgtgtgtgtatgggagagttctgtccccaacctttgctctagtaatagaaactgaggaaacaagcctagggaggaaacaaagaaaacaaacagagggaaatcacagatttgtttcatataatgaaaaccttgttttagctacctatctaggacttaattgcgtgtgtgttcatctatat

SEQ ID NO: 16650 - DNA, 38298 bp, Human
  misc_feature (1)...(38298): n = A,T,C or G
actcccagagttccttggtattttttaaactgctacagactttttgtaatttgagaaacttctttagtttacaatgatgacccaggcagaagagattcctacaatgatgacccaggcagaagagattcctaagaagtggtttccaaaaagctccaataaggaggaatgtggaggaaggtccaagtagtatacttggagtagaaaacatgagcgagctggcctgtcagctgtgcatctgtaattcagcctgcattattcataatgtaactgaagcttgggggtggggaggtaagaatagaaaaaacggattcatgttacagtgtggcaggtgcaggagatggaaaatggcccagttcattgagacccttctggccttcccatactatttgaggaaggaagagcagttcatgtgaaaaattgaacaacaaacctgtcttccagactttctcaaacataccaaatcttatggggtgtgtgccatttctggcatgcaggaattctggatatgccaggtgtgtttggctgcttgactccactgaaagggaaatggctctgctttgtactgtggcagttggcaaaggactttgacctctgtgttccaatttggacagggaaaagtgcagtctcaacatgcaggttcctgggcataaccagcgggtggtagggaaatgacacagtttgtgttagacactcgattgtgctagaagcttgatattttatgtgaagcttggtattctatgtgaagtgtcttatagcttgttgtcaccaagtaatgctgtaaagttcaaaagttagtctattaatagaactgtcagtcactagagatcgggaaaatttttacacccagttctctgagagcagatctgctgaatctttcctagctattaatagacggcttaggagttcccaccagtagagtatggtggaccttaggaatgaacatattccagaaagattaaaacacttggtgattcctttttacttccccagaaagctagttattcttatttcatatcatttgaaccatagccaatatttaatactctaaacatttaagggtgctttttttacacttctgcgatataactctaagcatgatgtaacattgggctgagttctcatttgggctgagttacagtcgggagcgagatggtttggtatatataaaatagagctattcttaggaaatgagattgttgcatgaggttatagggcaatttataattacaacttgctaagtaaaagataattcctgactgcaaaagggcatgaaggaacttactgagatgatagaaatgttctacatcttgattgtggtggtggttatgcacttgtgtacatttgtcaaaactcattcagttgtacctttaaaattgctaaattaacattgcatgtagttatacctcagtatagcctatttctttctttctttctttctttcttttttttttttttttttgagacggagtttcgctcttgttgcccaagctggagtgcaatagtgggatctcagctcactgcaaactccgcctctcaagttcaagcgattctcctgcctcagcctcctgagtagctggaattacaggcacacacccgcacgcctggctaatttttttgatttttagtagaaacagggtttcaccatgttagccaggccggtctggaactcctgacctcaggtgatctgcccaccttggcctcccaaagtgctgggattacgggtgcccggcctgtaaagcctatttctaaaaggaaaatggtaagagggacagcaaagcaaaaaaaaaaaaaaaaaatctgactcagaaacaacacttataggctctgaagggaaatccccactaattgtttcgtgaattttagggacccgtttgagggactagaacttgctgattcctaagactgtcatattttcagggagctcagagttatgaaaagaaatggaatgtgataaaggataaaccgtcaactttctgtttaaattgtctttgtcttgttattacagatcaaaggcagaaatgagacatacctgccgtggtaccatcaacctcgccacagccaacatcaccgtggaggactcctgcaacttcatcatttccaatgggggtgctcagacctaccatctgaaagctagttcagaagttgagcggcagcgctgggtgacggccctggaactggccaaggccaaagctgtgaagatgctggcagagtcaggtcaggaacaaagaacacctgcctggggaactttctttttgccccttttatgcacagattttgtttgtcatcattatgctgtgtcatttgattatcacctatttcctagaggtctcaagcttctcgtcttcatgcagtatttctgctggagtgatggttctcaaccagggttgattctcctccccaggggacatttggcaatgtctggagacatttttggttgtcacagctgaagggagggaggtgctatggcatctagagagtagaggcctgggatgctgctgaacctcctataatataccaaacagccgccaaaacaaagaattatctggccaaggttgaaaaattctgtcctagaggcgtaacagttgttcttttgccttttaattggctaccttaaaattttgagaaataattattttattggtgggccagtcttgggaatattattcctcagaatttggatctattcgtgctttttctcctgataccttcttacttaactctttgttagttaagttgaaacaattttagtagactgccaaaaactgtatatgtgatattttctatgaaaaatcttcattttgctgcattggttaactaaaaggagcaatcaagttaagttttgattattcttcaaggaaaatggtacgattttctcctgatatattgatagtttaatcatactgagcttgtttacctagaactgaccaagatggtcatctgctgactttgttatcttatcccctgtcatttcccatactgtatgttcattcatcagtgaaaggagaattcactggtttgtaaattgtttggtagtaagttatattttgactttggccccgtctctctgtctagcagaaaggacaggtcttttgtctttttttttttttttcttgcttttagtgccgatgttagctcctccaaaggaagtgacactgctagaaaagcactttgcagttacaaagtgttgagtgtgagaggtacaacatagcttctgtacttgacttattattggagagctatttaaagtgagtttttgcattcttttcatggtggctttagtcataaagtttctgagctctctttcagaagacaaattaatggccttttttgtaatgtggactttgtctacaaagagctagactgtgattctcaactcatttaatacaggtcccatcagtcacctatcagatgatagtggagttgcaaaaatagttagcttggactagataggaatcatcaagctagagttaaggagctcagtaattaattcccaattccaagagcctttcagcttttccattctgtattgtaggtcagtggttttcaaacttcagtgtgtgtcagttacctgggcagcttattagaaaggcagattcctgggctttgcctcacaccagctaaattgaagtctctaggggtgggcctagagactctgcccctttgagaaggacctggggtgtttgtggtgcaggtgatctgtggaccacactatagagaaaccatctggtaatggcaagttttcagtgagtcagaatgcacacagcatgaggaatgttggtttgtttctggacagagtaggtagggttccaactgtcactcctggttctggaatcatataacctttcttttcattcctacagatgaatcaggagatgaagagtctgtctcacaaactgacaagactgagctgcagaatacccttcggaccctctctagcaaagtagaggacttgagcacgtgcaatgacttgatagctaagcatggcacagctctgcagcgttctctcagtgagctggagtccctgaagttgcctgctgagagcaatgaaaagatcaaacaggtcaacgaacgagccacactctttaggataacatccaatgccatgatcaacgtgagtgcagatggtgtctgtgttgctttttgattcattccctctttgaaacataattctccccaaatgcctaaaaattgtaattgataaagcacagaacattagggcctgcttcactggtcaagggctttaagttacattgtttactgcatgaaatagaacaggctgtacagattgaatgactttcatgctctgcttaagtgatcaggaggtctttgctgcagctgggaatcaggagtccagggttccttcactgactgctctgcaaccactaggacatctgatcagtattagctgagtcccttaatttctctaggtcgtgattttatgtatgtatgtatgtatgtatgtatgtatttatttatttttgtctcatttcatctgttggaactaaaagatctccctgagtcccttccattgtcatgttctttgagctttgagttggagtcatctccttactttactaacgcattcaggcataaagggtggtaagtggaggctagatcaggtactagtgagaaccttatagtactagttattcccatctttagtccttgaattcgaggataatttcgatgataagacaaaatattcaactttgggcacttttctttaaaaagagtggtaaaacttcagcctccttatgactcctaacttgggtggctgttgttggtttgcagaacattttagctgcttgggtgcaagactctgagtaaacagagcacccatggcattaccgatgtattgatacgtatgaagtgaatacatggtttaaacagtgctgcttttcctctactgattcttgcctggcaggttgttttagttaccttctgcataaaaacattcaaaggcatttcataagtgagaagagtactctgtgagaaattatgtagggtagattttttttttcctaattaaatgggatgaaattacctctctagtgccagactttcccatgaccatgggaaagtatcgtttttctcatttaacccctttcttacttaatagatagttggataacctttattttaacatcatttttctgatatgtttaacactatcttcagtgctgtgattcacacaaagtaaaaagacaaattacattctccacttagggactgcaggaagattatctcctaggactgaccagtcagccagtcagggtgcttgtgtttctgatgtctggtcgtgtattcctggagactgtgtgcctggttttccagtccccttgtgatcaggaaaacctcattaagtcatacagtcaattaaatagtaaatacgtatactttttaaataaaacaactcggcacaatggtctcctgagagtgaatgccaccttttatccaaatcagaggaacaccccaatccataattttttttttaccttgatgtaaaaattttgctaagtaaagcatccctttataaacctaaacctttagtttcaatttttctcttgaaaatgtactcatctttgttccttggggaaattcttccctaagttctaagtgtccagagtttgtgttaaagggaatgatctcttggaagtcagagatgagttctgttttcattctttactctcttgctgcactgcctgtgcccttttcctagccagttattgcttaaaatacattttttatccctgtgttgtttcctttgtaccttttagtatgatactagcaaggccttaagtataatacacgtgttaaaaattaacatgctagagcatcacagctctaaacgggcaaagttatatcaaaggaagaatatgtttcactcaattacttctttaaaaattaatttaatttttgattcaaggggcacgtgtgcaggtttgttacataggtatattgcgtgatgctgaggtttgggcttctaattatcccattgcccaagtagtgaacgtagtacgcaacaggtagtttttcaacctttggttctcttcctccccacttttggaatccctagtgtttattgtttctgtctttgtgttggtgtgtacccaatgtttagctcccacttataagtgagaagatgtgttttttttttttttctgtgtctgcattaattcagttaggatattggcctccagttgcattcatgttgctgcaaaggacatgatattgttttttttttatggccgtttcagtttcttgactgcttaggatagagcttttctaactgtcaaagtgaatctgatcagagaattaaatttgacacttttagtatattcatctgccatctattgagcatgagctgtgttccacgaactgtgctagtggatattgctgagggcagatatggtccgtgtcctcaggaagatcactatttagtgagggatggagaattaaagggatcattatggactatgttgagtgacttgatagaaatgagcacaggctgctatggtatagcactttggaagtatttggctcagactaggaaatttctctaatttcctcaactaaattctgaaggagcagtgagagtcttcctatgaagaaaggcaagctagagcttggggcctggagtccaactgccttcatgacctatctctgtaacttgaggcaacctgcatcccgtccaactgcctctatgacctatgtgtataacttggggcaacctgcatcctctgtgacatcaattccttatctgtaaatggtaatgatactagcagatacttcaaaggcttgttgaaaggcttttgtcagataattgatgtgaagtgctcggcaaagtgcctgacatatgattgtctctggcaaattttaattacagtcagtattactaaaagggaatgaggccaggcatggtgcctcacacctgtaatcccagcactttgtgaggccgagtcgagtggatcacctgaggtcaggagttcgagaccagcctggccaacatggtgaaacccccatctctactaaaagaaataaaaaaattagccagacatggtgactgaggcatgagaatcacttgaacccaggaggcggaggttgcagtgagctgagatcgtagcactgcactctgtagcctgggtgacagagcgagactctgtctcaaaaataaataaataaataaatgaaataaaagggaatgagggagaagctttgatccaggtagtggtatgggatattcagatctatccctttccccaaagtctgggaactgctggtaattgactgttagtcgagcaaggaagcagctagcatgaggcttgggaggagttaattgtgggggagagaaagggctgcagatcataccaactaagcttggtagtagtggattagaagatgagaccaatttggatgcagtcataatttttttctttttttttgagacagagtctcgctttgtcacccaggctggagtgcaatagtgtgatctcagctcactgtaacctccgcctcccgggttcaagcagttcttctgcctcagcctcccaagtagctgggactacaggcgcacactaccacacccgactaattttttgtgtttttagtggagatggggtttcaccatcttggccaggctggtcttgaactcctgaccttgtgatccacctgcctaggcctcccaaagtgctgggattacagacatgagccactgtgctcggcctttttcttttttttttagagacagagtattgctctctcacccaggctggagtgcagtggcaccatcatagctcactgcagccttgagcacccaggctcaagtgagtctcactcctcagccttctgagtagctgggactacaggcagagctgctacactcaactttttttttgagacagagtcttgctttgtcacccaggctggagtgcagtgcacaatcttggttcactgtaacctccgcctcttgggttcaagcaattcttctacctcatcctcccaagtagctgggactacaggcgcacatcaccatgcctggctaatttttgtatttttagtagagatggggtttcactatgttggccaggctggtctcggacacctaacctcaggtgatttgcctgcctcggcctcccaaagtgctgggattaaaggtgtaagccactatacccagcctcttttttaaatttttatatctttttttaatttttatatagagatggggtcttgtatgttgtccaggctgatcttaaactcctggtctcaggtactccttctgtcttggccttccaaagtgttttacatacgtgagctaccatgcccagcttataattataataactaacaccttattgaatgtttattgtgagcctaatgtggttctaagtgcttacatgtaaaacaacgactctttgaggtagttactctattgttactatttgtttatggaaaaggaagatgaggcacagagaggttaaataacttacccttatttgtacagctagatagtgggatggatctgtgatttgagccctaccggtccaactccagagtatgcactctgtactgtttctgagtaaggaggatggaaagacatgtacagatttttaaaatattaaagaagaatcaataggacttgataactggctgtgaggaaggaagcaaaagtaagagaaggatgccccttaattttctggcttggacaactgggagggccctgaaagttggattggggaacatcaaagggaaaagcagagacaacataggaaactgatgaggctgggtgtggtgcctcacacctgtagtcccaggtgtggatcacttgagcctgggagttgaaagattagcctgagcaacatggcagaatcccacctctatattaactacaaaaattagctgggcattgtggctcatgcctgtagtcccagctacttgggaggctcaggtaggaggatcacttgaacttgtgaggttgaggctgcagtgagccatgattgtgccactgcactccaacctgggtgacagagcaagaacatgtctcaaaaaaaaaaaaaaaaaaaaaaaaactgaaggtgatgagttcactttgggatgcattaattttgaagttactttgagccgttgaatagggagttggatattctattctgaatctcagtaagtgctgggctagaattagtgatttagtagccattagcctataggcagtggttgaaaccatgggagtaaatatcctgtttaccttttagcttctctgtaacagggaatagatttttaagcttacgttgcttgcctccttcctttatttatttattaagcaaactttatcagatccctattatgtacagagcaactaaattaggagctggagatctatatatgaataaactcaaaaatgtgtttttaaattgcatgtgatccatctggagagatagaaaatcagtcacgatactgctgtgcatgtgtaaaatagaagtttgtgcaaaatgcagtggaaatgtagagaagagactggctgcttatgagactggtggggagatgtcacaaagtagcatttgccatagatcttaaagaaagatttgccctttcttagaaacaggggatagggatggacattctaggtagagtgaatagcatatgctgaggtatgtaggcctgaaagaaatctgtgtccacgactgggcacagtggctcatgcctgtaatcccaacactttgggaggctgagatgggtagatcacttgagtccgtgagttcgatactagtctgggtaacaaggcaaaattccatctctacaaaatacaaaaattagtcggccatggtggtacataactgtagtcccaactgctcagcggggctaaggtaggaggatcacctgagcccgacgaggttgaggctgcagtgagctgtgatctgcactctactccagactgtgccagaaatctgtgtgcaagaaatggtgagcagttcagtgtggctgcattgtagggtgcagtgctaagtacacatgcctggcgaggagaatacaaggcaggtgatggccgtattatgaaggtctctttatgttcataaccagtagttagtatttgatcctcatgttagtggggagccagtggagggacttgatataatcatatttgtgggttttttctctaaacctcttctttgatttttcaagtaggcttctaatatttttctttttaaaccttcttcctgcacactgaaggctcctaatttttaaggtcagttgtttctcttagtgaccaaaataaaaaccaaatgagtttccccatacttggtctacctcagtgtggattctctgttctcagtgtctgaagtccttagctttcagttacttgagtttagtcaagaatttgttgaaagcagttatcctgtgtgtgctctcatccttctttcagtcagcagttctctacttttggtgcagttcacatacctgctctttttgatgttgtcacaaatacttcgtctgggtttactgctcacttggcatttgtttggttctcgtgaccaggaaagtgtaaaagaaccatgacaaccatatttactttttttctgggtttgaccttgatttcagcgtggagctagctgtccctgataccttggcataaaagggaaagtctttcattgtaatttgccagttaaaagttcccagaataaggttactcaatgggcttgcagaagcctgaggggaaactctgactagttgagctgacacagtcaacgctttctccatacaggcctgcagagatttcctcatgttagcccagacccatagtaaaaaatggcaaaagtcactacagtatgaaagagaccagcgtatccgactggaagaaaccctcgagcagctggcgaagcagcataatcacctggagagggccttccgaggagccacggtgctgccggcaaacactcctggcaatgtgggttctggtaaaggtaagacacttagctctcaggtagcctggtctaaggtgagccagatggttttctgcagttgataggagaactccaaactcttcacagtcaatgagtcatgtgaaatggaattggaacccattgatttattctggattttccactgctttctaccattttttgctgtgtttgtggttagtatttaaaagaacttgctatatcagacatttggtaaagataaccaaagtcaacaaatggggcttttcttcttgtagatcagtgctgctctggcaaaggggacatgagcgatgaagatgatgagaatgaattttttgatgcacctgagatcatcaccatgcctgaaaatttgggccacaagtgagttatccttgattgttgaagcaaataaacatatcttcaccatcaatatggtggtattttagcatcatattttaaccatcaaaaggttaaaaacatttcagtgagagtattataattgtcaatattgaatctggggcccttttccctttttttttttttttttttgtctcaagatctctttgtagaatgggccctttttcttaagtaagtgaaaaaatgtcagcttttttacgtaaacaaattctccagagatacttaaattcattcctactctaaatgtcgtcatttgatcacccatcaataagtttatacagtgtacttggcattctgctttgtaaagaaatgtccaggaccacactctagttctggtctttgttctaattctcctgtgtttcccatctgtacagacgtactggcagcaatatcagtggagccagcagtgacatcagccttgatgaacaggtaattcttatatgggagatctcagaggtgagggacgtgggttgtgattcccaaggattttttttttttttttgtgaagtgctaagagaaactgatttttttttctttttttagcacgggggaagggaaggttataaataccaggttttctgttctttgtgggtggttgaatggctttgttttgctctcagtacaagcatcagctggaggagaccaaaaaggaaaagagaaccagaataccatacaagccaaactatagcctcaatttatggagcatcatgaagaactgcattggaaaagaactctctaagatccccatgccggtaaggttcttgcacactggagctgctgccaggagttcctctcaagcctcagtgggaagagtgctgatatgacagccccacccacttgtgcggcagtttgtggcatggtcttttttacctttataatcataaactgttccataaatttagctgctttaattttggctctggatctgatatgttcccagatcacctagaatcagatgtatatgctcagtagcagttatttttgagcaaattcctatgctagatgcactggggacatgcaaagataaatacatcatagtttctgttttcaagaagtgtgtagtttaaaagagacagacatgaaaacaggtagaaaacattattttctgtgatagtattatggaaagtacgacacagacaaaggcttagggaacacagaagcaaaaatcgctcattcaaaccagacagatgaccatccccatggcaaagatggtgtttgggctgacctctctgccccgtcatgtcttcctccagtctgtctacactgttgtcaaagtgatttttgaaaaatgtcaaatgtagtcatgtcagtcctcagctgaaaatcctttactggatcttcattgctttcatcatagtccagataccttagggggcttggtaactcctccccatgggcgaggctctaccccacgcatcccaagttctagtcattaggatttccttcaggcatcctgtcctttccctcagggcatttgtacacactgctctttctgcctagacttttgtcagttccctattaacacttgccactttttttctgctgtggctaatacccatttcttgaggatgcagctatagtgtgtctttttcagcaaacctccagtgcatcctgtcaggatgaaatgtctctcctttgtgttccaacaagttccactgttgatggtgtaaacagtgtgtatcactgcttgttcatttcacaagcattttctgggtgcctactatttgcctgatgttgcgctagttttcagttaggtatagaagatataggttcaatttattaaagaaacaaattcatggggccaactgtggggttggggagacaaaaaaaaaaattcaaaatatatcagtttaagccaggggtcatcacactaaggccctcaggccaactctggctaccatctaagaagcataatagtttgtgatgtgaaaattagatgaattcagttgttaacatccatgacattttataggagcacaatgatactctttcatttacgtatcatctgcagctgctttcatcctataacagcagtgttaagtggttgtgacaaagaccatatggccctcaaagcctaaatatttgctatccagccctttgcagaaaaagttgtcaacctctgccttaaacaaatgttggcttaactcattatgttcaagcccagaagtaggtggtccagggctagtgccatactctatggtgtcagagccaggcttctttctgtcctggggctctgctgcctttggcctcagtcctcaggcccaaagtggctgctccagcttgagtcatcagagccttattccagctagccggaaaatggaaaaagaggaaaggctgtaccatttaagggtgcatcctggctgggtgcggtggctcatgcgtgtaatcccagcactttgggaggccaaggcacgtgcatcacttgaggtcaggagttcaagaccagcctgggcaaaatggtgaaaccctgtctctactaaaaatacaaaagttaaacgggtgtggtggtgcacacctctagtcccagatactcgggagggtgatgcaggagaattgcttgaacccaggaggcagaggttgcagtgagctgagatcgcaccactatactccagcctgggtgacagagctagactctgtctcaaaaaaccaagaagatacttcctggaagttgcataaatcactatcacttaaatctgtgtggctaaaacttagctatatggccacagttagctggagagaaggctagaaatgaagacttctgttctggatggcatggccttgtgaaaaattaagggttctaccagttgtagaagaatggaagaatggatggtggggatgggcgagtggctacaggttttgtccacagccagctactaagcctacaaaaatacagaaggcattctccctaccctcttgaagctatggaccaatgtgtggtttctgcctcttcatagactgcgttccttgtgatcaggggctacgtcttgatggtgtttataaccttgatgcttagccctgtgcctggcatgtataaatcatttagcaaatgtcgaagtaattaactgggtcttggaaaacaaataggtttatgtacaaatatgtagaatttttgttagagaagtgttgggctgggtgcaacgcaacacttgggagactgaggcaggaggactgcttgagtccaagacttcaagaccagtctgggcaacgtggggagaccctgtctctaaaataataaaaaattcggctgggcacagtggctcatgcctgtaatcctagcgctttgggagaccaagatgggtggattgtctgagctcaggagttcgagaccagcctaggcaacatggtgaaaccctgtctctactaaaatagaaaaaattagtggggcatggtggcacgagcctgtagccccagctactcaggatgctgaggcatgagaatggcttgaaccctggaggcagaggttgtagtgagtcgagatggtgccactacattccagccttgacaacaagcgagactgtctctcaaaacaaaatagtaataagttagccagcatggttatgtgtgcctgtagtcccaactacttgggaggctaaggtgggaggatcacttgagaccgggaggttgaggctgcagtgagccatgatctcaccactgcactccagcctgggtgagagcaagaccctgtctcaaaagaaaaaaaggttgaccttcagataagaaaaggccatgagtagccttaggataaacctaaaataataattagtttattgggggcttgaaaagaaaccccacttgtctggagtattaggtgccttgaagggagtagtgggaaagtggactggaaaggcatgtcattgcagtctcaggaatgtagttcctgcttagaaacagcttctggtgccatgcgcggtggcccacacctgtaaaaaaatcccagcactttgggaggctgaggcaggcggatcacttgaggtcaggagttcgagaccagcctggccaacatctctctaaaaatataaaaattagccgggcatgttggcgcgcgtctgtaatcctagctgcttgggaggctgaggcaggagaattgcttgaatctgggaggcggagattgcagtgagccaagattgtgccactgcactccagcctgggcaacagagtgagactccatctcaaaaaaaagaaagaaatagcttctgggtctaggtgacttctctgtcctcctttaccattagttccttattgatcttgcctttaagaatgtacagtcctgtacctgtttgcccgcagatcaagtcctcacccttcccctactctaggctgtaacacaggaaaactaatccctctaggaagtgttttttcaggcttccgtggctactggagtctggctgggcttcactaatgcaagataccagtaggaggttatagccgtgggaagtctctccctctatgccctcttgagtggtgctctggcgcacctacgtggctctagttttcactggagaggcctcccctgccttgatgttttacattctcctgatcctcctctcttggacccccacctctaggctgtagtaatactgctgcttctccccatctctccaccctaccaatggttatggcttcctgttgctgctaatctctgggttgtcttttttttttttgggtgcctaatttttcatcagctgtatagctccctgcttccttctactttaaatactcagactcatttctttccctgtttggcttttgagtaataaaatgaccattataagaagcttggcacttttggagaaactggttgttgatgggcaaggctgtgtgtgtgtgaaaagcagtgatagcaatgtgctgattctagtcccatgcactgctggtatgtctagtaccaccagtggagtacactgcctgtccccagttttcctcaaaatgtatggaaatgttacttcgtattgtctaaattctgccacggacagattttattgggtgtagttaataagtgccctctttaaaaagaatcgaggattatggcttttgcagcgcgccacccctcagtgtgcatttgtgtcatcatactgcttgtctttcagtgtagggaagagggctctggggtatggcacactgttttggtgggtcctatttctcaaaggatgagtgttgttggctctgtggctctgtgttcactggaaaatgttcacagagaaacatttgggatatttctcagagaaaaagcaggctctagtttatgaattttatttatttatttatttatttatttatttatttatttatttatttatttatttttagacagagtctcgctctgttgcccaggctggagtgcagtggcatgatcttggctcactgcaacttctgcttcctgggctcaagccatcatcccacctcagcctcccaagtaactgagactacaggtgcacgccaccacaccgtgctaatttttgtgttttttttttatagagatggtgttttgccatgtttcccaggctggtctcaaactgctgagcacaagcaatccgcttgcctcagcctctcaaagtgctaggattgtaagcatgagccaccacacgtggccaagtttattacttttaaaaatgtatgaatgtatagaaacaaactgaaaatgttaatagtggtgatctcatttcaagaaaattttttccttgatactttgttttcaaagttttttacagttaaaaattatacgatattaatttcatgattgagcgggcggtggggggatagcaaatattagggtaatatgtagctcagagattggtgggtagaagggtgaacaaaaatgccaaaagagatggaacatcagaaagaaaagtgttgtgttttttttgtttgtttaagtaaagcgttgcttaaggccagaaccattcactaaaagggaattttttctttcttcttttgttctctggacttagaactcaggctaataatatttagacttgttcatctatattgttaattaaataagctttatggactaacttgggaacctgacttgttttatagtgaatttttacatagtaaaatcatttaaaatttcaaagttaattttgaagctgacttttttagggagtagaagggtggggagcatgaacaatgtttctcactccctacccctccactccccaaaaaagtcagcttctcttgttaacttctctctatccagtgggtagcatagggtctggcacacatgggtactcaataaatatttgtggaatgagtaagtgaataaatgaatgaatgaacatctcccccaacagaagcccccaattcctggcacacacacataaacacacacatgcttgctttatccagtacttggtcgccttaagctggcttcagaattagaaaggtaagagcatgcacagccccctctcaacccccatcatgagcacttcactcccagaaacacaattatccagcctcagaggagaaatcagaatcctggcctgatgcagaactgaactgagatttagcaattgttttgtccagggtggaaactaacttttataactagtcaggatatagctgtacttataatttactactgtttctttcattctccaagaattttaaatacctgatttcctctctgggtatacttgtgctaaaatacattgcatttcttttttaaaaaacttattcatccaacacctatttgatgatagtcttctgtgggccagtcactgatggatcttgggtatgtagcactcaacagaagaggcatggttcccatctcaaagagcttacagttagtgaaatgaaaacagtgatttctgccactcacagacatgaacagttgacaaggagaatgggttgtttgcgggttaaatattagagccgctctactgagcaaagccctcttttcccagtgatttatttcctaaactgcaaaaaaaattaaactgtctcttatagatgagtgagcatagtttttatatctgttcttctccttacaggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtaaaggaacctcagaaccataacgcatttcctttctgaagaaagagatgattttttggttaatcccctgggtcttatgtttgcagaaattctagtccctgtcatcccagcttttattctttttcttcagaacgtcagcgttggagaccctggaggttctgggattcacctactgttgtgggtgtaaaaacgtcaagtgtgaattttggtgtttctcaccaatttataggcagtatctttttcttctcctttctgccgtcttaatttgaacctgatttcttcaaggtgagtcatcatccccctgctgctgcgcaccatgctgagtccaaaaatggctggacattgcgtcaggaaatcaaaatcaccagcaagtttcgaggcaaatacctctccattatgcccctcggtaaggttaccatctttgtcagaattaatgctcctggaatgaaaggttttctggcacgatggaggaggtcactggctaaagagtcaggagacaggaggtctgattcgagcactgaccctcactaactggctttgggcaggtatttaacttttcagctatcaaatgagtgtggaggctagaaactctttaaggacccatctagtcctaaattctttatcctcttagctatatttaacgcatctctaagcactatttagaacacaagttctagcatgcattaaaaaaaaaaattctgtctcttaactggtggtgttttcttccttactttggcagtcaggttctctctgtaaatcagaactcatgattgcaaggttaggtttcttagctaatccttccgctttctcctctccttcctcccttttcctccacctgatgggttaggtatcatttatgtaatggctgaattctaggtcactgaaactttattttaaaaagatcttacttggggctgggcacagtgcctcacccctgtaatcctagcactttgggaggccagggcaggcagattgtctgagctctggagttcaagaccagcctgggcaacatggtgaaaccctgtctttactaagaatacaaaaaaattagctgggtgtggtggtgcacacctgtagtctcagctactcgggaggctgaggcacaagaattgcttgaacccgggaggcggaggtttcagtgagctgagattgcactattgcactccagcctggactgtagagtgaaactctatctcaaaaaaaaaaaaaaggaaaaacccaaaaaacaaaaactcttattggattacaagttaattttgtgtcaggatcagtcctgggaatggaatcctagtatacaatgttagagatcctataccttagaagaaatccagttattcaaaaagtatggtagagcttctcaatgctttcttgaactagagcaaccatgtttggccaagtgtgtgctgaagagtaaaagctgctctacaaaaagagatcaaagcacaaagcagttagagaaaacaagtagctcccaagagacagagcttaccataactccctgagctcctggtggctttccatttccaggttctagtctttcacgaggtatagctacagttcttaaatattgcaatatagactgcttctttaatgaattcacctttgctcagaaacacaaatgcagcaaacatagtgcaaactagaaattagccagaaaaaaagttcataaatgttttctaacatatgtaaagggagaaaagaaattgcagtgttacctctaatttcatggttaatatgcagaaggtccctaaacgaaaaggagactaagtgatacatcagtcttgatctttaccaaggacctttaaaaagcttctacatgcttaattgtctttgcagctaacaatttcagaagtattagcttaagagtagtaaatgcctgagatgttaacatcttatttgcagaatttgggtgtcagtggccgtattgcaatgtgatgtttcaccatagagaagagtttcagaggccccttgaggatctctaaagggaagaattatatttcattccatgggtggttaggtacagtcagccatccatacctgggtattctgcattcatggattcaaccaaccttggactgagagtactgggggccaggtgtggtggctcatgcctgtaatcccagcactttgggaggccgaggcaggcggatcacctgaggtcaggagtttgagaccagcctggccaacatggtgaaaccccgtctctactaaaaatacaaaaattagccaggcgtggtggtgggtgcctgtaatcccagctactcaggaggctgaggcaggagaattgcttgaacccaggaggcggaggttgcagtaagctgagatcacgccatttcactccagcctgggcgacaagagcagaactcctcaaaaaaaaaaaaaggaaaagaaaatactgagggggaaaataataaaaaataatgatacaaaaaaagaccaaaaaatatataatacctatttatatagcatttatattgtattatgtattataagtaatctagagatgatttaaagtatacaagggagaggaatgtgtaggttagatgcagatactttgcaccattttatatcagtgacttgaccaaattgtggtatctgcagggtgttctggaaccaatctctcacaaataccaaaggaagagtattcatctaaaagataacaataaacttaactaataaaatattgtacattttctctataatttgactaatctaggtttctttgaggaatgaatatatgaacatggtatagatggtggatctaattttttttctaatttttagtaatttgttaaagatctaattttttaaagttaaaacatttatcctagggagacttcattttaaaaataaattaaataacaggaaaacaaaattaattaaaaagaaaacaatttgatagtatttgcattcctatgcttatttaagaatttggatcaccgggatcctgttaagttcctccacatatcacctgcttaactgagtatctgccacatggcgggcatcgttctcagtgtttgggaaatgtaagtgaacaaaacaaaaatccccatcttcatggggagattgaagaaagaattgactttgtgataggaagctgaatatagaaatctaaagaatggaatttctaggtatttgccctggagatggctgtatttaacactttttggctcagtggcttggaaggcgaatcatgtagtgaaatttttacatttgccatggcactcaattctcagagagaaaattattgttaagccagtagatatagctgaagaaaaatatatggacagggttgtgagtaagtgagcagatagatgactggcagtttaatacactgctccagtgtattcagcataaagtaaggcatctagggaaaagtcgttcaaacttttatgttgataattgaagtagcatttgttgagtgctcattatgggtcagccattgatataagtgcttttcatgtattaactcattcaggcccaacaataattctatgagatagacacctttattgccattttttaaacaaagaaaactaagcatagataggttgggttgtcagggtcaacttaaccagctagtatgtgatctgagttgaggcaatctggcttcagggacccctgtcattatcgctaggctgtactgaaaaggagagactacaagccatcagttacaattacagtgcaaaaaggacactgaagacatcagcctaatagtctcactgaggtctgacaagataaggcagttttaaggttatttggtagcaggacaactttgtacaaaattgtggttctgttaactccactttgaaaaagtcatagccatgactgaagaaaatctaataccaatgaaagtgcctaaagatatttggaggcagtgacaatgagtgagtctccctataaaataggctaaaaagattagaacccttgacatttggaaagaagaatgcttctagaaaatataactgaagtttccaaataatgaaggctattttaaggagcaaatatgaatttcttttttttttttgagactgagtcttgctctgtcacccaggctagagtgcagtggcgcaatctcggctcactgcaacctcctcctcctgggttcaagcgattctcctgcttcagcttccggagtagctgggattacaggtgcccgccaccgcacccagctaatttttgtatttttggtagagacagggtttcaccatgtcgaccaggctggtctcaaactcctgacctcatgatccgcccaccttggcctcccaaagtgctgggattacaggcgtgagccaccatgcccagtgcaaataagaatttcttcatcgagttctaggatatagaaactagctgatatgcttgaagtttaaaaaggtgcatttatttttatttatttatttattttttttgagacaaagtcttgctgtgttgcccaggctggagggcagtggtgcaatctctgcttattgcaacctccgcctcccaggctcatgcaattctcctgcctcagccttccaagtaggtgggattacaggtgcccgccaccacacccagctaatttttatatttttagtagagactgggttccaccatgttggccaggctggtctcgaacttctgatctcaagtgatccacctgccttggcctcccaaagtgctgggattactggcgtgaggcaccaccacgcctggccaaaaagatacatttaattaagactattggcacagatgcagtggctcatgcctgtaatcccaacactttgggaggccaaggcaggaggatcacttgggcccaagagtctgataccagcctaggcaacatagggagacccccatctctacaaaaaaaaaaaaaaaagaatgattgctttggcagtcttttgcttcagcattttgcatatattannnnnnnnnnnnnnnnnnnnccacacctttgggaaggccaaggcacggagaggagtcacacttgggccccaagagagtttgatacccgcctatggccaacataagggggaccccctttttaccaaaaaaaaaaaaaaagaatgattgctttggcagtcttttgctttcagcattttgcatatattatcccactgccttctggcctctatgacttatttttctttttgtcctttttccaatttttgtttcttatttttttatttttattacttattttatttttttcagacggagtctcgctctgtcacccaggctggagtgcagtggtgtgatcttggttcactgcaacctcccgctcctgggttcaactgattctcctgcctcagcttcctgagtagctgggactacaggcgtgcaccaccacacctggctaacttttgtattttagtagacacggggtttctccatgttggccaggctggtcttgaactactcacttcaagtgatccacctgcttcggcctcccagagtgctggaattacaggcatgagccactgcgcccagcctccaattttttaattgtaaaatacacataacataaaatttagcaccttacccattcttaagtgtactggtcagtggtattaaatacataatgttgtgcaaccatcaccaccctccatctccaaaactcttgatcttgtaaaacgggaactctatatacattaaaaaataattttttttttttttttttgagaccgagtctcactctctcacctaggctggagtgcagtggcatgatctcagctcactgcaacctccacctcccaggttcaagcgattcttgtgactcagcctcccgagtagctgggatcacaggtacccgcctccacacccggctaatttttgtgttgttttagtagagatggggtttcaccatgttggcctggctgttcttgaactcctgacctcaagtgatccatctgccttggcctcccaaagtgctgggattacaggcatgagccaccacacccagccaaaaaataattttctattctccctccccaaaccctggaacccactattctactttctgtctctattttaactactttaattatctcctataagtggaatcatatagtttttgtctgtttgtgactggcttgtttcacctaacgtaatgtcatcaaggttcatccgtgttgtagcaaatgtcagaatttcctttcattttaaggctgaataatatttatcctattgtgtgtatgtacacattttgcttatccattcatctgttgatggactcttggattgcttccatgttttagctattgtgagtaacactgctgtgaacatggatgtacaaataccctttcatctctttgcctaaagtcttaagaaaaaaaaatgtttaaaaaacaacaaatatctctttaagaccctgctttcagttctttgcagtatataccagaaatggaattgctggatcacatggcaattatattcttagttttttgagcaaactaccatactgtcttcgacaatggttatacattcccaccaacagtgcacaaaggttccggttactccatatccttgccaacactttttaaaaatgtatcatagctatcctaatggatgtgaggtagtatctcattgtggtttgacatgcatttatctaataattagtgttgttgagcacttttttatgtacttacttatcatttgtatatctttggaggaatacctattcaagtcctttgccctttttctttttttttttttgacatggagtctcgcactgtcatccagtctggagtgcagtggcgcagtcttggctcactgcaacctccacctcttgggttcaggtgattctcctgcctaagcctccagaatagctgggattacaggccccctgcaacacacccggctaattttttgtatttttagtagagacttagtttcaccatgttggtcaggctggtcttgaactcctgacctcaagtgatctgcctgcctcggcttcccaaagtgctgggattacaggcgtgagctgccgtacccagcctcctttccccacttttgacttgagttctttagcttttttttgttgttgaattttaggagttctccgtatattctagatattaatcccttatcagatatatgatttgcaaatattttctccaatttctagaggctacatttttactctgttgctattgtcatttattgcacaaattttttttaatgttcaggaggtttgctttgtatttttgttgtttttgcatctgcttttggtgtcatagccaagaaattattgccaaacccaatgttgtgaagcttttgccctatgttttcttctaagagttttatagttttaggtcttacatttaggtctttcatctattttgagttaatttttgtacatggtactagataaaggtctaacttcattcttttgcatgtgggtccatttgttcaaaagactgtcctgtccccattgagtggtcttggcacccttgccaaaaatcatttgaccatatatgaagggtttatttctgggctctttgttctattccactggcctatatgtctgtctttattctagtaccacacattttagattactgtaactttgtattaagtatcaaaatcaggaagtttgagtcctctagctttgttctttggctattttgtggtcccttgagattccatatgaattttaggataggtttttctatttctgcagaaaacatcttgggatttggatagagatttcattgaatctgtagattgctttgggtggcattgacaaccttaacaatgttgagtcttccaatctatgaacataggatgtgtttccatttatttatcttaactttaatttctttcagcaatgttttacagttttcacctccttgattaagttcattcctaagtgttctttttgatactattataagtggaattgttcttaatatcctttccagattattcattgttaatgtataatagaaatgcacctaatttttgtgtgttgactttataccctgttactttgttgaattcatttatgaattcttttttttttcttttttttttttctttatttattttttattgatcattcttgggtgtttctcgcagagggggatttggcagggtcataggacaatagtggagggaaggtcagcagataaacaagtgaacaaaggtctctggttttcctaggcagaggaccccgcggccttccacagtgtttgtgtccctgggtacttgagattagggagtggtgacgactcttaaccagcatgctgccttcaagcatctgtttaacaaagcacatcttgcaccgcccttaatccatttaaccctgagtggacacagcacatgttcagagagcacagggttgggggtaaggtcacagatcaacaggatcccaaggcagaagaatttttcttagaacagaacaaaatgaaaagtctcccatgtatacttctttctacacagacacggcaaccatctgatttctcagtcttttccccacctttccccgctttccattccacaaaaccgccattgtcatcatggccagttctcaatgagctgttgggtacacctcccagacggggtggtggcctggcagaggggctcctcacttcccagtaggggcggctgggcagaggcgcccctcacctcccggacggggcggctgagccgggcggggggctgacccccccaacctccctcccggacggggtggctgctgggcggagaggctcctcacttcccagacggggtggctgccgggcggaggggctcctcacttctcagacggggcggctgccgggcggaggggctcctcacttctcagacggggtggttgccgggcggagggtctcctcacttctcagacggggcggccgggcagagacgctcctcacctcccagacggggtcgcggccgggcagaggcgctcctctcatcccagccggggcggcagggcagaggcggtccccacatctcagacgatgggcggctgggcagagacgctcctcacttcctagatgtgatggcggccgggaagaggcgctcctcacttcctagatgggatggcggccgggcagagacgctcctcactttccagactgggcagccaggcagaggggctcctcacatcccagacgatgggcagccaggcagagacgctcctcacttcccagacggggtggcggccgggcagaggctgtaatctcggcattttgggaggccaaggcaggcggctgggaggtggaggttgtagcgagccgagatcacgccactgcactccagcctgggcaccattgagcctcatttatgaattctatcaggatttctttttttggtggaattcttagcatgttcacatatgagatcatatctgcaaacacagataattttatctctttctttccatcttggatgccttttatttctttttcttgcctgattgccctggctaaaacttccagtactatgttgaatagaagcagtgaaagtgggcatccttgccatgttcttgatcttagaagaaagtctttaagtgtttcaccattgagtatgatatttgctgtggggttttcatatgtggcttttattatggtgaggtattttccttgtatttctagctcgttgagtgttttcattctgaaaggatgttgaattctgtcagatgctttttctgcatcaattgagatgatcatgtgttttttcgcccttcattctgttcatgtggtgtattgcatttaccagtttttatgtgttcaaccatccttgcattccaggaataaatcccacctggtcatggtgtataatccttttaatatgctgctgaattcaatttcctagttttttattgaggattgttacatcactgttcataagggatatgatattggtctgtagctttgggtttttatagtgtctttggctttagtgtcagggagtgctggcctcatagaatgagatggtagtggaggaggtattggttaagagatttaggctgggtgcagtggcttgtgcctgtaatcctagtactttgggaggctgaggtgggaggatcgcctgagcccaggagttcaagaccagtttaggcaacatagtggaaccctgtgtctacaaaaaataaaaaaatttagctgggcattttggcatatgcctatagtcccagctacttgggaggctgaggagggaggatcacttgagcccaggaggtcaagtttgcagtgaactacgattgcaccattgcattccagtctgggcgacaaagtgagatcctgtctcaaaaaaaaaaaaaaaaaaaaaaccccccccgggggggggggttaagcccggaaacccccccctttgggaaaccggggggggcccccccccggggccaaattttggaaaccccctgggcaaaaaggggaaacccttttttttattaaaaaaaaaaaaataacccgggggggggggggggccccttaaccccccccccccggggggttaaggaaaattttttttaaccccggggccaaagccccaattaaaccaaaaccctcccccccccccccacctggggggaaaaaaaaaaaccccccccccaaaaaaaaaaaaaaaaaaaaaaaaccagagatttagaatatgtttaggtggagcaaatatttcgaaggtgtttgtgaatattaaatgaaataatgcatgaggagaccatagcacggcacctggtacacagcaagtgttctcagcagagtggctgttattatcattgatgtcatagccttcattgttgtgatccttatctgccaattattagggctactttaattttttgtataagaaacatgtctaaaccacaattggtgagttattttttattagtggttacagagagaacttagggttatacttttactgaaatcgactttatttttatttttattttttatttttgagacagcgacttgctctgtcgtccaggctggagtgcagtgatgtgatcttggctcactgcaacctccgcctcctgggttcaagtgattttcctacctcagcctcccgagtagctgggattacaggcgcacaccaccacacccagctaattttttgtatttttagtagagatggggtttcatcatgttggccaggctggtcttgaacacctgacctcaagtgatctgcctgctttggccttccaaagagctgggattataggggtgagccaccccacctggcctggaattgagtattattaactatatatcttttaaaatgtttgattattttgaatcctcaattatctctgctgtgaaaccactgattttggtattcattggagattgacttataagaacaggagtcagctatatgtttcaagcattttattaggcaaataaacagacatttactgcacaacaggacgtgttatcccaagtttatagatgataaaatcaaggcctttgaaacattcatagtgcaatactgtaatgcaattctgacactacccacccagagttcccgcagactccctaagttaagggcatagtacccaacaaaattgcccttgcttcagatgccagcaacaagttggaggccctaggccacctgcacttctgataactggctataagttcaggagtccccacaactacctcaggtttgataattcattaaaatgactcaactcaggaaagtgctctacttatcattaccgttttattattcagggtacaaatcagggccagccaaatgaagggacccgtagggtgaggtctgggagggtcctgaacacagagcattgtgccctgtctccatgggatcagggcacatcaccctcctggcacactgatctattcaccaaccaggaaactccactgagctttggtatccagagattttagcagggcttcattatttaggtttgattgcaggattgaattcaatatccagatcctctttcatccccagaggtcaggaagttgacccaatatcaggtgactcaaaaccctgtctctaatcacatggtggagcctggcatcctaagttattagcattagctatctgaggcccaccatgagtcacctcattagtataaattgtcaaggtccaccgtaaataacagagatattcctgtcacttgggaaattacaagggttttattcttcattatacaacagagggtcatacatctaatgaggactagagtcaggatttaatccagttctgtctgaattcaaagccccagctctatccactattccatttttacaattaagggccttagataagtggtttgtttaaggtcacacagctagtaacttaacaatagagcctggtcccggtacagactaccaatgtgtgctccttccataatgcagttacttccatgatgcatgttggggtgcatttgacttgtttctgtaaattttgcaattgtattatagaacacagcgtcctagctaaggtatatcagttgccagggtttgtcatcatttagttatgttttattcatagatttttgaaagtcaagtgagaaaaattcagtcaatacttccaacatttaagaaagtgtaagtcctttttgatttattgttttatttctaaaagtaataaatatcaatagaaggaaattaatccattactgttttgaggctgcatggtgctatttttctgacatttggcttaatttggatacctctttctgcttccaggtaccattcattgtattttccatgcaactgggcaccactacacttggaagaaagttaccacaactgtacacaacattattgtgggcaagttgtggatagatcaggtgaggaaaggtacccaaagtgtgtgtgaagtttaaaagaatacttctttaggtatatttctgcagtatttaggacatgtgaactggtctcagaatgttgctactgattcatcagtttctcctaaggaatttctctcaggcagtagccctacctctaactctctaagttttctgtaccacaaattattgtttataaatgaccaaattataacattcatcaatgactattctgctaggactgtgttgggtgctacgacaggtagaaaaaacaaacgtggccccaactcttaatcctttcattattcatcaaatatttattgccaggcagtatgctaggtcctggggatacaaagtctgatgagatgtccctcaataatttattatatcattggagatacatgaccaatgtgtaggttggaaaatgtgcagcaacatacactaatataaaagatgccctatgatagtatctaattaattgtcagttttctcttaagacaatggttgcagcaaatttagaaaagagggtatactgtcttctgagcagtcaggaaaggcctcacagtagatgtgggagttaagctgaatcttaaagtgtggtttgggatttagaagatagaaaggaagggaaaatgggctgggcatgttggctcatgcctataatcccaacaccttgggaggccaaggcgggaggatcacttgagcacaggagtttgagactagcctgggcaatatagtgagaccttgtctctacaaaaaatttaaaaaaaaaagaaaggagggaaaatgaaatgaatcaagtatagaaaggccgaccatatgtaatttgcaattgtgagtagagtattttgatttaagcagaagagttcatgaagggtactagtgagggattggtttggaaaggtaaattatcatgtgtacttcagtatatgtgctgaaggtcaaatcatgccatctaacatgtgagatacaattcaaaacaagtggacacttggtcttgatctcaacctggaaaaccaaggttacatagggattctatagcattcccaaggctagctaagatctgaatcttaaacaagggattactagaatgtaagattgaaaagtaaagaattatgaaccatgggtttggcagacattgaatttatccagtcttaataaaactgaattttttcattttacagtctggcgaaattgatattgtgaatcacaagacaggagacaagtgtaatcttaaatttgttccttatagctacttctctcgggatgtagcaagaaaggtaagggaagttgaaatttaaattgtttcacgtagcatgtatctcttagaaagcatactcctttaggactggaatgtatatacatgtggggtggtatgggggtgtgtacattttatatagtgtatgtgtacatatagtgattcaaaaaaagtagaggtgaaaggctgggcgcggtggctcacagctgtaatcccagcactttgggaggctgaggcagatggatcgcctgaggtcaggagttcgagcccagcctggccaacatgatgaaaccctgtctctactaaaaatgcaaaaattagctgggtgtggtggcgcgtgcctgtaatcccagctactcgggtgaggcaggagaatcgcttgaacctgggaggcagaggctgcagtgagtctcgcaccattgcaccccagcctgggcaacagagcgagactccgtctcaaaaaaaaaaaagtagaggtgaaggagaaagtcatcaagaaagactatattgtattactactaagccaattccttctcttttctgggaatgacaataagtgaggaagtgaaagtgtcgagagcaatgagagattgacaatgggaaacacggtggaggcgggcggatcacctgaggtcgggagttcgagaccagcctgaccaacatggagaaaccctgtctccacgaaaaatacaaaattagccgggcatggtggcatatgcctgaaatcccagctactcgggaggctgaggcaggagaattgcttgaaccagggaggcagagtttgcagtgagccgagatcacgccattgcactccagcctgggcagcaagagagaaacgccgtctcaaaaaaaaaaaaaaagaaagaaagaaagtaaatgggaaaacacagaggaaggactaataaaagatttcaggaaaaaggggtttgatcactgagaagtttgagggggagttgtgtgataccaccataatgatttgtgtcatgagtttctgtgggagactgaagaatagctggggatttaaatctgtttataggtccctgtgaatttcttgagagaagaaaatataattctgagtaccagtcagatgcttttgctacgtgtatctttgatacaaaaatccctgggaagggtagtgaggggaggggacagagagcaagaagtggggataaagaataaagtctagtatttgctggcacaacagggtgactacagtcaaaaataatttaattgtacattttaaaataactaaaagagtataattgaattgtttgcaacacaaaggataaatgcaaattatatacacctactatgaactcacaaaaataaaaactaaaaataaagtttaccaaaaatccccatataacaaaaaatgataatgaaatccccaagtcatggctcagttatttcaagtagcagaaaaaaatacaacaaaataatttgaggccaggcatggtggctcatgcctataatcctaacactttgggaggtggagataagaggattgcttgagccaaggagttcaagacctgcctgggcaacatagcaagaccccttctctacaaaaaaaattaaagacttagccagatatggtggcacatgcctgtagttctagctactcaagtagctgaggtgagacatcacttgagccctagagttggaggccacagtgagctacgattgcatcagtgtactccagcctgggcaacagagcaagatcccatctctaataataatttggatgactctctggtgtttgttataacaggacctaaccattatttatcctaggacttccagtatagtcaggtaagctaattcacagtgaattctatatagccaagccctgttctccacccttgcaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgtgagtatcagcatgcatgctgcccagataccactttgaccttgactgtggagcaatattgaaggcatttctgcctgccctctcacttaattatgtggggaattgagcaagggaaattgagacttttggagagattaacagaaggttgtcattgtatgatttgacttgtagcatgcttatttcaaggaagttcaaaccaaactacatctgacaaaaaatactttgtgctttctaaaggtcctttggattgtgattcagaagggtatttttctactatttagagcaaaactgttcaaaagtggctagaggaggaaggtgcctaccacctgttaacaatttagcctaaaggcccatcagcagccaggtgcggtggctcacgcctgcaatcccagcactttgggaggccagggcaggtggatcacttgtgattaggagttcaagaccagcctggccaacatggcgaaaccgtctctactaaaaatacaaaaattagccacatatggtggtgtgcacccataatcccagctacttgggaggctgaggcatgaggatgacttgagcccagaagtttgaggttgcagtgagctgaggtcatgccactgcactccagcctaggcgacagagtgagactgtctaaataaataaataaataagaaaaagaaaaaaaagcccagcagaaaagaaagatccctgagacaatgtacaggactttggaaacaagatggaggtcacttatttcctgtcgtcatctaatacagtcagtttgtagtgatagccaagattatcccagagagagttaaaaagaaaactaaggaaacaggagtgaggaattttcattcagtagaatgtttccttctttctaatgaacgtagataatttcagctgggcaccacacaacaccagaagactatggaactgagtgatgccagggagcggatggggagggatccaatttgtctcctttagttagggcaatgtgacatggtcctagatccttttcacagatcctgtttttgtagaacagccttggtgatgtggccttggcagtgtacttagttgttgctctttaaatagggtctgggctctgggattaccatttctttttcttgtcttctacttttaggaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggtaatgaacttcccttctactcttctttcttgatgcatggagaatgccagcactaatttttttctttcctctcttttccttttaggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacac

SEQ ID NO: 16651 - DNA, 45762 bp, Human
accccaatggtccttttcagattcctaacgtgaagggttgttcatatctcggcctctcgcggaagactctattttcttgaagcgcggggaactacgtattcccactaacaaaaatctgttaaggggcagggcgcagtggcgcacgcctgtaatcccagcccttcgagaggccgaggcgggcggatggcttgaatacaggagttccagaccagcctgggcaacatggcgaaaccctatctctacgaaaaaaacacaaaaattagccgggcgtagtggcgcacgcctgtaatcccagctacttgggaggctgagatgggaggatgggttgggcccaggggatcgaggctgcagagagcggtgatcgcgccactgcactcaacttgcgcaacagaatgagactctgtctaaaaaacaaacaaacaaacaaacaaacaaacaaacaacccccaaactccccaaaaatgtgttaggggaaggaggtgggacagtgtgtatttctgatctactcgcctttcctagtatgaccaccagggggcgcggaagccctcctggtactaaggcggggacaacctgcccagcgagcacagcgggcagaaggaagtgtgccggacgcgagagagaactacggccgagacccgcggggccggctcaaagcccgacctctgccatacgcaccgtatctttatgggagccgatgaggtcagcagggagcacgcgttcagatggcagaagagggcaaagtactgctagaattacaaagatatttacagctttttaacctgaaagcacagagcagatcctattcttcagaattaaatcttcggctcgccagtcccgtttatggatctccactctgatgaatgtgccatttgttcccaagaagacaaatagggtagggagaagagggagaggcggggagaagactcgagataaagggacgatctgcttttcggaagcagaagccgcctgggaaccacctgcacaccaagcaggctgcgaggacggggagcgctccagtgcaaagttctgtattttaaagcccctcctcgctcacaggcttcacagcgaactacgaagtgggtaccatctctgatttacagacacgggaacggggtcctcttgagaaacgatgctttcccaaacgtctgcaaattgtgagtgccaagtgtctccactggcactaacaacatcgagctgcttacgtttctcggagcggtcccgatttccaacaagcaaaagatccaaattctctgaccaccctgaccgtcctgtatctccagatctccaggtctttcctctggacacctcctccatccccccactttcactgccagcagccctgaggctgcgcgggatcccgctactcggaatgccttcctcctggcgggatatttttagaacactcgactgccacccaatgtagcccacatcacattgtcttatttgttttcgggagcttgtccccgcctagcaaggagtcggctaagaactggatcctagcgaggagcccggcacagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccgtgagtttcgccgcaggcggggtgctgccaggaggggtgctgcatgggagaggggcttccctttgctccccaagtcgaggctggaggggggcccgagccggaggcttgccctccccaagcccccaccgcttcccgcgccggttccgcaccctcccctcccctcccctgcggggtcatgtgcccggtgattcatcgctaggcaatgattttcctgaacgcctctaactctcccaccccgcaagctggacagtgtctgtccagagctggttcccgaagcgggtgcttgggcccgggaggtcaggggtcccttcaccacctgcccactgctgcctggcactatgcccaggaccagcctccttctccctttcctgtttctctcctgaggtgctacaggcctggctgccccttcccccagggagcagctcagagctctctggtgacctctggagctgtgagccggtcacatgctgggatgggtcagctcctctccaaccggtggtctgtaattgttatccccgggtgtcattgtccccccctcccccgccgtatcttttggaacagctgtggttaggtcaaaggatctgaaggtagactacctccagccttggctgcgcaaaagctgtaaagccttaggttacttactgtgagtctctgtttccttatctatcaaatgggaatgatcataccctaggaatttgttgggaggatcagctgatacaatggaacttgatacagaaaagggttaacgcatagggttttaagccagatattcattgactcattcagtacataattattgagtgtattctatggggaggtccagtgctaagccttggagattcagtggcacaggttctaccttaatagaattaaaatctagcccttgacactcaagagtttagtccatctactttggagcttgttacaagtgtagcagcttaggcctgagtctagccccgcagaatcagaatctaattattcatccatttccccaggtgattcatgggcacattacagtttgggaagcactggactggattagaactggggttgtctcctggctccactgcttactggtgatcccttaaaatcccagcctaagttttgtcatttgtaaaatgggtagttgtaaggtcgaaatgcaacagaagatgcttaagaacacttttagggtgcatggcacgggggacttaataaatggtgaaatatgctaataactgtgagtgctcttgggaaaatgcagatgtcagggactgctgggatgatgttacaagagtttatcctttttctcccttgcttggatgagaccttcattcctgtttcacctgttctgtgtagcagggctgcggaggaggcaggtagctggggaagtgagagaagcaaagggacagttgcctattgtgggagtggcctctctgcctcaggcttgtgcttagtcatctcagcctcacagcgtccaggttactgatggggcagaatttattgcccctgtttttatagatggggaaactgctgctcacggggtaggagggatgctccaggacacagagccggccagggcaccaccaggagaggaacccaggctcttgacactctccacagtgctccttcccttgaagcacgctggttggggaggcagaaggaaaagaagagcacgattttgaagatctctctgtgtcggcacacccagcaaccataaaaaagtacaaaactgaacagcaggctcttccatttattaggaaatccacttccagaggaagatactccatggcccctttcagtagctcattgtcaacaatgagcaaagagtcttaactgagctttgagttccaagaataaatttaatttgcctggggacgctgagcaagtctctttgcctctcctcggtgcctcatggttaccctctgtacaatggaattaatgataggtttcctccccttccctcttggggatgtggtgaaagtgagactggagatggtggtggtattatgggaggattgttctgaaatcacagggtggcttctgtagcgtcttggagcagatgcatggcagcgtgggacaaagggacacaggtggcaggttccaagactgatcactgtgcttctttgcgtcacttctctgcttctcaattcctcctttatacaacaaagaattgagttgatctcagaagccccctctggcgttattataggtttttctttgaagactgttaaggtttatgtggattttggtgtcagttcacctcctcttatcccctctccccagccagactcccagggatcaccctcactgaaacaagatatgcgtcttctccctctgatttccgttatcaattagaagcgtttgttaacctgcatgaaacaaattgcacattgagcagcctatgcaatctctttctgtggtgttctttctaaatcctggggaggggaggtggtaactgcctcccgataactggagggctttccgtgcctgtgattgactttgttctgggtagatacaaagagaacatgtggggttgatgggtagaaatgaggaatctgtaagaaagcgtttttagtagacagagctgcccaaggatggagtagatggtgcaccctccagcatgggaaggaagcaagaagcttgttgggattttgaatgttgtaggaatttgagcatctcttggaggggaggtgaactaggagatataaggccttcaccaaccttaagaatgtgtggttttataaaatgcttaattgtgagcctgtcctgaggctttgaagtctacagggactgaggcctcaagagttgcccctgtaaagtggctcatcacccttttcccataggatcattgtgaggataaaatgagataatccgtgacaatcacccaccactgttattgttagttcctctgtcttggcctgctggcaacagcgtccacacagaagggcatcccttcctgaggccatggtcacaagatctgactcacctggtctcatctcatctcttctcttgcactgctcttcctggtgggctccctcgacagcctgctttttcagtgacacaggacaggcttgccaagaatgtgcagtgcctctacccagcctatcccaggacatggttttctctgacttctcagcagctgaactttgaatctgctgagtccagacagttccatgcttttgcatggccctgttttcattcagcaaacatttgctgagtactgagtacccactgtgtgccagtccttgtactagatgctggagtgtaatggtgataaacgcatgttcctggcccttagaaagttcatggtcaggtaggaagaaacagaagaaatagacatgaggatatcatccttgtgatagaagcaaccacaggaagaccctgttggccagtctttggaagatgggagatgggcatgaggctttgggtgggttcccaagaagtagtaatgcttgagctcagctgattcttccagcccaatctgaccttttcagatatgtaaaggtggttggagatacataagttactttacgtaccagataagtaaagagaccttgtatctaatcctctcaaccctgcaaagcagagtgggtttttctattattctcattctgcaagtgagtgaattgaggcttaacaagaaaggcaaggatcctagattgtcttaatcactctcgcattggtgtataaaccatcaagcatataaacaactcaagggagcatcagcagggtcgcatgtgcatggtacctgctgaccaccatgatcagagctttgtgacctctgtgtgcctagcatcctgctgggcgtcaagtttaggcaggattgacaaagtcctagtatcaaagggtaaatgatcacatagggaagacaaagacatgtagtatatgacaagagggccaacagtaatcaaagccatatggtggtaatggagaagccagtgatgtatggaatagaggttgaaggctttggactcccttggagacggatctgtagaggactggaaatgacgtggatgtaatggcccttcaaagaccagcactaataaggacacactaatgaaatcaaccacctggggctctaaaggccagactaactttttactctctctgtgtcttgctgcttcctaaatggctgttattggcctccttccccactggaagctccaggatctttgtggaatcatagttccttaggataacattataaccccatcagcaacatggagctgtgtacttctcctttaaagcttaatttgttaataaatatttatcgagccgcttttatgtgccaggtgctttggatcataactgaaccttaacataccaatctgcgcttcactgagattctgtctttctctagtcataaaatttcattcaagtcaggattcctgcctcccctcttctctgtacctgggaggattcattctctggaagagctgtttttctgtgagcagacgggaaccagagctgagagtgatggggattgagtagggattacagccccatcagccggaggccagaaaatgcttggatgagagaagaggattaattttatttttattcctgtgagtgtgggggaagtcgggggaattggcaggagctaagggagggacacttgttcatgttgtcctctctctcttccaaagcttcctccctgccttttgtcaaaatttctacccatcttccaaaactcattttttataggtagtagtgttctgtaactgcaacttagaatactctcctccattcttgcagctctcacggggtgcatgttgctttgcagtaggttgtgggttttttttttttgtttgtttgttttgtttttttaattaccatggagtgggtttgaaaccactgtccgttgctttttataagttagaccctttatcccctttatcttctaggtccttttgtctttaaggtcagtgtttctagtacttcttgtcaccacatcaattacaataacaacaatcatttattgagcagctactattggacagacttgtgctacataccttacataccttgtctctaattctctcaaccctgcaaagcaaagtgggtttttatattattctcatttacaagcaaggaattgagatattattctcgttttacaagtgaaggaattgagtctcaggtttgactgagatccccatctgggaagtggtgggctcaagaattgaacgtgtgtgtcttgcttcttcgtatccccttacactgtattcgatcatctccctaactgcactatatgcctctgatgcaacagcagttatgatagtcctctggagccccagggcctagcactctgcatggtaagcctgtattaaacatttgtctcttagttgattaataacagcttgacccttacacatcctttactcattattatgacttatttttcttgctccattccctgtgggctggtgaatctttacctacctgaagtggaacatttactgagggaatccatatgtttgctaatgaagccagaccttacaggtccatccccaaggacggagttccaaggctcctaactacacctaaacacctagcccaagatgacatggaaggttgcccctatttagaaagacaatgaaggcgaagatgtggctaccatggtgaaaacttaggtactccatttttctcctggcaaaatcctacatatctccaaagtctcagttccagtgtcatccagcttcccaggctgacagcactgagcatgcctttcctcggaccccgcaaactttacttttggtggtgtatacaaatagccacatggtattgcaatttcagatgccactggctctgttagttcttgtgctctgggagagcacagaccacatatgtctcattctctcttataccttcccagcccaaagcctgtaaagctgtaaaccaaactgtcctgtcaatgaatggggatattctgtaaatttatttgcccgcagattctgtagtccctgaggggccttacctccagccacctttatgttaggcccctctgcaactgcccccaccccatctcctctctcagggtagcctgctttttggcattggaccatttccatggcaactttccccagtctccatctggaaactgagtgaagttcaaccccccacctaaagagattagtggagcaaatactgtctggttatgttcagctgtctgggttaggacagctcagtatggcatcagggtttttttttttttaataaatttttaagttttagcctacttttagatttatggaaaagttgcaaagatagtacagagagttcctgtctagtcctctcctggttccctcacttggtctcattttatactacagtgtacacttagcaaaactaagagacttatattggtacattactattcacccaactccatactttatttggatttcactagttgttccactaatgtcctctttctgttctaggatgcgatccaggacaccacattgcattcggttgtcacatctccttagcttcctctggcctgtctgacaattgcttagtctcttgttttttgtgaccttggcggcagggctccggcatctgttttctagtgctctggaagcacatttcctgtggccagtgctacatgctacagctagggtggtggtggagcagccgttaagaggcaacactccagatggctgaggacaaagtcccggcagccagctgcccaggcacccctcctagctcaggtgcccactgtctgcaggatcttggtcaggttgcttggtgtctttatgcattagttttctcagctgtaagatggggaatatccccagaagactggcctagggattaactgtcatggtcaatagaaagcacacatcttagaaggatcctcactcagcacatgttgagtgtttaatgaaggttgcgcgttgtcactgttatttaagtattctagaatgaccatgagggagaggaagcttgtgggacagaggctgaaaggaggggttggggagaaggctgaggatggagtaagacagtattagttcctttcttcctcctctctgtgtccttgagaactgaatgccatggtggtgtccagaggccaggacaggagacaggggaagggagtggaagagagggaagaagtgtggggtggaggaggaaggatctaaaggacacctgagatctccaggaggaagaagaaggccttctttgaatctccttgaatggctcctgggatgagaaagaaagcaggaagaaggtctgatctcctcaccctgagtggccttcttgtaggtttcatttgggtaaatccacacattccacaaaatttctccaaggagtcacttctgccaacattctctaataagcttccatcttccccaggctcaaccttgaattcaggcaaggttgggcactgcgtcttctcttgggtgtgtaattccttgggctaaagcactgtcctcacgtgtcatgtggtattgtatcgcatggactgttgcttggcagatgttagatgtgcaataaatactgccggatgaaagaatgaacaaatgaatctgttactttgcatggaacattgtggctgtgctgatgggtgatgagaccttgagatgcctctctgagttaatgaaggagtgaacattggattagaccacccaggtttctaatcttggctgtgttccttactgtgtgattctggatgaattaaccttcctagccacagattccttgttagtgtacataacatctacctagagggccttttccccctcttcttcctttcttgggagtttttgtctttcttgtctagacccacctcaggtctggagaagcaaaagcaggtaggatggcatgtgaggattggacttcaatgatttttgtatccgacaagcagaatgcaagttcttttgaaatacgcatagaagattaagaaataccatgtattaagacacaaagaaaatgccaaatctcacagaataaaagtcatataggccgtttcctaacagtgatacaattagaaattaatacaataattgtcctccccaggctaatccatattggaaatgtaagaacgcctttctaaataactcttgggctaaagataaatcaaagtagaaatgacaaactatttagaaataaatgatcggccgggcgcggtggctcacgcctataatcctagcactttgggaggccgaggcaggtggatcacctgaggttgggagttcaagaccatcctggccaacatggcggaaaccctgtctctactaaaaatacaaaattagcagggcatggtggcgcatgcctgtaatcccagctacttgggagactgaggcaggagaatcacttgaacccgggaggtggaggttgcaatgagccaagatcaagccattgcactccagcctgggcaacaagagcgaaactccgtctcaaaaaaaaaaaaataaaaggaatgatcacaagagcggtaaatatcaaaatttgggagaagtagtggaagaagaattgagagggagctctgtttctttaaaagcatatagtagaaaaatgacagatttaaagcacatgaggtaaatgccaatgaatacatgaaattctctcctcctgagacatctagtgtcaccatctaagaattggcattagaattgcatctttgccagaaactcttagcaaaaacaaggcccaattttctgctttagataacatgatcttgggcatttaatatgtgcctagcattgctctaaacatgtctcctgtggtactgatttaatccttgcaacaattctatgagcagattattcttgtcatgtcacaaatgaagaaactgaggcacagagaagttaagtaatctgtttaagaccatatagctattaaatggtagagccaggttttcaactctgtatctctgtagaggtacagagatacatctgactgcctgagttggattatatacactggtatctttttcactcatgcatataggttaatccaacttagttttatggatgttgcggtatcccctgaaataagcgagagcgtgttcactgagcctgagtggggaggatgccttcaagtgtgtgtagtggggaacagcagaagccctgggctcccacagacttgcctgtgagtcctaatgaggtcgtttattagctgaatcattttggatgaattatttaattaagcagttgtcttatctggaaatggggaaagtaatatttgtccctcagagggttgatgtgagaattaatacatttgaaaccacaaaagtgcctgcaacaacacacacacacattatctattattattattattattattattattattattattgttagggcacactgagtggagtggggtcctcagggaccttggctcttgtccagttgtccactggctcactggccttgggctcactgataggatttattctgcagtgtcttcatctttcaaatagggctaattctttcctcaagttgttcagctagggctttcttcaaagtaaaagcatgaggctcacttaggatatcattatctgtcaatctcctcttgatttcatctgatgagtgtgttggggaagatggaattaagtgaaaaggggaagtgtgccctctgggagggtttcactggaagagaaatcacagcttagtgagagaactgggcactggagaagagtcatttgactcttcacataggaaacagagagcatggagtgcctgttgagaacctacactcagaatttctggctctttaaagaagagggactggaaagaccagatgttgggcagtgtgcacatgggtgtgtgtatgtgtctgtgtgtgtctgtgtaacctttgtaagtggtggtgtttgtctttaggaatccccagaccctcatttggagggaggcagttgggagaagtgggtagcaaggacaagaaaaaccaggagtcaggctgggtgcggtggctcatgcgtgtaatcccagcactttgggagaccgaggagggtggatcacacaaggtcaggagtccaagaccagcctgagctacatggtgaaaccctgtctctactaaaaatagaaaaattagctgggtgtggtggtgtgcgcctgtaatcccagctatttggaaggctgaggcaggagaatcacttgaacacaggaggcagaggctgcagtgagccgagattgcaccaccgtactccagcctggaagatagagcaagactctgtctcaaacaaacaaacaaacaaacaaaacaaacaaaacccaggtgtgtcattgtttctttgagttaaatttattgggagataatctggatttataaagaagcatctgtgtctccagagaaataattgtttaaatttggagaagagaaggtgcaagaatttgtactcgcttggttgtgccaggaggggtgctgccccaccggcccacaaatctttaatgccccactgtgggaagttaaggaccagatataccctttcccctctgttatttctttgacccagaaactttcctgggggctcctgggctttctgccttgtcctgggacccttttgtctgcctggggtctggcacctgtggcaggaagagaatcagagctggtgaacactgtgctcttcatctgggatgacttcctttttctttgtctcattctgccttgctgctctgatttgtaaacattcttaaggagatactgatgatttaaacttacgttgcagatgtgttttaacttggaaaggagggacaaactctttttagaaagcacttgttcatctatttctgtgattttccaactttttttctttcttttgtgacagtaggactctttcttaaaatgaaatcttatattgaatcccagtgtataaagcagataaaagtaaagctctgtagattgaagagggggtgaggctcaggacagctacgtccccccattggctccccactccctgagtaccctgagtggggtttctgaggcacatgtgaagtttcctgggtttccgcaaatctgcactggaaagccaagcccctccttaattgatgagaaaggcttaatggaaacaaatgttgtccccaaagggccacagctccactttctcagcccaggatgctttctgcagggttgggctgcttagcttctgggccccagctgctctcagtgacaggctgccctgagcagcgtgcagtgcgataagaagggcttaggacagatgacttaagcttgagccctgtttcggcaaatcagtagctgggagaccttgaataacttacaccttctctgacctgcatgttctcaactacatactgcagatgggattcgttgacatggtgtacacaaagcagctagtgtcttgtggccacctagcacctactaggggctctatggggttgcaaatatttttataaattatatgagctaatgaagagaggaacctgtggtcagatagactaacaatgatagagaaggcagttgagacaaagacactgagccttgagagagaggaattgcagttcagttgcttgaggttgcattctgggcctctgaactctttctactttctgtccagagaggaggtcataaccctggctgtcctttctggatttgggggcacacttgaggggtagggtcgggggagatagatcccaggttggagttcagtgttgcctaagtcattggtgatatctctcatctccttgggcgagaggcatctggaggttggggaggggaggaagttgatggctgggcttgtggttcacttgtgttttttattgtggctgatattgcagctactgtaatgttcctattaccagatatgttgattctttgataaagatgctgaagttctcttcttggctaagctcagtcatgtgggctgaagataagggcattgtgtgctttccttgcccttgggttctgatgcctctagatctgcaagagagcacatgtgtgtcagaagggcaggagcccttaccctgagattggttgagcttgctctgtagggaagcctgctgctagctccagtttcatgtgactccagataacatgcgatgatggcctcttccttgagttttctgatctggaccaaactttgttgttgttattttgtatttttggaagtggcatgctacagtgggaaaaactctgcatgggaaaatggaaatccagaaacctgggttctattcctttctgtgtcagtaactcattatttcattttgggccttggtttccccctggtttctgtccagacctcctctctggacagaaagtgaaaagagttcagggacccagaattcaacctcaacgtttccctttttctaagtgaggggatttgatggtaaaatctttaacattgcattcagctctgaaagtcctgtatctaaagatactcatatccaggtcaaagctgtagagaagttgacttggccagatcttatgtatggttgctttattgagttcttactgtgtgctctacattgcatagggaactttaaaatattatcatattgaattctcacagcatccctggcagatagcatatattttttatagaagaaggaggcagggaagaggggtggattttgcagggattctctctgttgcagtaaaaccaaagagtacgttttggcagtgctggtaggcatgcagtcacattgcatgtgacaggcagattcagtcagttgatatcaacttcaactttctaggtgcccagccttgtgtcaggtgcccaggagatactagtaacacttacgagatactatccctgacttcaggttggttaaaattgagcttgaagttgagactgcaactcattaaactatttgataaacatgaagtggggcaagttttgtgggagaaatgggccctgtgtttgaatagcagaggagtatatgaatattggttgtgattgggaataaggggacatagtgctaatatgactattgatggtggttgggaatgagggggcatggtattaagaaagcccaggagcaggaagcaatgggatgtgtgcagaagacatgaggagatcaagttgatgagcagaaggtgtctgggggagaatagtgggaatatagctaaacgcataaatacggtcagcttccaaagggttatgacagacaggctgaggacttttatacagtaagtaatagggaaccatcatgtattgggaaacagggacataatgggattggaccagagagataatggaggtgggtatgggcaggagactgttgtaatggtacagggtctgctactcaagcaaggtccaaaaatactctattattactattttatagatgaggaaattgaggctcagagatgtgttacatgtgtgtaactttacagggaggtagcagtgtggttttgttacatggctctattgcatagtagtgaggtctgggcttttagtgtatccatcatccaaatagtatacattgtatccattaagtaatttcttgtcatctactcccctgcacacatgtattgggaaacagggacacatacatttctttatccaatcatccattgatggatacttaggttgattccatatttttgaggctcagaggggttaaaccatctgtttaatgttcagtgagtagcatgtgatggaccgtggtatagagccctggccattatgttgccatggagccgatcttactgacttagcctttagtttgagaacttcctgtggaggaggaggaggaggaggaggatgaggatgggtgcggacagtgatgactcacaggggattctgctcatgtagacccacatcttttcagcggggcagcggggttaggcgctgatgtatgcctggtattgtgctttccatatgtgatctcgttcagtcctcataaaggtcataaggtctgtgggggtattactacttacaggttggaaactcagagaggtttgggacttgactgaggcatcccagccagtaattggaaacagcaggttttggatctaggtttctctttgcccgtttcacagattctcactgaaggcgaccaggctgcctggctacatctgcacaaagctaagaagtagccattgtggatgtggggaatccctgtgtggatactaggggtctcaagaacttacgtcatgatggagtgataagtgtctgcctcccatgctccaggtcacagttgttcccagcttctggaaacttcctttaatccatcccatgatggtagcctcttcccatttccttaacacgtgtttgaagactgaattgatgtcttatagtgtacacgtgtgtgtgtgtgtgtgtgtgtatgtatgtgtttgtgtggggggggaaggtgtgtgggtgtatgtttggaggggatgtgttggagtgtgggtgtatgtgtgtagtggggtgtgggttgtgggtgtcggtgtgtgggagcttgcagatgtgtgtgggagggttatgagtgtgtgtgggtgtatgtgtggagtgtgtgtgtgtgggatgtgtgtgtatgtggaatgggtgtgggcatatgtgtagagtgggtgttgggtgtttgtgtatgtggaatgggtgtgggtgtatgtgtggagtgtgtacgtgtgcagcatgtgtgtatagggtgtgcgtgtaaggggtgtgtgtgtgtgctgtatgtgtatgaaaggtatatgaagaggtggggtgtatgtgtgtaatgcacgtgtgtagggtgtgtgtatgtggagtgtatgtgggtgggtatatgtgtggagtgtatgtgtgtagggtgtgtgtttatatgtagcgtgtgtgtatatggggtgtgggtgggcgggtgtatgtgtggagtgtgtgtatgtatagggtgtgtgtgtctgtgaggagtgtgtgtgtgtgggtatatgtatgtatacagatatacttgaggtctgtcccctcagtcattctctagatgactctgaagaaaggatactccctaaaaagcttattgactcactctcctagaggaagaccgggtcacagtgaacctcttgggagctggaactctctagaggttgctgaggggcctgagagttgatgatacttgatgaagggaacattttgtctcaaactttaaaaactggtggtgaatcctggctgctagtctttgtggaagctagttatttattcagctaaaattggttaaatttctattatatgcctggttacagggtgagcgctcaggaaatgtggaataaattaattaatgacaagtacagtgctcagttttaattgcaagtgacaaaactcaagtctggctaaatgaacttaaaaaagacatattaggaggatactgttcaactcattgaaagaagactagggaagatctgtagaacctgcccaaagccaaggggtgttgtgggaagcatgggaatgagggcagctctgggaatttcatggacatctctgggggcagccatcaactgactcgggcccattcacttcagactcctttcacaattcagattcctcagggagcctgggtcacggttgatcgactcccccaaatcatgtggagggcgtgaggggttgctccacagaggaaggtgtttcgagcagacacagacacacatacaagtatccacttcggctgggtgcagtggctcagagctataatcccagcacgttgggaagctgaggcgggtggattacttgaggccaggattttgagaccagcttggggcctggtggtgcatgcctgcagtcctagctatttgggaggctgaggcaggaggatcacttaggcccaggaggttgaaggtggggtgagctgtaattgcgccattgcattccagcctgggcaacagagtgagtcttcctgcataaatttgccccccgtccccccacctccccccccccgcccgcccacagaatctccaggagtttgtagtcagtggggaaagacaggtgagtaaagggctgtgatggttggtgtcgaaagtttgtgcaaagtgcagtgggagcttagggaggttttaacttttgcatgcgggagccatgcccaggtcaggcatacagaggttgtccgagctgagttttaagggctaaggaaatgtttgtcagttggaccaatgcctttcagcagaactccctgtgtgatagagtgatctaaaagaatggtgtgtccagggaatggtgtgtccaactgcttgcttggtctagagtgtgcatcatagaaggagaagtatgggtggagctggatcttaaagggccccacgtgctctgttaggcactgggcctttaaattataggagctaagctatcattggatgatgttacgtggcagaaggacatgatcagttctgagtttagggaagttgatcggggaggtggtagcagtgccctcaaattcgactcccttgaatgtggctattaacctggggatgctgattgttgcagaccagccagagaatgagatgctgggggagccaatcaagagactgtccacatggctggagaatcccaaatagccataggatttcccagtaacaacttctgccgtggattcagggggatggtcgtgggtgaaggaaagaggcttctggtggcattcattgcccatggaattctaagtgttcgagagtgctatatcttggacttagagggtcagaggctgatgaagcttgtgaagaagcaggtgtggggggtttatcccctgcctcacctccacctttcacaacagtcagttctctgtgcttagaaatcagcaatgtgctgtgcagcagctgtctgggaagaacattgaacaggaatgtagaaacagctcaggcccttatgctgggtgggaatggaatcacttcctttagatggccattttgtgaatttttacagaggaagttgaatgagattgagaaagcttgggtccccagaggtggctgggggccgggggagagcttcctctttcttataaacaggagcttctgacagggagtgacatagcattgtttcctttgtgataggtggtttctgaaaacaggaaaatctttactcctaatgtgaaaattgaaagcttgtcctttgtaggaattgtgtctggaacctgtttgaacagcatggagaagggtttagcgaccctggggttcagatccaaaagataagtttgattctacctgttgccatgttttagctgtgtggtttttgccaagttacctaacctccctaagttttaggttcctcaactgtagtgagttacagtaactaccaccacaaccaacagcaacaaaacctagcatgtgttgaacttacagtgtaccaggcaccatacaaaagcatcctatattcattatctcttttataccttacacaatcctatgaagcaggtagtgtttttatcagcatttaacagataaggaaacctaggcacagcaagataggtaacttgccagttcctccctttctcacccctcaccccctgaaagaaacacacacacacacacacacacacacacacacacacacaacccagcaattggtagagctaggatttaatttcagatgttgagacaccggaatttgatatatcagagagctgttatgagttttaaaggaaattatgtgtaaaatgctgaatatagttcctagtacttcgtgagcattcaataatttagccatttattgtgtttttagcctcactctgctcttttttgccttttgcagaagcagctgacacaggatgatgatactgatgcggttgagattgctatcgacaacacggcttttatggacgagttcttttctgaggtaggcaaccttcctgtatttttttctaaatgtacataaggaaacactatttccttagtaagaataaaaaaccttagatttttcagggtagcagaggaaggtcacagttttttgctagggtgggatggccagacaaagaaattaaaataacattattttcaatatttacttgaatctggatttttaaaaatcttaagaaagtcagcagagggtcaattatatgtaattgaagagatgcttttaaaatcttactccgtatgacaacattttaatgatatcctttcttgcttaaagtacataacaaatacagaatcaaccataggatcacaaccatgagtataaaacattgcatctttaggcttgtgattcagatacatcaaatgtgtagttttgaaaattttggggccagacatggtggctcacacctgtaagcccagcactttgggaggccaaggcaggtggatcacttgaggtcaggagttcaagaacaacctggccaacatggcaaaaccctgcctctactaaaaatacaaaaattagccaggcacacctgtaatcccagctacttgggaggctgaggcaaaggaatcacttgaatccgggaggtggaggttgcagtgagccgagatcgcaccactgcactccagcctgggtgacagagtgagactttgtctcacacacacaaaaaaaaaaaaaaaaaaaaaattatagtccctctgacttaattctagtggtaactgagaaaccaaactgccagtttagttttgtaaaagttcaacaggggcaaaaatgggttcatgtctacagatccatgtactctgatcttaaaggtcctcaatgggatggtactatgataggtaggtggtggaggaaagcttgtagaggcagtagtatatcgtggatgaaaacactggctttcgagctgggtaaacttgggcccaaatctcaaccctgcttctgagaagctgttgatttcatgaacgttccttaacaatctgtgtctgggcttccttacctgtaaattaggattgataatgtaatttcccacaggtgggatcacctgagcctaggagtttgaggctgcagtgagctatgatcatgccactgcattctagcctgggcaacagagtgagaccttgtcccctaaaaaaaaaaaaaaaaaaaattcactggtgatccagtgtttaggtaagaaaagaaaaaaacaataaacaacaaaaatccccattgagttgcataaggattaagagggacaggccaggcgtggtggctcacgcttgtaatcccagcactttggggggccgaggtgggcggatcacaaggtcaagagtttgagaccagcctggccaacacagtgaaaccctgtctgtactaaacatacaaatattagctgggtgtggtggtgggcacctgtaatcccagctacccgagaggctgaggcaggagaatcgcttgaacccaggaggcgtaggttgcagtgagccgagattgcgccactgcactccagcctgggtgacagcggtagactccgtctcaaaaacaaacaacaacaacaaaaaccaagaggaataatgtttgtaacacagcatagcatctggcatatatgtgcttaatgaatgataattcaaaaaacaaaaacaaaaagctcactattgttgaagtttctgccaccatactatggtttcttaggtttttaatttcccctggaaagaaaacaagaagtatcgtgctctttttgcagagagaatgtgatgcttcccatcctctagactgtggatgtggaaaagtaaccctccagttttttttctgaaaggaatggagtggggcatgacggttcgtgcccatttatctgttagagtaataaacaggaattaagaataaacttgaatgtgtgctggcctgattgggaagttggctgtaaactctccacagatccccaccctcctcacaggcgggtccatcagagtcatagtgagatcaaacaacacttaggctttgtgagtccagtgttactccaattgtggatcgtggaaggacaatatcctttcactccgtgatgggggtggacttaaggagatgtttgaagtctttctagctcatctcagtctgccttggagaaccagatacattaaagaacttcttccctaagataaggaatcttttccaataactgtgttctcctttttcttctgagccagtcagagggtccctgagaggaccctctttgttaggtgtgaagatggtgggctttggcctctaaaacatggtttgagtccacttttcaagcatttcgtagcagtgtaaccttggtcaggttgcttaacatctcttagttttaatgtcctgctctggaaattgggagtgttagtacttacctttcaaggatgccatgaggatcatatgagatcacacatctgggaaggatcgtcagacataaaagcactggatgggtggtagctacttctgaagaggctgttgaagatttaacaagaccttcagggctgctgcattgcttatttctttctctttgttatgtgtgtgtctgtcatttagggaaaaaccccgtgaaacttatatttagagtggagaagagggacagcatggggaggtggaaagaacatgatctttgaattaaattccatatctgccactaactgtgtgatcttgttcacattccttaactgttccaagtatcagtgggtttatctgtaaactggggagaaaaatattcatgtcatagatttggtagagattaaaggagctaatgctcagaaagtacttagcatggggttcagcagtgttactttcctcttttcttggatctgatagagcacagagaggataaggccttgggggagtggggagaagtaagagggagtggatcaagtaggctctggccccacctaacatggtctgaatctcagctctgcccattaccagtggtacaattttggaaaagttaactactctaaaccccagttttctctaaaaagagaatattacctgttggattttatggatataaaatgagaaagggtatgggtgcacctatcacagtgcctgacatctagtacatatgttcttatcacccttctgtcccccagtgtacttatgaataagtagaccacaaagtttattttatagaatgtggtgtagatatactgttgaaattgggataaattatgtttcagagaatagagatttggggaaatgagagattgtccccctctatgtgactggtgatcatgcccactacaccctgcaggttatataactaagtcgctttcttgggaaagcactcttgataaaacttactgtttggactggttccaggaggtcatccttggttatttgctgagagcatgaatcacagcttagtcatagaggtatttgcaaggtgcacatgaagtcataggaccagggtgttttcagaatgtgatttgcactgtcagattccattgtatcttctctagcttcttgatcgttggaaaaaaagattggcccttgggttttcaggccactttggctgatcaagccagagcctggtaaatgataaacgccacatttttgtctaatttgcagttgtctatatttttcttggtttgtttgctcagttggcagaaagtaatgttcagatgaaacagacctgcctttggaggcagaaacattaggggtttatttttctgtattcgtttatctattcatcaaagtatttgagcgcttactgtcttcaagatagcatgttaggtgctggggatccaatgttctgtgacaggattctcgccccctgttgtctccttatctggtaagggtgatagaaatttttaaaatgttgttatatgataagaaaagtgtcagtaaggtaccatgggagcacagaagaggaagcgttaaattctgcctgcagagaggaaggtgagggaagatttccctggttcttaactagacttgtcatcagaatcacctggggagttttttgcacatacacatacctgattcttagggactggaatggctcagacttttggatttttaggaatgtcttccggataattctgttgcctactgcagctatgcaccactgcaaagtgatggggaaccttcgaggatttaaacaaggaagtgatgggctcagagtgtgttttagaaaattcactccgatggcagtttgtggagggtgcgaaagacctgaaatggaaagaccagcaagccagcgatggagccttgacctgaatctgtgatcctgagcagcagtgtagcctatcatttagggatgcttttgactaactgtggcttaagcaacaaagatatgtaattattttgcatatgaagtagtttggggttagggatggtgccgtttaaaggtcagcttggggttctaggtcagcatcactgtgatcctcttggcttttctcttaggattgtgagagagagagtctgttctgtgattatctattgttatatcacagcatagccccaatatttagtggtataaaacaactgtttgttttgctgacagattctgtggagtaggaattcaaacagggcaaagtgggtccggattacttctgctctacaatttctggggcttttattgggaagacttgaacaactgcaggctagaatcttgtagaggcttttaaaattttactgtctggtgcctttactggggtggctcaagggaaaagctcagcagagactgtcagtcagagcacctacacttggcttctttctgtggcttgggcttctcgtagctggcccacttagggctattgaacttgttacatagaagctcagggatgcaaggcaagtgttccagctacagaagttacatagcacatcacttctgcttggctctgttactgaagcagtcacaagcctgccagattaaaagagcggtacataggtcccacctgcctgtgttttgaaaccaccagagtcagagctctatttggcatcaccctgtgacagcgttgcaagcattaagaaagggtgcagctagaaaagtccaaaggtcctttcatcagagaggaaaactgcccagatcctccaatctgacttcccttgtggcctcctggatagcactgggtcacatggtgtgggcctccttagctggaagggacaccaggaaagtgagtactcagcaaagggacaggattgccaggattgccatcaaacacatcatgattcatcctctggggctggcaatgccactacccaaacaaagtcagatttctgttaaaaagaaagagagggaaggggccagggaatggctgtttgttgggtcagtgaaaatgcgttgtcacagatggcagtgtgaggtgcaaaaagccttctgtgatcaaatatgtttgagaaatgcttcctgcttctttcttctcttggaaacttaaaatgcacgttaacttattgaaagctctaagaagtcctgtaataaatcagcttaacttggctatcctagcatttaatttttcagagcaacactttctaacatggaacttctattaataaggatgaaagttttcttttcttttcctttttttttttttttttttggggatgaagtttcgctcttgtcgcccaggctggaatgcaacagtgtgatctcggctcactgcagcctccgcctcctcctgggttcaagcgattttcctgcctcagcctcccaagtagctgggattacaggcatccacaacaatgcccagctaatttttgtatttttagtagagacggggtttcaccatgttggtcaggctggtctggaactcctgatctcaggtgatctgcccgccttggcctcccaaagtgttgggattataggtgtgaggcaccacgctggccaaaaatttacttttttgaatgctgtcttagtttgggctgctatgagaaagtaccgtagactgaatggcttataaacaataagaatgtgtttcctacagttctggaggctgaaagtccgagaccaggattccagcatgatcgggttctggtgaggaccctcttctgggttgtggactgccaccttgctgtatctgtatccttacagggtggaaagagcaagctagctctttggcctctgcttataagtgcacaaaacacagtcatgagggctccacccttacaacctaaatgccttccaaaggtcccatctccctctaagtaccatcccattggggattaggcatcaacatattaattttgggagagcacattcagtccataagaagtatgcatttgtagtggtataacagaccatttgtagtgatataagaagcatacttgtctcctgcagttacttatattcatttatttattcagcaaatgtctactgagtaacccacatgcttgacagtgatgaatatcaagtagtctaagttgagcaacacgtggtcctagtgcttgaggggatctgaatcagttctgggagaagttagggtggataaattgtgggcatagtgcagcagagcctggctggggtgaggggtgggtggagcaatacctggctggaggagctgtgaggtgaccagtcttgaagcatatggatttgctaggtatgcttgatttttgttagaactaagaacctcaaagtgaatccaacttggaaatccacacattaaatctagcaggttaaatactttttaattctttaagtagaatattggatgacaatgacctaccaggcaaactggtagattctgcatttctgggctcttccaatggggcaggcaggaagccttgccagtcatttgcctatttgcattcaggaccattccctactgtccttcctctgctcttctctgtatcacagggaactacatttcccagcttcccctgccaattgcttttggtatatttgactaaggagagtgttatggactgaatgtttgtgtcccctcaaaattcatatgctggagtctaatcgccaatgtgatggtatttggaggtagggcttttgggaggtaattaggtcatgagggcgaattagtacccttataaaaagagacgtgagaaagatgatctctctctcagccatgtgaagatactggaagaaggcagctgtctacaagccaggaagagggtcctcctcagacatcagatttgccagtggacttcctagcctccagtactgtgagaaatatatcctgtgtttaagccacctaggctatggtatttttcttacaggaacctgaacagattaagacagtgaggtactagcagaagactcaaggaggagggaagagaccatagttttcctcctttctctctctacctcagacatgccttcttcatggcctcagctctttctcaatagaccccgcctccatggtcccagttctgctggtcaactccaccatggtctggtccccatcagacagctctggctttaggctctggtgaccctgccttccttctctttcgctctgacctgctgttgctaattttcagagtgccccagcaaacttctgtttggcttcttgacgcttccatccctgcataaacaatccctttattatattactttgattaaaataactagataggttttcactttcctgactaagttttgagtgatgcaaagccccaacacacttaatttacttgagattattgtctcagaatacttgttttcattggtcagtataattctgagatcattcttttcttttcattcataaaaggagaattgaaacattagtcctggtcttgataaaatgcttttgggacttgacttccattgcttggttgactgaggtggccttttccctcccttttcatcaacatttgttttcttttttttttttttttatattagcacaaacacatttatttattaaccaaagggatgatcctaattaatccaacacactttgaaatagctgcatgtaaaatgtttatgataaagataattgaacacagtaatgaaaaaaaaaagaaagaaacagtatggagatttgctcattgaactgagcttggtcattctcttaattaactcctgtccaaagtgatgatggaatttttattctactttttcatagatccgagtacaggtgacattgttcatgacacactccaccactaatttcccatctttcaattttcttgttattgtgctttccttcccatcccactcctgatgctgaaccaatgcaccatctgtaaagttgcagacagtctgagtttttctgccatcagctgtggtttcttcaaacttctctcccagggtacaagaaaactgtgttgttttcaaagtgctctcagtttttatggtgaggtttttaccatcacaagtgatgatacaatctggcttggccattgcgcccatttttcgcaaagctattcccactcctagctccttcatgtattcatcaaagcctttgctgtccaccaggcgccatcttccttccagctgctgaactgtggccatggtgggtgcgggcgggctggcgtgcagagagcaacatttgttttctaaagcaaagaagcaaacaaattaaagaggacttgactgagcagctctaatatgaagactgcttgggattctgtcattttttggggaaagtgaaggtgtataaattgtgaaaaggagggatcatttgacagttaaaatcacattgctcttgtcacctcgcaataagttttcaatacgtaaatatgcagcaattaatgctcaactagaggtacaaggtacctgggagtttaggagaggccgagactaattcttagggagaataaacagagcttttttgcttagccttccatcttaccccatgcaacctgccagttccacaaactagtactttctctgcttttccttgtttaattagattccactggctaattaggtccagaaggaagaggccatccagatctcgaaaataactccttccttttagttatagttattagtataatatagtaattatatttggccacgcccaacatgtagagtgattgacttgggtgttgaccttagatttccttgggtggctactgatgaggtcagactgttttattaagacttttttacaggattgctatgaggattaaatgagacatgcctgtaaatgcactgcatagtacctggcatatgacaaatgtgcagtaattgctggcatttttgtatttatcattgtcatcacctaacatttattgaacatgtactttatgttaaacatttggcatgtattgtctaatttaatcttcacaaaaactctaaagtgggagttgtgataattctcatttcacagatgagagaactggtgcttagggacacttacagggtgcgttcaaggtcataaaactgctaagagagatggagcagaaactggaacctggtctgtttgatcttaattccttaaatcctatattatctggattcccgtattactaacaaagcattgaaaagtacattttaggctgggcctggtggctcatacctgtaatcctagcactttgggaggccgaggtgggcggatcacttgagctcaggagttagagaccagcctggccaacatggtgaaaccttgtctctactaaaaatacaaaaaaaaaaaaaaggttggtgtggtggcgggtgcctgtaatcccagctacttgggaggctgaggcaggagaatcacttgaacccgggaggtggaggttgcagtgagccaagatcatgccactgcactctagcctgggcaacagagcaaggctttgtctcaaaaaaaaaaaattaataaacaatgtgcaatgagaaggcactgggaatatattagctgtaaattttacatggtgatttaaaaaaaaacacttttagatgtcaacacttggtcagcaatacttcttgagggctcattttgtaaaaagctttctatagggagcggtggtgagaagacagagaaataaggatgatctctgtgaaaggcaactgatccattctcccaaaacagtggattgaacatgcacattaacctgatgtgagctgaatatgcatgaacttgggagagaagatataggagccttccttaggcgtttacctggttcaggagacaggatttagtattcctgagttcaaacctcagttttgcctctttctgcagtataacctggagtaaatttctctacttctttgagactcgatattctcatatgtataaaaaggagatgatgatggtagcctcatagaagtattgtgaagtgcatagcatcatttctgatacaagaatatgtttagtcaattttagttcttaaatatatgaatatgcagagtaattttagatgtcagtatacttaaccccagacaaacacatgcaatagcccttaaacttttagattgggcacttgtcagtttcctataccccttccctgcaattgcctcatgattttttgattatgtggcaaatgcacaaaaggaaaccacatgtagctgccatttcacaccattaaatactcagaaagtcacctttgaggaaaaccagtacttctaagaaaaagcaaagccacgaagttcaaaaaaagaaagctctatggttggccacttgcccatcctgaggtcccaaaaaggtcctgtgattatttggtgaactgactaaattgctgtgaaatcagattccctgaaatgcctccaaatagaaaggttgatgcggtcagaggaaagagaccagctacagtgggtggaggatgggtggggtggaatggagtgctccctgggcctgggaagtcccgtaggcaggttgcggatagagcacccaggaccagttctcctgtgcatagggcagggtgagtatcagccatccagtctccaaatgcctgtagtgacactgagcctgaggcctgccagtctcatcctagaaacttcctatctcttcctgtgcttctaccattgactgaactttgggtcagaatactcttcagtttataaaataattttccagatgagagaatttctgtgacaaccaatctgttgaacatgcaaaatctaagtccttcatgacttgttaaaatttaaaatttgataaactcatttaaaaatgtttagtgtgttttcttctagaaagcctttttccctccctcaatcctgtaaaacagtgtaattgctttggcaagacagttatgtggtggaactggaaaccatggtgtgatgcaatgacatgagttctaagaggggccagtagattctgaggtggtcacacccctagagtctgtgagtgtattagtttgttttcatggtgctgataaacacatacctgagactgggcaatttacaaaagaaagaggtttaatggactttcagttccacgtggctgggaaagcctcacggtcatggcagaggtcaaggaggagcaagtcacgtcttacatggatggcagcaggcaaaaagagagcttgtgcagggaaactcctgtttttaaaaccatcagatcttgtgagacttactatcatgagaacagcacaggaaagacccactcccatgattcgattgtctcccactgggtccctcccacaacacatggggattatgggagctacaagatgagatttgggtcgggacacagagccaaactgtatcagtgagtatcataggttgtaacagaggccttttttatagctgggtagggctggaatgctgctaaacagtacagataattaaaaaaattaactcttcaatctaatggaaaaaagcttcccagttggagtgtggagggcactatttgcatgctgtccctaccactagctatgtgacctataatttctttaaacttgtttcctcatttgaataatggtactggtccagtcttataggttgctttgtaaactcttaaaatgcttcacaaatatttgggtagttacctgtatgtatgtttacactcccatgatattattacattgtaattttattctacatctttcagcaagcagctctactcttaaactctggcacatctaagccaatatatttatagaggggaaaatcctgtgctccagtggcaaaagtactgatttgagggctagagagctcaagtattgtttctcctattttctttcttttccctttttttttgtttgtttttgagacagagtctcactccgttgctcaggcgggaaatgcagtggcatgatcatggctcactgtggcttcaacctcccaggctcaagggatcctccgttttagccccctgagtagctgggactacaggggcatgccacgatgcctggctgatttttgtattttttgtagcgacggggttttgccatgttacccaggctgatcttgaactcctgggctcaagtaatctgcctgcctcggcctctcaaagtgctgggattacaggtgtgagccattgtgcctggcctctcctattttctattgaatatgaagagctataatcaggttttgaaaaaggtgaagtgtccacaggaaaagagggatgctggaagctgcatatgcattgagttttatttttgttgcatctcagatgttaggatcctactgtatgacattttacaagatttctgtttgtcaattgttgcaatgttgatgtgcccttcactttgagagtgaagcagatagaccctacaggtgctgaggtctctccttcctgccctgctccctgtacataggcttccactgcagcagggctgtggtaccagtggcatgggcacctatgaagcggggagctgaggctgcagtcaaagctcacacaggaatgtctgacagtggcgttctacctgggaatgaagtgctgctggaaatattttatgatactcacagccttgtacaatcaggagccttagaaatatgcagaaatgggctgtggctcgagctactgggtcctgatcgtctgaggaaatcagttagtacaagaacatatgtgtcctagagaagcttgggctgtctcctgagaccttcattgcctagtatctctctttttctctccttgttttctttatctgtttctttctttcttttttttttttttttgaggcagtctcgctgtgtcgtccaggctggagtgcagtggtgcgaactcggctcactgcaagctccacctcccgggttcacgccattctcctgcctcagcctcccgagtagctggtactacaggcgcccaccatcacaccaggctaattttttttttttttttgcattttttagtagagacggggtttcactgtgttagccaggatggtcttgatctcctgacctcatgatccatctgcctcggcctcccaaagtgctgggattacaggcatgaaccaccgcgcctggcctatctgtttctgtctttctcttcctctcattctgtgtttttcactctctaggtttgttcttttcctttcacttctttctttccttccttcctttttcccctctccttcatcctcactcttttctgttctcactttttgggctttaaggctctgcctgctaaggtctgctgattctccccctctgatcattcttcatggtttttcttagctcttcttgactttggcctgaatcctttcatccaaagtgggtgaatgtattactcttagggagcaacaagtatggatttttaacaactgttctgttgagattactttatctgaccatggaaagggtactcactgggcagctgaggactttaagtcattatcttcttccacaaacccagaagatgggcagctttcaccagcagctctgccaaacgtttatctcagccatggacctgtacttcctctttgatgatgaaggttattgtctttctgattatagattgaggaaactcggcttaacattgacaagatctcagaacatgtagaggaggctaagaaactctacagtatcattctctctgcaccgattccagagccaagtgagtgtttacttagaactgagtcatccaacaatcaccctttccttggagctgagccagccttgttttcttgcccttcgtgagcagtagggaagtgtacaagttacagggcactagtgtacatattatctcatttccctcccctttaccttacctgagctcctactgcctggccacagtcaaggttttgtcttcatggtcccactccaaccatttagctagactttcctgtttcccagctagtccctcttcctgactggcgacgattcccactgctgcttacataccctgtgccctgtccctcctctgagcctctgcgtgtactatttccccagcctgaactgcttttcctagccctctttctgaatcctaccagatcaagtccattttttctttccatgaggtgttccaaaatggttcgagttcacagaaattccttctatccctaaactcctgtttgttaccaccacctaggcaaacgttttttctcccctaattgtttgcatgggtgtccaaccttttggcttccctgggccacattggaagaagaattgtcttgggccatacataaaatacactaacactaacgatagctgaagcgctgaaagaaaggtttgtgcataattttcctgatatctgccactacagataagcaaaaaaatccgtgcgttccacggtttggacacgggtggtttagggctatatttttggttccttaagaacagggaacaagcctgacactgtcattccactctttcatttttcccatgggccctcttacctaaagactgaagtgggaacactttagcagagcatatgggcattgtcttgatcacattcctgccttcccagccagcctgtctcctgccatcctcctcctgcttcccacgcttcagccagagcaactctgtctggttccccaggcatttcctgttcactcataccctttacttactgtttcttctcgtgggattcctgcttttagtctctttctctacctggccaactcacagtccttgagactcagtcctgctcatctccatctttagaggcttttccagatccctccaggctgtgcacaccttgaccagaactcataccttactccacgctgcatattagagctgctgatttatttctcctttgtctcccactagactctaacaccttgcaggaaaaatctagatcttctttctgattccatagtttctagctctgttccaaagttgtagtaggggctgaaggatggcttttgaatgaatggttatagctaacacttagtttgctccatacaacctaggatgtgtgtagtaggtatgtcataaatatttgcctcattttaagttgattagccttggttgaaatctattttccccataagctccctagaaccttctcaaccgaagctcccgtggtaggctctttcctctaaaagcagagtttccacaattttatgtgctgcaggattactcaggagggttgaaagagctgattttgtggttccaaccctgggtatttttattctgtagactgagatggggtgcctggaaaatgcctttaaaaaaataagcactctgtgattctaatgacagatgctggggagtgcgtagggataaataccattctgggcagtggatgcccgataaagctcccctcctctgatgatgattgctgtagttcacaaaggaatcagtcctctcctttctaacggattctgcctgcctttatttacccagaaaccaaggatgacctagagcagctcacgactgagattaagaaaagggccaacaacgtccggaacaaactgaagagtaagaagggaacaaagaaaacaaggccgtccccaccaccatctatctcagctcccctagggtccagctttccgaactgaaactcctcttgatggaagtgacaccacttggtccatctttgcttgtggtttgggctctgtccccgcaatgatccattgtagccccagaaatttaccttttcttaaatcctgactgtactggaaagagtccagaattgaagctaggagatgagaattaaaatgtgctttcagctgctgagtagttttgtgacttggtcctttaacttagtctttcaacttgtctctctttttttttttttgagacggagtctcactctgtcccccaggctggagtgcagtggtgtgatctcggcttattgcaacctctacctcctgggttcaggtgattctcctgcctcagcctcctgagtaactgggacgcacctggcccatcaacttttctcttattggtcttatttccctggcaactacatacttttttttttttttttaagacagaatcttgctctgttgcccaggccagaaggcagtggctcaattttggctcactgcaatctctgcttcttgggttcaagtgattctcatccctcagcctcccaagttgttgggattacaggcatgcaccaccacgctcagtcaatttttgtatttttagtagagacgaggtttcgccatgttggccaggctggtctcgaacttttctggcctcaagtgatccacctgcctgggcctcccaaatcgctgggattccaagtttgagccacaatgcccggccacctacatacatttgaatagtcattttagagatatataaatgcaagagatatcattcagtctacagatatttcttggtgggctaggcataccaccttcccataccctcactccccccatttgggagagtatagttcaatgaagctactgtcatagattcagttcttccagagcctagaaggtttacttagttctgttgctagagcctgcattcttgcccagtgtatttggtgcatgcatgctattgatcagaagagaaagcattattgctcagctcaatttaccatttcttccccccaagtatattgcaataactattttaactggaggagtcattagtagcagattccagtaataacagtgatagtgcacctgccattgtgctaggcactttatgtgtcttctcatttaatcttcacattagtattgtgagggagggactgttattctgttttacagatgagagaacaggtacattaagaggggttaagtggctttttcaaagtcacacccagtaagtgccagggcaaggattcaagcctaagtctcatggtgaccagaacccatgctgttaactgttatgccaaaacctggtcatcgtaaaggctgtggaatgcacgtcctgtggctcatctgggagctgaccttttgaggtgacacctacctgttacatctccgtgggctggatgtgtgggaatgagtgaggaagtttcactgaatagcatgtttcttggaggcggagataggttgcaagtataaccttcctctcctctttaggcatggagaagcatattgaagaagatgaggtcaggtcatcggcagaccttcggattcggaaatcccaggtaagacttttcctggtctcatgattagctagtccaatctcttattgttttcccttaactgtggagggattttttttttttaatacaatccttattttgaaactcaatttgaagacctggtaaaggagaactctccaggttgaaataggggtcagggccagagtccagcccttttggctcctctcctgtactctccttctctaaggaggcccctgaagagcttttcaggcttcctagagcacagcttaggatttagcgtgccttcttgttttacaggagaggaaattaatgtcttctaacaattgttagtcattggttgtccagtttggagctaggcactttaggggtcatcaaagataggatccttgtccttaaagaactggcatgccattgaagcggcatggaaagctattacctaagacccagcaggaggatgcgacccagcaggaggatgcgataagaagacacatgcatggtgctctcagcatcaaaagatctcaggaagaatggggggtagccagaggaggctgggccagagtgccaacatgagcagcctcaggaagtagtttcccctctctgagaggcacaggggcaggagtgaggcacgcacatatgtgtgtgttggcagcagtggttggtagtggtggtgggtagacgtaaggggcagacgtgaagacaataggctttctgtagaaaaaagtttgctgtgggatagtggacacataatttttagtagataatgtagtgccacattctagaggtctttgaggaccagtctggggaatttggatctgatgttataacttacaggcatttgcttcaggcggcagtatattaggaggattattatggtagccatttgaaagccgtttacaagtgggaaagaagcaggaaactggaaggtccctagttaggtttttgcaagggttttggtctaaatttgtatggtggtagtgggtttggaaaaagtatatatattggcgattttccaaaggagaaaccagtaagtagggcttgatgctgagaggtgagcaaggaataaaaattattaggaaggttttagcttaggcatgcagggctgttgagataatgcatctacttataagcaagaagagttggggagatgagtttagcgtaagaactcaaggatctttggtaagtatgacatgtgggaagggaatctgacagttttagaatgcaagccaagtgttgtgccagaaaaatgctactagtccatgtggatgtagggctcagagatttagagatgacctctggcctcgcaattaccacgtgaggtcagcagtaaaccggtttcagtaaactggtgctgaaaccatgctctggaaagggcagtggactctcccagtggcacaaagctaggaaacaaaaaacttggtttgacacctggttttttgattccaagtccagtgctattgtagatggctatgtgggggtggggaggggttctataacagttacagaaccactggggcctgactgcattttacatcatcccacagcactctgtcctttctcggaagtttgtggaggtgatgaccaaatacaatgaagctcaagtggacttccgagaacgcagcaaagggcgaatccagcggcagctcgaaattagtatgtacttgaggtttggcgtgtgccctccacctttcctgccacctggttgtccatcccaagttttgaggccctggtggagcaagcaggaagcacattttgtgcctaagtctagggcagctcctgcaccactggcacatcccgaatgctgtgctgtaggctgaaaggtgacaccgtgtttatcaggcccaagtaattttattgtatggggtccagcattgtctcctatatagaggggaaatgcttgccaaacagttgctctcttgtggactcattgtatcattttgctgtctgtttgacagcaaagcacatttaagaaataaaaagtgtggtgtaagttgctgggaggataaaagtatggtgtaagttgctgggaggattagagaaataaataaagccataccctttaggaatgtagtaatgtggaaggcagggccccgtggagtggaaggtgctttggatgagaggaatggtatgaacataatcaagaaagagcaagtgtgtttaggagtggcaggttgtctagggtctggagaaagggtgtgtctggagtagcataaggttaggatggattgagggagggcttgcccatgaactagcatgttatgagggccttggacaccatagtgtagtgaatggggcaaggaaatgttctgagctgggaagcaatgtaatgagataagtgctttaggaaggtaactgctgatagtgttaaggatggcttggattagggcagaaataagatgagtcaggaggcaattgggggagtgttgtaaaggccacggtctttatagggaagtcacgttcctaattttcagggtccttatcagatggtgtttcaccgtgatcttatatttgacgctctacttcttttgttacaaagctggcaaaaagacaaccgatgaggagctggaggagatgttggagagtggcaacccggccatcttcacttctggggtgagtgccctgtgtgctcggatagcacatccctctcgtgagcagggaggccactgcggagctcatgcagtccagcaggtggagggggagctgcaggtgcagggagttcagggaggcaaggagctccccaggagcgtgcatgagggctgtggcaggggcagcctttcttgcaggggtagctaacagtctgtgtgtggcctgttgtagatcattgactcacagatttccaagcaagccctcagtgagattgagggacgacacaaggacattgtgaggctggagagcagcatcaaggagcttcacgacatgtttatggacatcgccatgctggtggagaatcaggtaagtggcagtgagtcccagcgtggggagggaggagaggaaagctcagggtctactgagaacagggagaaagggaatactggaagccagtgaggtagggtgggagaaccattgggaatttgcataaaggagaaacagaatcccatgggaaagtgtgcattcaaattgaatgttgacactttgggtgatcttaaccttgtcattcttgcctgtccctttggccttgcagtcgttgctagttgatacagggtttgatgtgttctgtcaagtacccagttttcctggatttttgattttttttttttttttaagatggagtattgctctgttgcacaggctggagtgcagtggcgtgatcacagctcactgcagcttgacctcccaggatcaagcaatcctcccaggatttgtctttttttctttcttaaaaatcagagatccgggctcctaatggtgacgttttaaaacagcctcctgatatggactagttcactgatgacattgaaaatgtgatcttttctctagttcacagggaagactcaggtttaacataaatttttatttttttccattttttttctgtttgtatttttttttaattttggcaccttttgctaaggcacagagcagacaacaacatgaatgaaggagtagcaaaatagcattgacagaaagactcgaaacactcgtggtgctagtttgacagcttactttgtcccaggcatgcttgctcgggatagaattctggattgcctgcatagggcgctagtttcgcatagttagatggttcctagttcttatgggacagttaagtgtgccacagggtcatggtgctgtgcactgttgccatgaacttccagctgctctgacacttgggataggagagaaaattgcttccatagtaggcagactgcacaacctagttgaagctcgagcacagcttgactagtttttgacattggttccctgccgagggcctggatgctttccccccattccctactggcctctgagaccatttctcaagtccctccatcccacctcttcttttcccccacactgccttgccgaggaactggcttgagattcaagtggtggtaagtgccttgttctgtttacagactgccataaagtgatagagttgggttgggtagttgaggagaattcctaaaatgcctaagattaattggaatgatcaaacttccctgtcaggaagtgattgctaggaaatggttgggaagcttatcaagagaccactgtctggaagggaaaatataaccaaatagcttgggtaaacccaatgtctgtcagttaaagggcctggaaataacttagagaaagcaaatgttccccacctcagatagttattgagcacctactgtgtgccaggcactcttctgcagttagtgaatatactcaattcaggctgaatgatgttgattcaggtctgaatgaccaggaagaggccagcatcctagtgatgtcctaataacaatgagatatccttattttggttcctctccatgtgcttaagtgtaaaaaaaataacaaaggttgtctggggatatctcagagtatatttataggtagttactaggtatctagatagtatgttctggatgcctggtggagtgctggtcacagagaagtagtaaaattcactgaatgtttcttgaacaagtgactgccaccccaccaccaaggactgtgaatgggtgtcctatggaaggccatgcatcaaggtttgtggatgctcttcttgccactgaagattgtaagaaagagaatcccttccccgcattggctaggactgacctgagacgtttacttggtgtgatcagagtctgttctttgcagggtgagatgttagataacatagagttgaatgtcatgcacacagtggaccacgtggagaaggcacgagatgaaacgaaaaaagctgtgaaataccagagtcaggcccggaaggtgagactctcctgtggccttcagagaagagagtccattttgtttgctgtgtctcgctctttctcttccctctccctgtctctgtttctgctgccaccacctcttgcatctggggaaagggatccatgattgaccgtattgagaacaacatggaccagtcagtgggctttgtggagcgggccgtggcagataccaaaaaggctgtcaagtatcagagtgaagcccggagggtgagcaccttcatctcaactgtccttcgtctcagctgtcttactagtatctcttctccctggccacccctacctgtgttcttgagcccatgcctccctccctgtcgtagcctcatcaacccctccctcagcttttcctagagacaagctgcctgcccttccttcccaggtgtgccttgcatggatctggctcacaagctatctccccaaaaacccacacttgaaaggcagttctgtaggatggatgcatggcccaggtggtgctgctaatcttctcctggacttagctcatgaggctttcagatgttacacttgactcctctgttcagaaaccttctcttcattgtcttccactccaggcgcccaagctccgcctcccttctctttttctctaccttgtacctagctcatgctaactgctatctatacattatgtcatatctgatggagcacctgttatttctactttataaatgagacagttgagggtcaggggctcagtaactggcttcaggccacctagtaagtagaggcactgggattcaagttcagatcccaatcattctgtttctaccacaccactgtatttgcccaccctctggtgcccctgccgcttaaggacttctaggcttctgtgctcacgactgtggttatccagctctggtggcgtctgctttttagacttctctcctttgactggttctcttgggctctgatattgttgttgtttagttctttgtttttcatccaactttacctattgcttatgcagggatttaggggactgggaagttattttacatggtgaatccaggctgggtggcattttctgatatccaggcagtgtactgggtctgacaggtaggagtatgggcaaaagtaggaaattagaactctatcaaaaatgcctttacattccctcttaaaatggaaaaaatcagtcagtgactttttatcttggccaactgctccttagagaccccacgatagtggctctgattctatctgtccacatatacagaactgcagtgtgagctgagagctgagagaggccccatatttccctctgctggcattcctagcctagaagtaatttaagaaatttaaactgtcctaggctgggtgtggtggttcacacctataatcccagaactttgggaggccgaggtgagaggattgcttgagcccaggaatttgagaccagactggggaacatgggaagatcctgtctctacaaaaataaagaaaatgagctgagcatggtggtgcatgcctgtagtcctatgtactcaggaggctgaggcaggaggatcacttgagcccaggaggtcgaggctgcagtgagccatgatcatgccactgcactctagcctgagtgatagagaaaaaccctgtcttaaaaataaatgaagtatcctagaaggatgtctgtatgtagagatgtaggcctcttactcagactggtaagatattttctatgtagaggtgacaggggttaggttttggatgagttgttatttttttggttgtttgtaataatgatttgtttttgtcttattcctctctccagaaattgataattatcattgtgctagtagttgtgttgctgggcattttagcattgattattggactttccgttgggctgaattaagagtggcctaagaggctgctgcactgaaatgtaagtaaacgagtggttcttggggactctggatttggctcctcaagaggaaattagcttgggatttcaaattcctcttctttccccctatgattgtccttggacacactgagctttctaaaactttcagtagcctgtggattctttatctccttatagttctattggtttctggctgcagtacgtggatgagctctccgtttgttcttatcctgtagattctgtccccaatctctgtcttgtcgtattaccacttctcccagcatacctgagcaccccaggtgactccccttactcaggaagcatgcttctaagttgggtacatctctgtcttggatctggagtctgtcttctgaattcttactgattttcatggatgttgggctttactttctgtatccttttcaatgtaaatgaaactctgaattgggatttggatctgcagagttttctctgttgctgagtggttgggtcttaaatgatgatagttaacacacttttgagtgttgtgttgtaccagacaatgtactaaacaccttatacacatatcattgaatccttacaacatcctttgagacagatacagtgttatgcacattttacagacaaagaaactcagtcaaagagaatgttgaataacagggccaagttcacacagctaatagtggacctagcttctctttgtaaaagaaggtagccacttatcattaactataaagcctggagaaccttagaggatagcgatgctaaaatttagactattcattttcttgaaaatttgttaaaagtgatagacttaccactgaatcactggtttttttttttttttgagacggagtcttgctctatctcccagcctggggtgcagtggcatgatctcggctcactgcaacctccgcctcctggattcaagcaattctcctgcctcagcctcctgagtagctgggattacaggcacatgccacagcgcctagctaatttttgtattattagtagagatggggttttgccatgttggccagaatgccttgaactcctgacctcaggtgatttgcccgcctaagctgggattacaggcgtgagccactgcgcccggcctgaatcaaaacaaacaaaaaacgtttttgttgttgttgttttttgtttgtttctcattcttgtcccccaggctggagtgcagtggcgcgatctcagctcactgcagcctccgcctcctgggttcaagcgattctcctgcctcagcctcccgagtagctgggattataggtgcctgccaccacgcccggctaatttttgtatttttagtagagacgaggtttcaccatgttggccatgctggtctcctgacctcaggtgatccacccgcctcggcctcccaaagtgctaggattacaggcgtgagccactgcacccggcctgaatcacgtttaatagtagtgagcatatcaatctggttattgggactattaagacttttgtgactttaaaacaaacaatttttttttgttgttgagattgtgtgttgctctgtcgcccaggctggagcgcagtggtgcgatcttagctcactgcaacctctgcctcccaggctcaagtgatccttccgcctcagccttctgagtagctgggactataggtgtacaccaacacgccaagataacttttatattttttgtagagatggagttttgccatgtcacccaggctggtcttgaactcctggactcaagcgatccacttgccttggcctcccaaagtgctgggattacaggcatgagccactgcgcccagccagtgacttttaaaatatttttctgaataaaatatagcatgcattgttaaaaaaaaacctataaaatacagaaaacataaaactaatgaacttttaatattattgctgataaccttgtggcacgttcacatactcagacatagttttacatagttcagactatattatccagttttgta

SEQ ID NO: 16652 - DNA, 143248 bp, Human
  misc_feature (1)...(143248): n = A,T,C or G
ggagcaggccccatgggcaacaggtccatctccctctccctgccttttgtccctgcctgagggtgacagctttgttctctctgactagctttctcctgaagtaagggaccaggatggaggtggtggccacattctcagagccttgagaacagagaagaaagacgtcatccccagacatcccagctcaacatgctgtagggaagatttgtgatgggcttagcttgggtcacatgttcatctctggatcaagagtggaggagcacccccccacacacacacacacaaaaccaaacggtgtgaagagtggagagtgtcttcctctgaagacaggaaagggcaggcagcaccttcaccatccacaaagttcagtatttaaagcaactcttgactccctgttgtccagacacagaaaacccaggttctgtttagagcctttctctgtcttccaccagcccagctccccagactccaggcctttcaggccctgaccttgacattatctgccaggatttcccctctccttccaccctgtcctgggcctggccgactcctgctccatcgttagggcccagtagttgtcggatccctacgcaaagcctttcccttgcaggatgctccacccaaagcacatccacgcacccagaagtgttactgctggaggatgtccaggttcttggtgttttgaacaaagaattggacaaaatgcacaaacaaaacaaggaaagaatgaagcaacagaagcagagatttattgaaaatgaaattacgctcctcagggtgtgagggggcccaagcataggtgctcaagatccccgttacagaattttctgggatttaaataccctctagaggtttccattggttacttcgtgtgcgccctatgtaaatgaaggggatgaggtaaagttacaaagtcatttaatcgctgtacgccctatgtaaatggagaggatatttcctgtcatagctgaagtgtttccgtttgacttagttctagaaagtcagcatgaatcgacctttgttccctgcctccagaccttactctcctgcctcagaaggactctgtttctactctgtgatcgctcccttcacactggattctgtgtcacccatcaccctaccagttcgtggtgtcatcaagatgggggctgttcctacttgtctttgtatcccagcagctagcacctggcagcggtagttacacaggaaatacttcctgtggttgtgttgaacaggataaaatagtgcatgttatgtaagacattggaaaataatttaaaatctaagtaacccatgctttgcaatctttaatgaagttctggtagactgcatacagttttattaatagttagcataaacggggtttcctccccctttcaatttatcttagaaattcaatatttcaggatgtgcaaaatcatttttcctcacctcatacatacatcgctgcttttagcatttcattgctgttctattctcttctgtgacatttcaatattttcagccagttctctcacctgccggggagccagcaggggcactgctgcggatcagaatgattttcccagcaggtggttcaaccattgattccagttggtggagactgtgacttccaagcaggagattttcccaaattggaaatctgcctgtactattcatggaagagtatatgtgtgtgacaaatgtgtgcgtttgcaagtgtgtgcacccagtgtgcgaatgaaggaatgaggtgggaggaagggagagagggagggttccacattgagtgtgtgggctattgttccgaggatgcatatctgactctgttgtctgagtctcctctgaattctccccggagaacctaaactgggaaggccctaatgggagcttccttggattatctgttaaaaaaaaaaaaaggaggtcacaatcttgctaccctatagcctagacattcacaacaatgtatcaatgcaattctgcactcatctttttatggtgtttttgtttttccgcagaggtctcattgccagcagtttcacggaaacccactatctgcaagacggtactgatgtctccctcgctcgaaattacacggtaattctggcacgttgggatcaccataatcttacaccactggatctgtgcttaacctttgtagccattttattcggagcaaaatcacatgcccagattcttaacttaggcccccccaagaagcgctggtgtgtcccttagtggtaggcgttctattataaatccaaaacagcagccttggccaggtatgtgcacagacagcccctgagggaatggctttatggcagagctgaaccttgaaaccaccttccaaggactatggatcctcatttgggcaaatcctttttagaaaacctagccagttagagatggcttggaaggcagccttgcctgaactgaacttggctacattaaactctgaggtgccttaaagaactttaaaagaaaactgattctgcttaacctattctgaatgtatccacaatgtggatacgattctatatcgtgggtgttactgtaacatgacatttatcccctctcaggcagtgtttctggtatttgaacttttagctgtgtcctggacaaaatgctcacttcatttgttgctttaacaaatgtttactgtgtactctccatgatctgtcccacatgtgaatatggggattcagagagaataggacagagtcgctgccctctgggaaggaggaaggttacttgttttaaagagctgtgggtattttaaaaaggatgagcttgaggcaggctttatgcttctcccttatcactgaaggttgtcaagtagccattactgtctgcagtgattcctcccttctctgcatgacaccaacacttttctttatcacttgtttgacacttggcacttgcaagctgatacctgcagccttccaggaacgtggtggaatgagctgctgtagctctcccagcccaaagaaaacacatggaaatccaggataaaatataaacatttaagaatttttgctaatgcctggtcaagctcaaaagagagtcagcaaaatccccaagaggcagaaacaaagaggggatgttattcctgagcactggctggtgagttggggctccccaaaggactattcaaagacccaaagggctattcaagacccagaaagagggcctggtgcttgggtttggaaaaagagaagtaaccgcctgcaactgagaatcccacaaaagccagatccccaggagagctgctttcctctgtgaaaaagagacaaaaagaactcttccaatccagggatgggggctgggaggaagaattgtttgccaggtgtcttggattgaaaaaagacttcataaaaaatgaagacattgaaaccccagttagtctcatgtgtggatgttgggaatagtctgggcctgtgtccaaatttttaataccagcgtaggaatggaattcccagtcaagatattgacctcaaaactggtcccacatcagtgaaactcccatgggcccagacataagccaacccaaaatagttctgtaggaatatttctataacccagataacatgagatgccctcatggaagaaaaagtaataaaaatattaaagatgagccccaaatcaaaattacaagccacacaatgcaaaaagccgttgtacgcaagcatcagcagacaagagaaacaagaattaggacttctgagaacataagagataatggaaaaatcagagaaaaaaaattaaagagaacagaatgggtctaatagaaattccacaatgaaaatacataaaatttaaaaacacacacaggaaacaagccgtgtttaatcagagtgtgacgagcctgtccctgaattgaggaaagacatgagtcttgaggaaaatccaccaaggaggtggataacttggaataactaaactaaacatactccaggacagcttatgatgaaaatgcagaacaccaaggatgaactcttaaaaccacttgaggcaaaagagagatttgtacaaaataatgacaactaaaccaacaataaacttttcattagtaactatgcaattaaaacttgagagctaagggaaaattattgtcagtctcaatcctatattcattaattattttgtaagaataaaaatgaaatagacattttcatacaaagatgagagaaattactaccctcagattccaacgaaggtatctaccaaagggtaactaacaaagaatagctcagtaggaaggaaactgatcaccagcagcaaggacaggaagtcagaggcactagtaaacaaaataatgcatgtgaataaatttaaataagcttcttaaaatgactgttgcaacagtgaccaaatttggatggtttaaaaccagatgagctaatagatttaaaatggtttaagaatttgtattgtactggagaataatagacacgctgattaactttagattttgataagagtgtgtcctgcaattttaagtataactatttaaagagtagaaaaacataaaatagcaagataaaaatgagtcaacatattaatctcattatatgtaaatagatggaatctctttgtaaaaatgaaaacatgatctgcttagaatttaaaataaaatccagctacatcatttttacaggattcacacccaaaatataaaatggttgtgagaactaagaaaaggaatgggaaaagatattgtagacaaatcttaattaaaaaaaaagcaaaacaaaacaaaaaaaaagctgctgtagtggtaacatcagagaagctagaccttaaggcaaaaatgacattaataggcataaagggagtaattctgtaatgataaaaggagcaacttagaaaggtagtaaaagaattttgaaactgtatatgctagcaaaattgtctcaaaatatataaagtgataaatggcagaatccagatgtaacttttaaatctaattatagattcatctagaactaagctttagcccagctcctaattaaaggatttctgaaaatccgaaacaaaacaaaaaagcattaaagattagacattatgggctaaaacttgtttggttcctagaaggttaccaaaaaagctttcaatactgacagcattttacaatttttcctcaaaagaaaagtctctagatgtaaaattgataagcttaattcataaagcaagtcactgaaaatgtctggacacattcacagagtgggagatttaaatatacctctctcagaaatgaagattttttaaatgagcagaaattaatgaaaaggaagaccaaaaaaaaaaaaaaaaaactcaagagggaagatgaattaaaccaaaagctggtgctttgaaaatattcataaaatggacaagacatttataaaattaagaaagaaagaattcccaagtaaataatattaagaatgcaaagagggatataaatatttttattcagagattttttaaatcacaagaatgttgtgaacaatactaattatttcttagaaatgtaaaattattaacactggatcaaggtgaaagaggaaaatttaaatataactatataaagatattaaatttgtaatagtatttttaatatttactgacaaaaataagctcagactcaaatgatttagctggtgagttttaactaacatataagaaacaaatagttcctgagaaaaaaagaataatttttttaaaggagggtgtggaaggagcttctaaaacaagaaaaagagcatgcacaaaatgaatcctacagactagtttcaattatggacgtagttgcaaaaatcctaagtaaattttacaaaccctatccagtacatattttaaaaatacttctgaccaaattatactcaactgaggaatgcaaggatagttcaacattagtatatctactaaggtaatttaatccattaatatcttcagattaaaagtattataactgatagtatttcttctgtgataacctatactgtttcttatagtgattttaatagcttttgtgagtggagaatgctatctatccctttcctaaccccatagagcctcacatagcatcttgcatataatagatttttaataaaattatccatctagcattgcattgtcttaggtgatgccatgtaaaattcatttcttcatctattcactcagcaaacatttatttagcacctcctgtttgcagacactgttaggctatggggagataggctgactaaaatatattcctcagcatataaattctgcttaagaggcacagagcattttaaagacatttaaaaaacatgttttaatgtaattactataataggagatgtgtacaaaataccactgtggtattttaattgtggctgattttaattctttggacgccatttcactaaggaagtaacattaatctgggtctttaaaagtgggcaaagaagaagaccaagatggggatgaaacctttccatactaaagagtttcaactttacctattgaaatttgggagtcataggaagttctcatgcagcagaatggcctgttcagttctgtgatttagaaagggtctctgatgacagaatggaagaaagattggtaggaatattggtagacagaagacaggaagatttcttatgggcccattgtagttagtgaaaattttgcctacagaactgggccttggaatggtcagcaattggccagagtcaagagtccttgggaagtcaaaggagacaggatcaggggatagagggtgggggaggtgtcatcagtgggactttcccttccacttaggccattggatgggcaatttgtttctcagtggtaccattaaggagcagttgttggttggaaggcagaggagatgagtcttggtttgtctgtgttgagtttgtcataggacagccaagtaaaggtcttctgtaggcagatggatatataagaacctagagtacagagaaagatggagtcctaaagtaaagatctgtggatcaacgtcataaataagtgatgggcagggccatgagttcacatttgacgtttatgtcctcttttacctccctaagatctcatttaaaatatgttttcagactcagcactgaggctatctccacagtgtaaatagttatttcagaaagaaacagaaaagagagatcttagaaataccacaacaataggctccggtcttccaaatgtccacgatctatgatggtgaacagtgcttgtctaatacagacatctctagaatgtgtaaaatatgcattcaaagttatttgaatagttttgtgcattctgttacaatctcccttactagttttctttttcttaggcatctgtattagtattagtcagggttctcttgaaggacagaactaataggacagatgtatatatgaaggggagtttgttaaggagtacagactcacacgatcacaaggtaaggcctcacaataggccatctgcaagttgaggagcaaggaagccaatccaagtcccaaaacctcaaaagtagggaagccgatggtgcagccttcagtctgtggctgaaggcccgagaacccctggcaaaccattggtgtaggtccaagagtccaaaagctgaagaacttgaagtccgatgttcaagggcaggaaacattcagcacgggagaaaggtaaaggccagaaaactcagccagtctagtctttccacattcctctgcctgctttattctagccacgctggcagctgattagatggtgcccacccagattgaggacgggtgggcctctcccagtccactgactcaaatgttaatctcctttggcaacaccctcacagacacacccaggaataatactttgcatccttcaatccaatcaagttgacactcaatatttactatcacagtactttttccccttttttctcacttgggaggaaaaatgcaataagcaagaagacgaagaaatagaggactagagaaacaggggttcaacaactgccaggtctgtttgggacttggattgcaaaagctgaagtctacatatccaggcatcttagtaaacagcccggatggaagggctccagggcgttgatagtgtttgtctccatgtggtgcgggactctgtgcttttctgggttctctgattcacatgtgcacaggagcaggagctcacatttttcctctcctccttttccatgtggttactgtgtgaaagggtgaatgtctgctccattcccctcgtcttcccccggtcctccccatggaactgtctctttacagggaagagggtgggaggagacaggccctgaaaatccctggtccctgctaactggggagtggctgcagcccctgtgttgggcagcccttgaggtcagtagtgggtgagacttgcccctccctccctccatggagtcctctaggcagcagtgttcctcatttctaccttccccacaatgggtcctgaggctttggctgggaagaaggggaaagaggtcggggcatggggaggatggaagttggaaattgcaggaagcctctctactgtctaggcctaaactagtatcctctccagaatataccagaagcctcttttttggcagtcattaagctgatgctgtattttgatcttcatctgactctgtggatcatctccactggggaagcaactgaaagctagattaattggcacccccaaatctccagaagcatcaagcacatgttgcttttataattagaaaaatggtgacttttcttttaacccagcagttcccttcccccattcctttgaatgcctttccaagcagtcagccttgttacagtaaagacagggagtgaacaatgttgttcactaattaaaacccacagcccagaacagctggtccttccagcaggagccccttaaggagagtccgaggctttgcattgtttttcgtggtgaggacccagatgcagcttttagggttttgtttttattgaatcaggctggaaaacaaaaagaaatttgctgactcatctcctcttctgctcaagtcagcacacagggaattttcctaaatttaaagttatgtataaaataagaaccactttttgttggctatagtgtatagtgctatttttttctttaaatatctcaacaattggtataagctggttgactcagaagagtggctgattttaattttggagttaatcacatcttttctctcgactgtcctgacaggatgaaatatttgtggctttatcctttgctgcccacatctaaggggagattatgttttatattgttacttttaataaggcctgcgggagactatccgtgtgacatttctgctgtttacatgccaaaagacagctctgaaaggctggcagaggtccccaaaaaggctagatgctgtcagtgctttggagggaatacattcgtctgttacatgcatcttgtcaaccaagaacctgcactacgcaggtaccatgacctgttcacatgcccccttatgctgagaatacagcagggattaaaaacagacaagggagcccatgggtgaggggaggctagaggaagaagactgcccttatcctggtaagcacaaacataattaacatctgggctaagtgcaccaaaggaaaggccacggggccctaatctggtctgagggatcatggaaggctttatggggaaaggaacatttgaaccaacagctggaggctgaggaggcatgaaccaggggacaggaggagaaacgttccaggctgatgctgagttttacttggggtggcgggggagaggaaggaagtgtttaggagctgatgaaagtcatagcgtataggacctgaggaccatgttgatagccttggttgtgataggggaacattaggaggtcaataaaggccttccccaaggcgtgtcatgactatgtttgggctttgaaaagcacccactggctccagcatgaagtcgtagtcagagggaacaggaggggagagggagggtcccctgctctgtcagggtcaggcaggggcctcttgtggaacagcctgaagcccaggtgagaggagatagcagcagaggccaggtgcacggaatgaaaggaaggaaacatatctccccttagacatgatcaggacccaaaaatgtttcattcgtggtatatgtttctcactggaaaaaatagagagcatttgctttgatagtttcaaaggagaccagctgagatgaactgaggctggaccatcaggtaaggatagaatctaatattttggccaaaagtgttgtttgggtgacatcccattcatttccatggcaactactgattgtcagaaagggatagtatcttctacaaccagcttggactaaacacgtcagggcggatgactatcaggagttaaccacagttcattacagttagaaagcatctaatcgagatgaaaagataattctggaaggaaggggaaagtcagagatcacgcacatctcataagtgtatcaagtgtaagcagtgttgcaggtgcgcagtgactatctgggccagaggcgtgggggtaagaagaatttaccaagacagttgtaggtaaagaaagggagatttactagagatcataggaaaatacattacaaaggagcaatgggcaggccagcaagagaggagctgactgcaaggagacaaaggcttgctggagatgttataggatggtgcttgtgccaccggtgtgctgaagaaagctttgtgcaatattgataatgccaaggttgcagtgaactaaattgcaattttctgtcagctgggggtctggtgatagctgggcacaggaagattgtgagtcatgtgcacgggagggatatgtgtcctggaccatgaaaaaggcagacttgtagcttatctgcttcttcattttgctttcccccaatcctgctagcctgactcctcctccctaactaggactccacaagccaggctcatcatcatattcttcttaaaacatcattgagaatggattgaatttccctgctgttgctgtactccacacatacctaactcaccggctctccctgcctgcctctccctcacaggctgctttgctgtcccactggccgaggcactcaacaccagtgccttctctcccttgggtcttcacccaagtcccgtggtgactcctacctccacagcacattccacaccctttcctgtccaccatcacatggctgcaccagctcaggccctcccttcctcacagctggaagatgttttagccacctgtctttttctcccaactaccagtataacctagctttaatccagaccccgcacctgcctgaatgatccttctaaaacatctttctatttgtatcacaagattgcatttacattttgatcctcccaaatcatcagcagcttcccccaatgcctcctcagtcaaattcaaatttcttagaccagtatcaccctccacagtggtgacggccctaccttttcacacatgcctatgtttattcagtcattcattcatgcactaattcaacaaatgtttactgatagtgtccaatgtggtagctaacattgagtaaatatcaacaacaggcaagacactgtgcacagaacttttcatatattctgttgtttgatcttcaccaaaaatcagttcttgctatctttatacccagatgagaatactgagacattgaggggctaaataactcggccacacccacagttaataaggattcaaacccagatagtctgactctagaatctgagctcctagtctaaggctaccctacccagaatgagcctgatctcatctgatcttggaagctaagcaggatcaggcctggctagctcttggacaggagagtctcagctcctatatgctgtgctacactgcctccagttcacttggaacaaaacactgagtctcggttatacgtttctggctatggtgtttgttgtaatggaattagtctataaatggagtggattggggaagcgggtagcattcatttacaatgggagacacctagagaatgctcttgggggagagcagctgaaccaaagtcctggaatatgaggagaggagaggccagaacaggcctctggggattcactaagtgcatcactccaaggcccaactgaactcagaccagtaaacatcccatactctgtggcaagtctgcagaagggaggatgcagcccctgtcctcagggaacatacattctaacaacatatgacgtaatgtgcccataacagagatgctttgggagccaaacaatgcaaggggcaaacccacgttcccagaggaactcactgttttggtgacttttcttccataaaattgtcaggaaagggcaggctgtaagatagaccttctgtctggagacaggatacgtcaaggttaggatcacaagccagagtccagctacccaggttcgaatcccagctcgagcacttaaccagctgtgggatgtgacgatgaaacagacaccgagcctggcactcagtcggggctttggggaagtgagccagccatggccactgctgtgccagtgatcatttcacagcagttcttccccacgctgtaccatatgttccttctgaaatcccttgtagattctgagaacagatgagaagctgggatgcggctgataactgagttgttcaggcctgtgtgtctccatcaaattgcaaatggccctataggtcttctgacccctgcccctgctaacccccccgtgtgcattttcacacaatatccaagaaaatttgcagttaggagttagagccaagtgacagggtataagcaaataaccctcccttctctctaatgggtcaatttctctcatgcacatccattcattcattcgttcaacaaaaatacactgagcaatgggtcagtgtggaagaaaatagcaagtggaaaatagagcttacagcagagtgggtttaaaatatttatgttcgtattccagatttgtaacaatgccttacattttatgaattgcgtccccatgtcatgtttatttgatccacaaaactctggacaactaagtgcccgtcccattatacagattaaaaactgagagactcaacccgaagatttccaattctggatggatctagtgatctcactattgcagacgtgctgttcccaggcccagtttgcctggaggtctcaaagactatgaacatgattttgtaagcgtttgttctctctgcagaattctagcacagcaaaatgatttcagtggtccctgaggttagttctttatagtcttttaaccagacatggttcttgttatggacatgggagcagagatgctcggaggatgggtgtggtgacttatttcttcacaatcctgccctgcacactctcaggactaagtgtaatgtagcccagttatagaaacacacagagctgcaaagtcactttttctttgctcagatgcattgtcaccttgttttagtctcaagcaaacatgtagtatgttggggcttgcgtgcaagggaacaaggacctgactgcagtcatgctgaaatgcaggctggcaacagacatgcatgtacatacacacacccagaaacacagacacatacacacccatatacacacaatgcatatacacatgcatacccacacacacacatatacacacatgcacacccatatatgcacatacatatacacatatgcacaccatatacacacatacgtgtatacacacacccacgcacccccatatacatacagatacatgcacatatacacacacaaatatacacatgtgcccacatatacatgcgtgcatacccatacacatgtacatatacacacatgcacacccacatccacacatatacatatatgcacaccatatacacacatacatatacacacacatgcacaccatatacacacatacatatacacacattcacacatctgcacaccatatacaaacatatacacacacgcacagcatatacacatgtatatatacacacatgcacacatatacacatgtgcacaccatatacacacatgcacacccacatgcacacacacacatgcatacccatatacacacatacatatacacacatgcacacccacatccacacagacacacacatgcacaccatatacacacatacatatacacagataccatatacacacatacatatatatacacgtgcatatatacacatgcacactgatatacacatgcatatgcacacatgcacaccatatacacacgtacatatacacacatgcacacatatgcacatgtgcacaccatatacacacatacatatatatacaaatgcatatatacacatgcacaccaatatacacacatgcatatatacacatgcacactgatatacacacatgcatatatacacatgcacacccatgcaccccatatacatacccatgcacatgcacacacacaaatatacgcacgtgcccacatacacacacatacacacctatagacacacatacacccatacacatgtacgctcacccacctttggacccctcctatttatgggcttttctctgagtttggaaatgacttcaccttcttatgatgccatgagtgacactgtaatgaggctctgcggtacccaggaaaagcattccgcccatgtatggattttaggtgatagctttttgttgggaacaggccccccgccaaatctggccataaactggccccaaaactggccataaacaaaatctctgcagcactgtgacatgttcgtgatggccatgacacccacgctggaaggttgtgggtttaccagaatggagcaaggaacacctggcccacccagggcggaaaactgcttaaaggtgttcttaaaccacaaacaatagcatgcatgatctgtgccttaaggacatgctcctgctgcagataagtagcccaacccatccctttatttcaacccatccattcatttcccataaggaatacttttagttaatctacaatctatagaaacaatgcttatcactggcttgctgtcagtaaatacgtgggtaaatctctgttcagggctctcagctctgaaggctgtgagacccctgatttcccactccactcctctgtatttctgtgtgtgtgtctttaattcctctagtgccgctggattagggtctccctgaccgagctggtctcggcagcttttcttttctaaaagagagagaaactcatgtttctgagagaaatgcatgtttctgacagccaggtatggagggaagtgtctggcctagagttgagaggcctggattttagttcctgccctaccgttaaccagctctgtgacctttgatggttatttaggtcttggtttccccatctattcagggaaggggctggctaaaagaaaaaggttggccttagatggcccaaagcttccttctggctagaatattgtgtgattcaagcacttaatcaagatagtttggctcattgcatagggcaaggagtctgggaagaccctacaaatttcccctaaagaaggcattcagaataattttcatttggtatactccctaacagactttgtctggtagcattcctttctaatcacaaggtcaagccatctttgttaccacttaagcatataaaatgcctttccttctagtccactgagagttgggtaacagacgtttgattttacttcccacatggcgtagagttgagggctaccaattttcaagttcaagagttcttattccatcttcctcttacccaccattatatttgattgatagtattaaacagaaggaaaagttgttctactggagtgggaaaatgcattaggttaagtaataagtatataaaatacatggttagaggtttttgaaaaggaaaagatgtaattttgtggttatgcatgtttggggctctttttctgtgttgtgttttgttggtagaaatagaatgtcttggatcagcagaactaggcaaagacggcctggcctagtgggaccatgtcttgttcggcaatgtctttagagacataagggtgaggaaaagaaagaggctatacagtttagcgcccttgaggcaatcagagagaggaacaggaatgcagtgttggaaggtctgcagagggctgtggccacagctggctggctggtaagggccatgcagtgatcaacaggtcagggggccctggggtgcaagcccctcttaggcatgatggctccctgctgggtctctttctggtgtggatattcagacccaaaaaccaagtgtttgtgaacccacaaggcctagttggtgcctgcctcttagcatcagtgcgtgcagaggtgcacccttgggcagggcacaggctcacctggagattgtcttgactggccactgctggccactagcggtgatgtagcctgtgctcctctctctctgcctttgtcactggctaagagggtcaccccccacccccaggggttgaagactgcatctcctccactccccataatcaaatttcccaaccaaccacgtgatgcatggtgtgacaaccatgtcttgctgagttgcgaaattatctgtgtattgacttatgttataaaaactcaatcacatttgtttaaacacttaatgagacatattgaaaaaaattaaatttcacgaaattgtcattgccttggaaaatctagaatttggagttctcataattatggtcagtaatctaagaagttaatcactgtcaggaatgaacaacggacttgttagtcaactgtctgaaggtgatacaaaagtggtgttaaagctggaaatcagttgttaactctactaatgactgagagaagtgagattgtttactttaagcaacagtttatgagagctgaaatccacccccctcctccctcataagcaatacttcaagtgagttgttgaactggaaattaatttgatactagtttgttctaagctcatgctctaacgagcttatatttctgtgtatttaatttgaaagtacatttaataaataatctattaaaaacaaattgagattgagtataaatgagcttgaaatttcagaggtcagtaattaaaattattgtcaccatttggttttcagttttttaaacagtatttagctacttagagcagcatttcacattcctctaaaatgggggaaattctgtaaccatatgtgaccccaaagatctgtgacagtcaaaacccagtgattctggttaccttaagcagccaaaatcctaacagcagctgccaacctttcactctctgcattgtcttccgctttgatgcctgccgtgtgcccagggctaaaatccctaccagggaagcccggcctgggaaggtactaggatccccctgatgccccagagcattatgatccaattatataaccccctcatagtcagagaattatcatgcttcccctacatacccaactaagagttaatctagagtgagaggacactgaagccattcaaaatatatgtcacacaaaagctaaggaggtgacctggcagcgaggtttgccctcccggatggcctggatggaagcctgatgcatcctttcctaagccacgtgcttattgaagatggcagcttctctgggggaggaacagggcactgtgagagctacactcctgcatctgaaccttccagcccagcagaactaaccccacccctggatgccactccccacccccagcgcccactatctttgcacatgctttccctctgtaggtaagtcctctcctgccatggcccctgcatacctagccatttcactcttcagtgttgtatgaaggatccaaaaaggagcacacggcactttcattgtttgcaattgatataatcagcaacatagaaaaaagatacgctacaaactgataaactgataagatggtgtggcaaaagtgcccaatataagaccaacttacaaaatcaaaagcttccctttacattaaaaataaatatatgtaagacaaaataggaaaaaagagatcttatttatgatatcaacaaatctacacaatacctatacataagcttaacaaaaattttccaacagccacgtggaaaaaaaaatctaaaactagactaaaggacataaaaatgaccgtattaaaagaagaggcctgccatgtacatgaataggcaagcggtttattatgaaaatataagttcttcccaaactgacctgtacttcagtgtaatacaaactgagatctcaatgggttattgtgtagcttaaaattggattctgtaattcatctgaagagaaaatagggaatgataacctagaaacctttgagaaaagaatggtaccaaaagaaaatgatttggagaaagtcaccaagacaattcaatagaaaaaagagtaggtgtttcaacaaatggttctggaacaactagctgtccacatgccgaagaatgaagttggacttgtacttcaagctacatacaaaaattaattcaagatggctaaagatgtaaatataatagctaaacccatacaactcttaaaaaaaaaagaaaaagatatgtgtagatctttatgaccttaggttaggtaatggtttcttagacatggtaccagaagtgtaagtagccaaagaaaaaaatagacaagacctcatcaaaattttgagcttcaaaagatacaatcaagaaagtaaaaggggccagttctgatggctcacgcctgtaatcccagcactttgggaggccaaggcaggcagattgcttgaggtcagtagttcaagaccagcctggccaatatggtgaaattccatcactacaaaaaaatacaaaaattagctgggtgtgatggcatgtgcctgtaatcccagttactccagtggctgaggcaggagaatcacttgaacccgggaagcagaggttgcaatgagccgagatcgtgccactgcactccagcctaggtgacagagcgaggctctgtctcaaaaaaaataaataaataaaataaaaattaagaaagtaaaaggacaacccataaaatgggaaaaaaatctgtaaatcatatatctaataagggtctagtgctgaaaatatgtgaagaactcttctaactcaacaataaaaacaccaaaatccaatttacaaataagcaaggatttgagtagacatttcttcaaagaagatataaaaatggacaataaacacatgaaaagatccccaacatcattagtgattaagaaaattaaaaccaaaaccacattgaaataccactttatatccactaggatggctataattgaaaagataaacaataacaagtgttggtgaatatgtggggaaattagagccctcgtgtaatgctcacaggaatgtaaaatggttcagctgcttggcaaaacagtttggcagtactttaaaaagttaaacattgagtttccatataaccagcaaccttacttttagacccacgtgtctactcatagtgcatatccaagagaactggaaacacatccttacaaaaatgtgtacacatgtgttcatagtaacgttactcataatagtcaaaaagtagaaacaactcatgtgctcaacacttggataagcaaaatatgttttcatccacaaggcagaaggtgattcagctgtagaaaaggaatgacattctaatgcatgcctcagtatgaatgaacttgagaacaccatgcttaagtgaaagaagccagtcacaaaaggcacttattgtatgattccatttctataaaataacagaacgggcaaatccatagagatagaaagcaggttaatggttgccagagatggaggagcagggaatggaaagtgactgctaatgaatatgagatttctttctgaggtgacagaaatgttttagaatcaattagtggtgatgagtatataatattgtgaatatacaacaaaacccactgattatatatgcttttaaaaggtgagttttatggcaagtgaatttaatcttaattttaaaggacaacttaactctacctgatatcaaaatagagtatagagcaatagtcattggaacagtgtggaattggcacagaaacagacaaatggatgtctgtctcagtgggctagcacagagagtacaaaagtggcaccacaaacatactgtgggcctttgatatatgccaaggtagcatgtcacatcagtgagaaaaggaaaaatggcagcaaagcacagctggctctcatttttaggggaaagttagcattgaacctcacagtcccacaaaaattaattccagatggattaaagagctaattgtcagactataaagatagaagaaaataaagaagaacatatttgtgaccctgaaaacagccaccttgagctatgcaaaaaatgcatgaagagagcgacaaatgcatttagattgatatacactggaaactctgaacaaaaaataccataagcaaagttaaaagacatttcccatgtaataacaggcagagtattaatatcctgagtatataaagaacttctaaaattaatatgaaaaagctcaacagaataataaatgtccctgcaaccccttaaccctatcaccctcctttcatcgccttttagatgatctgagaattttgtcatctacgttgagaccaagagatcatcttagcccctttcccatggtggtgtctggttttcttcatgactcaattgcatctggtgctttttcttagcaaagtcaaggtgggttttgttgggcagaatgactggacaccaagctctgcgctggacaaagtgcatgactgttgtcgtgtgtgaaggagctgtgtgctaaggagggtgcagtggagacagactaacacctgagctgctcaaaagaggagcttctcagaggaaaccctgagaagatgcatgtacctttctctgcagagacctgcacccagctggcgtccagaggatctgagtgaggagtactgagtatactcagccacttcttgccagtctgccacttaattggggctgcagcataacctttgctcgatgataaaattaaccttgattccggactgatatctgtcttcactaaggaagtgtctgtgctgtggtttctttttgtaagctgtgacattatcaaagaatagaatattgcaggcatgacacacgggaacttttgtcttagacttagaagaccttcctatttttctttcctgccgagatagactttcagctctcaattgggtaattcagtgaggtcccctccttccttcttcacccccacttcctctcatctgctttcccgttttcataagccacagatttaggccttgttttattacatttcacagtgtgcttaaataccccctacagttcttcatctcattacaaaagacaatttacatgagggtaaaatggcgatgtcaatgtgatttgttttgctgctggattttgtaaaacgttctgtatcagggctttcctgtagggtgccagagagacaagagtgaaactagggttcatttaaaaaccgctgttggtaatctgtaagtaaatcagatattcccgacatagaccctggctgggtcatgttgggctttgcattaaatattaagactgtagaacaatattttatgcaatggaaaattctatagttaaaaacaagaggcagttgatttattataagtgggcaaaaatgtgttataactgaaatgggattctctcctcctcccctttagggtcactgttactaccatggacatgtacggggatattctgattcagcagtcagtctcagcacgtgttctggtctcaggtaagtggccatgaccatggcggctctagtcttcagccatctactgcaggcaacctctgtcttttcctgctcgtgctaaagcactgagagtgagtgatgggggctcccagctcagctacacctccacctaggcaagagaacacggaggccctctctaccactgcttacaagagcatggccacccaggatcttagcctcatgttcatgccccctcttacagtgccatcctcaggcctggtggggtaaaagcgactgaactggttgagtttctacatccaagcattttgtgaattattttccatttatgtggctctgatgctttataattcccagtgctaaaagatagaacattacataccaatgttgaagctgctggcttaatgtaaatcttaaagggcctcctctcattaggaaacaaagtaaggaaactaatttagcaacaaccaaggtgagttgaatagaggcatggattggtagggggtttgctactatgctacgggcatgatgcaggaaacaattaccttcccatgctagacaagtcaaccccaggtgttactcacagcccgcttccttccacatcacagttattggccatcaggtggcccttatgtgctccccaggaaaatcattttgtttgataaatttccagctgtttcagcctttttactggatttgcttatcgagtttgtgaactaaatgtttgtatcctcagagtcctgggtaactttggcccaaggcaccaaagcatgattccatgggagggaagagagagaaggccctggaaggatatacctgcttgagttaaaaagcagaatcacattctgcgcatcagcagttcctgtgacgtctttgcaggttctgtgtgggatcatggaggatgagaatatgcatgtgacacacacaacaaccacacacctaccagtttattctttgctgccctcacttctactccagccagcagagaatgagagttctatttgctcacatgttccccattgctcactacatctgatttatctctaagtatttaccagcgttggtcctttcatgtaactaaaaataagtacacaaagctattcctcttcctcgttcatcccgttccagtcccactcagataaaaatgcaagctgggaattcccctcccagctttctcatcccttgtgcatgtaaacacatagtcagagattggggtgtgtatttgtttatttttacaaacatagagtcacatcatatacatcattctacggctttcttttgtcacccaaccctgtctgtctctccaagttagcagacacagacccaaatcattgagtgaacacacacatttgcatgcacacacacatttctgcatacctgcatttttttaaaagcatttttatgtcctatttatgcaacacaattgaactttaagatgtctgctactctgaaaagtgaaggaggtgccttgtggtttgaatttgcttctcttcagttattcattcgttcagaaaacattccttgagtgcttcctcattgccagttctgttctaggttctgggggcacggcactgaacaaaatgcattcttcctggagcacttcctagtggaaggaacagacaatggacatagagtaagatacatgatgtcaaggatcatggagaaagacaaagctgagatggaggacaggaaaggcaacaggtagtcagggaggttcggaaggaggtgaggtgagccctttagatgaggtaggtagcatatcagagagaagagcatgtgcaaagctcctgaagcagaaagatgcctgggatattcccagagcagcgaggtggccagcataactagagtggacagggacagggaggcagtagagagaaatgaggtcagaagggaagtggaaaggtaggatcaccaggggtcacgaaggtgatcagatgtcctttggcctcccccccagtgatgggtgccagggagcttggagctgaagtgatgtggtctgacttcacatttttacaggggcactccagctgccaggctggaaatagactgtagggaatgtgcacagaagcggaggcttgggtaggtgtcttcagagtaactctggtaagaggtggtggggcaggcctggtcaaaggtggcaacttttgtgagagtcgagagacctttccacgggtattagagaggctggcgactctaaattttgttagtgatctgtgtcttaaagtcactttcctgaggaagcgtggggtgtgagcacatgaaaggacctactgaagatgcagcaaaatccactaccaggcagggactccaatacgcgtacacgcccagcatgcagagtgggcgctcaggagaaggtgaagaaggagagtttggaagtgacaatttagagcaaagatgacaactgttcaccaccaaggagctgaggtacatgagggagaaattttaagtaatgaagtatcatcctgagaggctgcaggggaggtgatatcagtggaatcagccaggattcagctaggggaaggaggtaagaggaatattctggaagagatttggatcaggataggatttgaggatggaccatgagccccaagagcacagtggaaagggttagggaaaagggagtggggatagggtcagtagaggattaaagacttgtgggggataaggggccagttttcatggaaaaccagtgcttgaattcctggaggagacagagatgagggggtgaaatgggatcagacctggtggcatctgaggtgaaggtgagtgaccaattcaaaatggatactctgggaccccaggtagatgttctcaccctagaacatgatagtcagggtggtgaattagctgtgtgacgatggacaggtcactgggcctctctgagccccagtttgcatggtgggaagtttgcatgttcaaacaaagtttgagtttgtttctcccctgtgatgggtgccaggggagaaacagtaaacaaatgcagtgacctctaggaaagccaagccctgtgcccacctctagtgagcatcatgagacagtctttgttctttgattctgggactggactagttgtggggggggggtgttcatgcagcactcctgggataattccttgcaaagctttgcagctcctgtagagaccagggcagagatacacaaggccatggtagtaaggaccacacacacttggaaagggaagtccacactttactattgtgcctctctggggcctgaaaggtggacctctttcttcaaaggtcatgtgttgaaggctggatattttcagccttcaatttggcattaaggtcattgtgtgtaaagaagagaaaagctgcccgggggcacggtggctcacgcctgtaatcctagcactttgggaggccgaggcgggtggatcacaaggtcaagagatcgagaccattctggccaacatggtgaaaacccatctctactaaaaatacgaaaattagctgggcgtggtggcatgctcctgtagtcccagctacttgggaggctgaggcagaaaactgcttgaacccgggaggcgggggttgcagtgagccgagattgtaccactgcactccaacctggcgacagagtaagactacaactaaaaaaaaaaaaaaaacacgaattcaaactgacttaaagaaaaacaaaataatgtggagataggcttatgctactgaaaaatctaggcatggctggatacagggtcctagctaatattatcacggtctattttctatctcaagcctctaccttcttctgtgttactttcattctcaggcactatcttagcatgggctgccatagcaaaataccatagactggttggcttaaaccatagaattttatttctcacagttcttgagcctgtaaagtccaagatcaatgagctgacaagattgatttttcctcctgaggccttttctcttggcttccaggcagtcattagcttgctgtgtgctcacgtgacctctctttgtgcgtgtacagagggaggaagctctggtgtcccttataagggcacgaatcccatcatggggcttccctcatgatctcatctgagcctgatcagctcccaaaggccccatctcccgataccatcacatgggggccatggctctaacatatgaatttgcagggtatataaacactcagtccataataggcagttgttgttttgttttgttggcagcatgaggcttccatgctcaaaaagcaagaagaagaataagggcctctctcccaagctcagtggaggtcatctaaacacatcccagtggctctgactaggccactggctcatctgtgaaacaatcagagttgtcagtggggagcttagtagtctgatcaaacaggttatggccctatatcctggaccaggttgagggaaaactgcacccagggtccccgaggcagggagcagggaaggggtgaatgtaccaaagaaatgcaatgagcttttgccaaaaaaaaaaaaaaaaaagaagacagctgagagccagggacactcagaaacaaataggcctcttccagcaacaattatgaagaaattcccaattatcaaaactgagatcagccatcaatggaaacatccaggattggctggataattttcaggttatctttatagggctatcagattcttgatgggcaaagagaaaaggattctctacaaggagttcctaatagctcctatttaccttaataaaacaacttataaactagtgacattaactcattagagtgacaactggggaaggtattcctagagtaatatccaagcaagacaaatcctcccatagggcttggccttgccactcagtcacaaccctccatccctcttcccaggccagccctgtagtcaccgtgtgccaggcacgctgccttagctctttcagcctcccacaaaggtgcagggcaactgtcagggttgccagttccttccgcatggtggtgacgacctcgctggccagactctgcagtgtctgagtctccacatccaccccgcatccccaggagcaggcacagactcataaatttggcagaaaagaatattgtgaaatccttgcagctgggatttcaggaaaagtcagaagagtaagtgctgcattgtctggtgtcagccaccaagagggaatgggaatggtgatgaggaacgctgtgtgggtctaatgaactcctcactgtgggcgcttctgagaattttgacttcccagatctttgtgctgttgttacaaaagcagcagaccgtgcatcaacagagaaattccgcagctgtacagtcaactttatgatctttcaagtcaagaatcagaccagggtgaggggaagctgtatctgatcaactgctcactgacagaagaattgattgagactggaagtaaaaggaaaaaaaaaatgcaactagagtagccccagcctgctagctgttaagaaagaaaatggggattaaaaattgtgttaaatgtggtgtgctccagaaacatattaagatctaggaacctggagggaagctggggtgtcctagaagacacattaattacagcccaacagattccagttttgcagcgaaagaacatcccacattgcttcaaaaacacaggatcacaaatcagcaggaagaaaaaaactctgttctagaacatagaagaaggagggaattaacaagttgtttttcatcatttgaagcttgaagcggaaagcacacggagacagaaacagcacaaagatctcagtagaaagggacatgaaagaggagatggctcttgaatggagggaatgaagtacaacatggaaaatgggtcgtaaaaaggagttcagccatggagtttattcttactttgaaatgactccaagtcgaatgtgaagttgaggccatacgttaattttgtcccgtatcgtatgtctcccatcgatgcgcaactcccagttaatacggtttcggtgaagtgcttgtgattctcctccccctttttacattctggttcccaatttgctctggtggcttggtgctctcattcctgccagccagggagcctggaggcacagccatgagcttcagataatctgcaactctgcagggcacagacatcaaactgtcactgagatgggaagagaatccagctcctggcccagaggaaccgacccactgtactttgtaatgggatagacgtccagccctgtcatgctcctgctggggcatcaaaacagccatgcacccgtcttctgagtttgttcctaaatgccacgttcccactgcttcagctcctggctggagcatgagctcctggagggaaaaggttgtctttccctaatttttctggttctcttgccccgctctctcagctctgactcaggtatctggcaggaggagtctcatgggctcttggcattggaatgagccccaagtcttcatcacctgcaggcacagaggttcgactgaagctgaatttcttcagggcctacctgtgctttaaaagacctgagccaagctcacttgctagatgaggaagtggtatctcgatcagatcgtacactagagactggttgtcatcatagttatttcctttttaaatggggttggtgacacctgagcacgaggtgtcctcacactcacatgcgcaggctcccacttgcacacattcccacacgcgcaccacacactcccatgggcaggtgcccacttgcacacattcccacacgcgcaccacacactcgcacaggcgcccacttgcacacattcccacacgcaccacacactcacatgcgcaggcgtccacttgcacacattccgacacgcgcaccacacacatgggcaggcgcccacttgcacacattcccacacacgcaccacacactcgcacaggcgcccacttgcacacattcccacacacacaccacacactcgcacaggcgcccacttgcacacattcccacatgcacaccacacactcacatgcacaggcccccacttgcacacattcccacacgcgcaccacacactgacatgcacaggcgcccacttgcacacattcccacatgtacaccacacactcacatgcgtacccactctgtggggtgctgatgatagttgcagtaggtcatactttatttttcttcattgttatgattcctgttttcatgagaatggggcagatgttattgtcacctgagcagccaactaaggcatagcatcctcaggggcctggagttcgtttcccaacccccagcattgctgtcatgcagtttgcaccttgaaatcgccaccctctcaaagccctttgccccatccccatatcaccaggtactgacccagctcacttcccttcctcatcccagctgcagaccggggcctctcctgaattggcacctcacctttccttgtcctcatgggaagctcacacaagccacgagcaggtctcatgctccttggtttacaggtaaaaagcagagaccacaaaagtgacttcctcatggcctctcagtgatagtgggcaaaactagatcttaaacccaagcctggctgacccccgttcaattttttttctggtaaacctcttgcataatttggatccaatcttctttttcagtcccaccatccccttcctgaggaaaccaccctattcccgccatgctgtttttttggctgtttccagagcatgctgccacatgcgtggtgctgcccctctgcctgggacacactactccctgccctcccttttgactttggaagatccactcttccctcaaggcccaagtcaaacactgcttcctcctccaagaagcctctcctggtgtccccatctcctcaccatctggctcagccatgtgctgtcatgcatttcctcatacattgtagttctggtagcatagcaggtgctttgtaaatatgtgtttacgtccctgtcttaaggcccctatccttccttgcccatgccttggtaactgccatacctcattctacgaggtgcctgcaacgtataggtctaacacccagaaggtcaggtgcatggaggtggccttgccttcaccttcctgtctgctacactgggagttccaggaaggcagggactgggtgccccaacacggctgtgtcctagaccctggcatgttacaagtactcagtaagtagtgcaggaatagatgtgccctcccaaaggtcaggcagttcataaaccttaattttggccaatccactttttaaaaactatttaaagtgcagtagatcatatgaaggaggaaattggcatggaatggcggtaaagccactttgaccttcacctttgcacttgtggtgctcgctccatcagcacctgtctgactagcccacctggctctcctccaacctctggccaggtgtctctagccaggtttccacactgcttcccttctcccttctgcttcctcccatggagatctttggacatccgggtaaactcctgtgagagccatccctgggggcccacctcagctgtttgcagatattgttggacatgtgcacgagtcagcaagaagctttgacgtgcatgccacagggatccactggccaccagccacggtggttttgccaggtggcatctgctctgaaggagatccaaggtcaagtctctcagctctccccgggccccactgtcactcaaaactcaggatgtctcaatctaaactcctctgggtaggtctccagactggctctccacctgacctcttgtccagaaggtccacaccacctcgagtctataagcctgaccccagggagatttctgtaacctattgtatccacccaggccctgcacgctctcccctatagcgtctccttcatccctctcttctatcaccatccttgttcaacccccctcttagatttgaaaattgcctcccccactgtgcttctgtctccacccctcctttcattgccatgttgcacattctagaaggtcatgttttaaaaacactactagatcatgtcataaatcctgccaacccattgcactccagcccaccttggctctcccatggcttacttgtcaaagcctctagttcagtcttatgcttgttcaatagtcctgcaaatatttagtgatcacttactcacctactggtcacgtgcaaactgcaatgctggttctaaaaaaaacaacgaaaataaggaaactattccctgggtgtgtaaagggagccagatatcaatttaataaaatgttgttagtgacaggaagcaggttgcacaaaaccacacgaggaattccgcagaagggccctagatgctggggatcctgaaggaagggttggctaacctggacctcgaaggtcactcatcagcctcgaaggtcatccccagcattagtgctgtgcgtgaccctgaagaggaggctaaccatccagtctgatgagggcaagtgaccaggcccaggagccaggtcccaactgggacatcttggctctgctgctgattggctgtatggctgtgtctgtttcatagggctaccttcacaaactgccataaactaggtggcttcaaacaacagaaatttagtctctcactgcttttcaggccagaagtctgaaatcaaggggtcagcagggttggtttcttcagcagagtctacggaagaatccctcccacatctccctcctcgctttgggtggcttctggccatccctgctgtgccttgacttgtagatgtcactcccgtttctgcttgcatctttgcttggccttcttccctacgtctgtgtgtctcctcttcggtctcttctaaggacatgtgtcgttagatttatggcccaccctagtccaggacaatctcatcttgagatccttaatctaattacatttgcaaagtcccttttcgcaataaggtcacgttcacaggtccagagattaggacttaaacatatcttttctgggggctgggggggacactattcaaccccctgcagtgacctgggggctctcatctttattttcctcattagtaaaatgggctcatgttatctgctttacaggattgctgtaaatattaaagaaaataatatattcctggccgagcacagtggctcatgcctgtaattccagcactttgggaggccgaggctggcggatcacggggtcaggaaatcgagaccctcctggccaacatggtgaaaccccatctctactaaaaatacaaaagctagctgggtgtggtggcacatgcctgtaatcccagctactcaggaggctgaggcaggagaatcccttgaaccagggagtcagaggttgcagtgagctgagatcacgccactgtactgtagcctggtgacaaagcgagactccgtttcaaaaaaaaaaaaaaagaaaagaaaagaaaaaaaaaaggaagtaatacattcgagagcctggctcatgggggccatgaaggatcaagagtgactgctgataggtccagagttttggggggaatgatgaaaatgtctgcaattagatagtggtgatgtttgcatgactcagtgaataagctagaaaccattggattgcatgctttcaaggagtgaacttaatgctgtgtgaattatttttccataacactgaaatttaaaaaaggagcctgactcagggaatcttttcatacatcatagctgctattattattattgatgtgctggtaatgctggtaataacacttttctttttttttttttttttttttttttgagacggggtctcactcactgtgtcacccaggctgaagtgcagtggtgcgatcttggctcactgcaacctccgcctcccaggttcaagtgattctcctacctcagcctcccgagtagatgggattacaggcacgcactatcacacatgctaatttttgtatttttagtaggaatggggtttcacaatgttgcccaggctggactggaactcctgacctcaagtgatctgccagtctcagcctcccaaaatgccaggattacaggcatgagccaccatgcccggcccttggtaataactattcttaatgtgttttatcacagtttaaactcttacctcctctgtcgtgctcccacaccctggtcatgagatatatttgaaatgggagccacgggcaaggggtctttgcatgtctagcctagtgtctcgcgcatagtaaaaggataaagaatatttgttttgactgtacctgagtagttcacatggaaattactgaagccctgtggtgcgtatgtgttaagtaatactgctgccacgactgtttatcaaacatgtatggggtgagatattacttttacccacgagttgctccaaaaaaaaaaaaagccgaaattaaatttcaagccaactgcttttccaccacatgattgacagcaccacactgagaccaaaagtctttttctaggaaattcagttagcagttggacactgagctagccaggataattcatgttttctaatcatcatcttattacaggcagtcaaaatccatgtgccactgtcctgcttgccgggtgcagtcaaaaaaatcaggatcagacattaagcggccccggtgcctgctgcatcgtggctttggagattaaaaactaattttcagaaggacaaaaacttatcttgaggaaatataggtctcttgagtgtccactttgaaagctaaaataatcaactaataaaattttaatagattcctctttgtttcctgtcaaggaaaaacaacaggattttacatgttaaaggaaggccgctggttttcaaagcagcggctccattttctctttctaattctaattctagtccttttcatttttaattctgcttttttcatgctcctgctggttctgggcccctctctcaaaactgcacaaagggaagcaggcgagtgtggggttgagaggcccaagcccggggcacacaggtcccgactgggtccccagctctgccacctgcgcaccttggacagtggggtcatggcgggagctgcagccatggtcagcagagtgatcagtgtacggagcgcagcccagaacctggatcctagaagagtgccacaggggggtgaccctgaccaccctgagaacccccttctctctgccccagaacttggcctgagcctggggtgatggctgggccggcctcctcctgtcgctctagagaagggacccacggtcttcatctttcccaaacattggagactttcttctcatcttttccccctactctacctagggagaaagaaccccacacgcaaagtccactggatttaaattccatgctctgagagtcttccaacttcaggtttacaactaaatatctgtgacattcaacttaaaacaaattacattcacttatctaactcagggccagtaagggctgtgagaacatcaaaatgtatctcagaaaccctgaatgcttcaattttgtgtccactgttgtttccagcaattctttagagctaaatgattaattatacccaagacagtccaaagcaattatttaattaagcttattataggctgccaattgtttgcagtaaagggaaggccttcatcctgatttctcaacatctggcctttggatgacttaaaagataaaagaagataagagaatatttttacgactaagtaacaattgctagaaatattccactatgtagaaaaactttttcagtaatttgcttctcatgattagaatgtggtgacatgttttacagttaagtgttcagcttatttagatccgatgtaaaatagaaaatgttgcagtacaaaatgaaatgttactgccattttctttttagggcagaattgatggtattcatttccactttccccttgcctgtttttgttttttttgtttttgagagggactctcgttctgtcacccaggctggagtacagtggcacatctcggctcactgcaacctctgcctcctgggttcaagcgattctcccacatcagcctcccaagtagctgggactacaggtgcgtgccaccacacccagctactttttgtatttttaatagagatggagtttcgccatgttgtccggctggtcttgaactcctgaccacaggtgatccacccacctcggcctcccaaagtgctggaattacaggcgtgagccaccgcacccggcctccctttgcctatttttttaagttcgcatccttaataaaatcaactttaataaacaaaaatcctctcctacctattccaaagttagaagtctacattttatttcataaagaacatctcagagaaggagacacaagccaccccacagagttgatgaccaaagtaatccctgaatgatctgtttggtgatatacatggacaccagtgtgggggaaggcaacacttcatagaatgacttttagtcaatctggactttggatgacttagaaggagacatgagaacattttcatgactaagtaacaatttctacagatttgggatttgaaaatattgaaaaatgttttagttgctccaaaccacattggaccccttcttctctgaaggattaagtgttacggttcttcaaatgcacatcttagctctcacaggatttctaattgtcccggatatctcgatgctgccttgtctattaggataccagtatcctgagcatgatagatctgtttctcccattgcccatgacaactcataaaacaggattggtggagtaagccagttaaatactaatgagttgattagtctgtatttgcttaccagttgtgttcaaaatagatacttgactaactcaagcctcttccttccgtatcatttgagcgttgagatactgtcaatctattaaaatttaagagttgttaaatactacctacgaatgggccatcaatgagcataggatgatgaatgactgaacaaatatgtaagcagtaatgaatgacataggaacaccttacacagtcccttctttggaaagaagcttagattgaggaaaactgatggagtttgcaacttgaccagctattcctcgaggattgatgtatacctagatccttgggttgctgcaatataaattatatattagaactaattattatataagattatatattattatataattatataatatataattatctattatatattgttacatattatataatttctgatatataacatattgcatattatataatatgcaatatattatatattgcatattatataatatgcaatatattatatattgcatataatatataattgcatatgtaatatataatatatgttacatgtaagataatatatattatgtattgcatatataatatatattacatgtataatataatatagtatattatatattatataatatatagtatgtatatactatatagtatatatactatagtatataatatatatagtatatagtatatatatagtatatagtgtatatagtatatatagtatatatagtatatatagtatatatagtatatagtatatatactatatatatactatatataatatagtatattatacatctaatatataatatatttaattatattgcatataatatattatattgcatatataatatataatatatattatattgcatatgtaatatataatatatgctatattgcatatgtaatatataatatatattatattacatatgtaatatataatatataattatattgcatatatattatataatatatattattatatattgtgtattattatatattagaactaatgccctaaacctcattccatttacatagaccttatcctcactcctgaatttgctaaaataatctgcaaaattttgtggttatgtatgttggggctcagaaaatgataccccaaaatatggatctttgacatgctgaactgaaggaaaaccctcaaggtctctctggcccctggcacccaccttcaccccatctgactctccaaaagcacaggatgaagttgttctctgacgttcccttatctgcctaaactatagaccctccaaaaaagaaataaattaccttggtccctctctgagttttcattaactaatgtcacaggaagaaagactgaagcctgtcaacacatccagacagacttttgtcataaaccgttgtctgttctgcaggcccaacagactttgtcccaggccattgtatgttcttccagcccaatgaattcccctaaaaatcatttactcaccccctaaaattatccatacttccctatctccctttctcctaagaagaagggtgtataaccatctgtgcccccattgagtaatcattcttctacaattcacctgtgctatgactgttaaaataaaattgtatgccttttctcccataatatttctgccttttgtcagttgatttgtagtgaactttcagagggcaaaggaggacattttcccttagcccctacaggtatgtatgtgaattatcctaggaagagtctgaggaggttcatgtctcacaaaaggttagtagtcactgtattagaagggtccatttccagtcagatgaattttacatgaaaattttgtgtctttctaaagtggagagatagtggtcacctcgctaaataacataaggtactagacacatgggaattcagagatgccagtttgctgttacccaaattgtcatttctccaaagaaaacctttctctcaacatcaggaagcaccttttaaattaaagcacttcactgccccaccttagcaaagagagaaatgaaaaccaagctgcaggccgaggttcccatcgtttgaaggaacccgacagcccaaggctagcattactcatttccaggcagtgggatgtggccttagctgtgagctccagaaggtcagacatgtgtcatggtccatggctaaatgtcaccttctatctctgcaagttagagtcttcagcaaatttgtccatttttaaaaagaatctatgctttctttcccaaacctaaagactggctcaaaaggttctttcttagttattgtcattcccagaaatgtatttatatttttaatgctatattttatatcacagagccatgagtgaccagtattcctatgagcagatgggttaacaaaatacagaactttcctgaagttgtcagtctttcagttaacctgttaacagatgcctaatccatgaatctgcccttattaatagtaaagaaagctaccatctctcaagcactgacctggggcctcccctgggctaagcgttttgactcgatgacatagcaaccctgagaagtaggtaccattatccccattttacaggtgaagaaaccagggctcaaagttaaggtcacataactagtaagtaaaaaactggaactcaaacccagagcttccagactccagaggccacccttgcagcgttgagactggcacttctccctgtagtgttcttgattccagaaagagctgaacacaggatccagaggccggacctcagcctccaagaagcagtgctaatgttctgtgtacttaagtgggttcctttattcacacatctcccacaaattaaataagtaaataaaaaaatataaatttgtactcatggtgcttataattccatcaaatatttagggaatagggctgatcaggataaataattagatgtaggaattgtccttttataaaaagatttcctaatggcttttggagcaacttggatggaactagggccattattgtaaatgaaataactcaggaattgaaaaacaaacatggcattttctgacttctaagtgggaagtaagctatgggtacacaaaggcatccagagtaatataatggacattggagactcagaagggggaggccaagaggcgggagagggatgaaagaatacctgtggggtacaacgtacactactcagatgacaggtgcactaaaatcctagacttcaccattacacaatttatccacgtaaccaaaggctactgtacccctgaggctattgaaatattttaaaagtaaacatttgccttttgaaatgtgtctgctaattcagatacagttatcttctaagcagttaaaacatctttttcctcattcttcttcccggcaatatatctttgagacataaaaagagataaaaacatacaaaagcaaaatgcactgtattctttaccataaaatatttcaaacagaagaaaattcctaggctaactttccaaaagatttgccaaatgaatcaatgcaaacatatgtcacagaaacgtcctttccaatcaaaatctgagaatataagtaaattggtgtttctgttttcattctctctcttgttaagaactgtgtcttggccataaacaagaagctgtccttaaaattatatattttttcttgtttctttttcaacaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaagggtaagggggatacctgattttgtgtttctggaaagctaggagctcaagctacggataccccacactaggacatctggagaaatgttgccatctagatgatgcggcatctgggggatggaagtgcccagtttatctggaggtggtcacaaccataagccaaatccccatcactgtactgcagatgtcagtctcagactcattaaaatatgctgaggaaagtcacacagttgggatcaaaggatgacaaaattaccccccccccccaacttctacccccacaagctcaagattcatggaatctcccaagagaccctactatggtcctaggcccagggttgggcgccaccatgacaagcaagacaagattggaccctgacccactctctagcagctctccatctactggaggtgaaagactacatagagccttccttattagcaagtttgggttcttataatttgcagagaattctcactctttgcctacacacttatgcagaggtgaactgggccttcctccacgtgatgtggctcaggaatcttgcttatccacagtccaagctgcaaatgcttgtcctagttccctcctgggaccgtccaagcagtctgtgttttctggccaccagcccctggatctgctgataaaatgtcttcctttttgcaggagcactggaaagagtagttgcctaagggagtctgtgctgcagacagacttcccttcctgacacgtgtagtgtcacaccatgaaacctccacccctaagggtggcctgccccttttctctctggcattatgtgggcaacagaggctacagtagagctcttttaataaggattaaaggcaatcgttcccaacatttggctggaggccctgaatttaaatgagcagaaacagataggaaattatcaacaatttcctgattttccatttctggatttcctgttcctctgttgataagaaatcaagaaaatttatagataggatgtcgcttgtgcttatatttgactgtccgagaacatttcttctaggtttctcctaacccgttgttgtctcctaacttgaatttcagtagaccactgcttagcactcaatatttaatgaatattattcttggttcattctaaatcatttttctagttggaaacagtaggggttatcccaaatgataccttctaattcttagaattcccctcatacctgtggatagatgtctgttcccctaaaactgctcttatcggaaccagttcaggacttttaactctaattttacattcattctttcagtccaggtattctacttgtgtaaccctcacgtcttctgtttgctagtatgtttctaagagtttctatggcaggtgctcacaacctctttttcgtttcctgccccatcacaggaaggggaggaactctcccatctggtactgtggctcaccttgacatggctgcttggtggcagaacactgtatcctaatcccaaggaacagagcttgaaaattacccccccaacctctacccctacaagctcaagagacttttcaacttgtgcttctccccgctacctgtcttagtggtggatttaaagatcagcctctggggtcccacggcaggtttattttactcttcaaatgcttttgcctttgattccaaaccttggagaagatgtgattaagctgtagctttaccggtcataaacaagtagaacatttgcattttgttttccaggctctttgctttgagtaccttgttgaatgcacgttgcccacgttacaagatttataatttgatggcttaaatgacactcaaatatgtttgtcgtttcatatagaagtacacacttggtctgtacttgccagccatattttaattcttttagcttacagctttctagaagcatgattgtaatttccagtcattttgacttgtggagaaatggggagaatgggaataacaacggtgctttgttaataatgcatattgaagtgcaaatgaacctttaaattgaaaagggaaggcatcaatgccggtcaactcagttctcaatatttctctctagaaagcaccgtgatggtttttatggaagagaaagcatcctggacttaaaatgcatgtatataatgaaaatggtgcgaaaaataatttcaaatatgtggaatccttgtgaattggaattatatagtagattgttttggttagcacctacggtaaatatgaaagggacatttcctgccccacttatgctgcctttatttcactcttaaaaaaaaatcaatagaaaggctgctaactaatcttgtttatgcaatgcagcaactgcatttgctttttccctgcatttttctgcccccactaaatgttaactattgcaaagactggtttgcagactctgatttttctgcagatgtttgcgtttttcttcacagagcatcaggaataaatctgcactcagggtatacactggctgtgatataaacctgagctattgtttgtcatttttacaaggctccacattagattttagtgagaacccaggctgcccctcgaagggcacagagaaacagggagcgtcacagtcagctcgttctctctgtggatttttgagtctccatcctgaagcctccttactgttcagctcccccacagcagactccttccctctccatcggctactcattcaagaatgcaaactaattttaacatcatcctaagcaagctctgagcaaggcaaagatggtaaatctactggagaaaatcacataagacatcccaaaggcaaatgcaaattatttttgaattgccttttctttagggattatctgtgccattgttcccctccgttagtatggataattatgagtcaaacagaaaagttgctgccttctctgaaaagaaatgtttgcttgggtactgtgtacatataggacagcgagttggggaggtgctgttttgcttcctcgaaggtggccattctgaaatgaactggtgctattgcttttgtgtttctagacagcctatcgtatttgtttaatagaaggcacagtagtggtggggtatttgtagccatagcagtatatagcacattatatgtagagcctaatgagagttgaatatcaggaactggccagaactgtttgaaaactccttaaatatgacaggcatactgaattcctctctaacaaccatccttgcttccatgcctcttctaagagactatcatgttcttttactaccttagttgttcttaaagcttggtggtgggggctcacgcctgtagtcccagcactttgggaggctgaagcaggcagatcacctgaggtcaggagttcaagaccaacctggccaacgtggtgaaaccccatctctacgaaaaatacaaaaattagcagggcgtagtggcaggcacctgtaatcccagctacctgggaggctgaggcaggagaatcacttgaaaccaggaggcagaggttgtagtgagctgagatcatgccattgcactctagcctgggcgacaagagtgaaactcgtctcaaaacaaaaaacaaaacaaaagaaccgcttggtggggaacggggcagcaccacttccttggccctgggctttgaatatctatttatgtgagtggaggctccagttttccaggtgtggattcctagtgagtttcaaatccactgaagctctggataaataaataatagatctcacttgtgccattcgtttttaaggcttaatttcaatacttcacatttctccctattaacattcagtttgccggattcagcctgttctcctggcagaatgtctcatttgtttacttctgcccgcctacatgtcggccaggtgtcagacgctgtatcctgtgtggatatgatcagtgtgtgctgtccccatgccagtcacggtcaaggatggtagagacaacctttcctaaccgaaactggagctcaacttacaaatacgcagaaagtgatgttagagtcaaggcatggagcgttgcttgcttgagctaatactgattgttttcttgcctagaggaagagaaaccaaacttttgattcatttcatttgctgatattgctggcgatggacactttggctgtggtctcattgtgattgttgttttctcgctgtcaggtgatagcacagctggcttgcatgtggctacccatgtccatcatgactgtcacctctcacctggacgactgcatggcctccttgctgcactctcagcttccagtatcatccaatatcatccccctagaatccgttctccttccagtagccagagcaatatattatatatatatatatatatatatatatatatatatatatatatattttttttttttttttttttttttttttttgagacggagtctcactgtgttgcccaggctggagtcagtggtgccatctcggctcactgcaacctccacctcccaggttcaagtaattcttgtgcctcagcctcccgagtagctgggactacaggcgtgtaccaccacacctggctaatttatctgtttttagcagagacagggttttaccatgttgatcaggctggtcttgaactcctgaccgcgagggattcgcccacctcagcctcccaaagtgctgggattacaggcgtaagccaccacgcccagttgcaatatttttaaaatctcacattcaaggcccccatgctcttagattattaggctatcactcaacctccttgccatggccccagtgtcctgtccccatcttccacctcctctcgtccactcttgtccgccattcgccagactccagccatacggcctgttgccaacacccacaagctctccccagcctcaggacatctgctgttgccattccatctacctgaaacactgttcccacaatctttccacacatgcctctttctcatccttcaggcctcagctacctttggcctgcccactgcccagcttcatcctacctgcagaaccctgtttatttcctttgttgtacttttcacagactctctctttctttcgttaattctgcatgggctcaccttctcccaggccccaccagaatatgagtttcaggaggacactggatttcccgaatatgggtttcctgaatatgagtttcaggaagacactgggtttcaggaatatgggtttcaggaggacactgggtttcaggaatatgagtttcaggaggacactgggtttcaggaatatgagtttcctgtccacactgtatccccagcaccctacacagggcctagtgcaaacagcatccctggtagatagcatgggatgaataaatgttatacaaatggtctgacccatatgaagaaagaattgcaatgaggatttattatagccccaatgtcaacttgcttttctaacttgagttaagttcccattgccagagtcctcattgcaggctgatcgggggttatttatcctggggaacttggctgtgatgactttgagaggcccaggaactggttctttcttgagcaagattcaaagaaggcctctgcctccacctgggaacggagacttttgggctaatcccagaggctgatgttcccgtttgaggaagggcttttgttcataaccccccaaaatgaaaatccagtagagcaaccagtttctttttttaaattttttaaaattattattttaatttcttctttaaaaaaaaaaaaacaggatacatgtgcaaaacgtgcaggtttgttacataggtatacgtgtgccatggtggtttgctgcacctactgacccatcctctaaattccctcctctcatcccccacccctcaacaggccctggtgtgtgttgttcccctccctgtgtccatgtgttcttattgttcaactcccacttggttctctgttcctatattagtttgctgagtatgatggcctccagcttcatccatgtccctgcaaaggacacgatctcattcctttttatggcagcatagtattccgtggtgtatgtatataccacattttctttatccggtctatcagtgatgggcatttggattggttccatgtcttcagcaaccagtttcaaatgttgctctccatatcacaaatttaaaaacatgattctttgttgttgtttttttaactggacagccagataggtggaaatcacgtggggataatgtaaacctctctctgtgtgtgcagctaacaggagaataaacctccgccctgagccggcgactcccccagtgcttctctttattatgtggttaagcttccctctgagcttgcagttctctgaattcatgagaaaatgtagacttctctgaaaattgcagagacaggaaaattgtgttcacatgtttgtttttattatctggaattgtgtattttctaaatggggatcttaagccagttggaaatatcccatggtcgtttatttcacccctctgcaggctgaaaagtgtaaacgtctaaacaaccagattcctttccatgagcttttcaatgagagattagtttttcatttctagagctatattttcttctgcataattagccaaatttttttaatgattaattagggaattatggacaacagagagggttctgcctctttcacgcctcaatgaggaaaaagggcaagatcttcacactttcagaaggtgtctcattttgtgtgcacccgtgggcaccatgggggcaaatgtcttttcttttataagtaacgcatagttatcaccataaagcatgcctacaacatatagttacaaagcgtaacagtttcttcttgtaacattgtaaagatatgagaaattgtacctttcctggtgctttatttttccttttccataaggtttccagatatctttaggaacacctaaattcatgaattagcacagctgggcagcaagaaggaacactgctataatacaaacatttttcttgtaaaagtctgtttggaagatcccggactgatggggatttgttttataaaagatgtttccctcaggattatgtgactggaaacctgattcaaagcatacttttgtgattttcttttgcttttgtctgaaagagtggttataacatgcaagttttaaacttgaagcagtgtgtgtagttaactcataaaccagcaatatcagtcatcaggaccaaagaccaacttaacccccacttcctccaactgcattttatggcagaaacagaaggctttgttttttgtttttaatgtttgctttttgagaccaccctccacgaactgctttatttctcttaaaaatgcatttggaattcttccagtaattcacagaagagtgtgaatgctttttgaggaagtttgattaaaatgtgatccacttcaggagctgcctttgtgggggacggggttcctatttctgctgcctgaatcatctccattcatccacttccatatccactttccatgttctctcaactgtctcactcttacgaaatccctgttctccaggggcatattgcagtcttagttttttcttaactctgtttctttccgttctctttctctttgctcttttttttttctcctcatacctttctcacttctctgttcattagtctgacagtttccttttctccagaccaccccggtcttccattgcttctaactagatttttacatgatcatttaaaaaatgattatacagttcctgttcaaaatgtattctcctccacttttcttaagtctcaaaacaggtacacttggaccataaagacaaagggaacagccacagtgcattgaactccgtcgtcttctctgatgaccttcaaatgtggtcatcagagaagacctacacgtggtctgaaataaatgacttttgactggctcctgttctagagagtgctttggttttgtttgtttatgtgctcgttttgtttaataatcttgatttgctgctccaataatccatgattcagcagaaagcttaaactcctttttaagggttttccaagtggaaatggaagctggttactcatgttgagaaggttttacaaagagttggttggagttggggtaaacttctagatggaatggaggtgtgggggcctggcggggatgggggatatacattctcaacctaaagtgtttagattgagagacattgacagtcttaatgccagagaggcattaagagagattaagtgcatgtttactcttggcagcataaaagagagaccctcaaggcaactaagtatgtggagctggtgatcgtggcagacaaccgagaggtaagaactttttaaaatttctcagtatggttggttagagataaaagaaaaaaggacatgttttgcaagttattacttgctttaatgaacctcatttcctatgtgctcttaaaagcaatggaaacaacccattgaaacaatggttttctgattttataaagcatacaatattaaaaatttatttgatatataaagtaatggcaaagcctgcaggaaaaaacagagttgctctatagctcagctctccaaacaaggagaattaactgagaggaatgacagaaggctttagattatattctaaaacattttggggaaaagtttagtctttaaaatgggacatttaaaaaatatcccatatgtcattaatcaaaatgaataaatgaaggtatgaatgaaggctatagagacacagcagaaaaatcctcccctctgagctatagcttgatactacattcattttttattttaattaattttgaattagtttttctaaagattatcttctctgtatttactgcctcattggcatatatgaattgggtgattgggtgatattttctcatagactctttcaacacctatgaatgaaacaggcttgactatttttcagaaaatgattcccattctggaaggtcagattagagaggggaatgggaaatttgttgatttttttgtctattctcctctgtattgtttgacaagctgccatgagcttctatgacttttactttttaatttttaaaaacaaatataaagaaaatttctcaggaagttaaaatcaagttgatgatatgaaaaatggctttggactgacttctagttgtctgtttcctctttgccaaaacaagtcactgcctccatcatttatgaggctggaaaattgcagaagttgctgtcttgagagcacttggcttaggcaaatttcagggaatttcagggagtccccagccgggaaagttagtcggcaggatgcaagctcattttaccgtgaactgtggagggtccccagtggtttgtaaaatcccaagacttcacatttccagaagccaggaagatgaaacgtgattgatattcttgctggtattaatgctgccatttaaaattgttaagtttcagaggcaaggaaaagatctggaaaaagttaagcagcgattaatagagattgctaatcacgttgacaaggtaagttctttttcagtagttaaatcattcagatcatgtaaatgtttggaaatgaggttgggggacctcatctgacttagcaaggagatgaggttctgcctctgggccttggtttggaactgtttcctgtcctctgagtgtgtaattcctgggtcctggggcagcttcaggagatgccaaaccacagcagtctggactatggtggccttggtgacatgtcttcctccaggctctcttccggtcaggtggaataccagtctgagggtgttttggacttcccgattagctccagaacccctacagagttcacctgatcctttggattcctcctgagccgggcctctcccaggtctcccgatgacggatcccacaggccccttcaatctgtccccatcattgcaggcctgtaccaatgtaaccctgagggtgggcttgcatttataagggatccataggcttcactgtcctggaacacagaagttgactttcagctaaatcagctattggaaaatccctcgccaagaacaagtaggtcagaaactcacctttcacaaagatgatttccttgctggaggagcccctgcaaaccaggtcctactcctggggtacttgttcactaaccgctcctcacactgcgggccggcaaagaaaatggcagcgctctctgtctaaaccacctgtccttcctcagtgtatcctgctggagaggatgttggctatttgctgctgacgacccttagcctaaaataggcttctcacaagccccgcatattggagttgccctgtgagcttctgaaagcattgctgccctcaaggggcagggcgggggggaggttagacctcgaattttcagaagctccccagcaattctcatgtgcaatgtggatggtgaccgctgtcctaaagcaaccatagtctctcagcaatactgagtctcttgcctgtggggacagtgtgagaagggatctggtcatggctgagcctttcacatccatggtcctctgaaacagcagattttacacatagtggtttgtgagggtgcctcactctagccttgtttccaagcaatcttattcgatttgaattgcattctctaagttttcagaaaaatgaaggcaaaggtcctttcagaaattcggctccatattacaagaccttatgcactctgcatcaataattcagaatgaatcagatgtggtccctccacttgagaacgtcaaggctgtgtagggaagcagacatgcaacccacacagcatggtccaaggcattaagaactagatccatgctatgaatggaggtttatggggatgcagaagagaatcacttacttcttcccagggccagggagtctttgcagggagaggatcctcaaaggtaagttcagtttcaccgtgagcatagcagaagaaggagtatgtgtgatgtggacatgtatgtgcttcatgtacatgtacatgcatgtgtgttcctatatgtgttcatgtgtgtgttcatacgtgtgtgtgccctgcatgcatgtatgtgtgtttgtgtacatgcatgctcatattgtatgcaaatgtatgcatgcagagctagggcaggaggagatgaagctgcaaagattcacggtgctcaaggccccggctgttctacgaagccatcttgatgttattctgcagtgaatagagagctaggtgaatgtttttaagcaggggagagacacacatgatagtagaaaaatattcctgcagttagtgtggagggtgggataaccaaagacaaatagggctgagaggagcctattgcatagaaatgataaaggcctgagcgggcgcggtggcttacgcctgtaatcccagcactttgggaggccgaggcgggcggatcacgaggtcaagagatcgagaccatcctggccaacatggtgaaaccccgtctctactaaaaatacaaaaactagctgggcgtggtggcatgcgcctgtagtcccagctactcgggaggctgaggcaggagaattgcttgaacccgggaagcagaggttgcagtgagccgagatcacgccatcgcactctagcctggtgacagagcgagactccatctcaaaaaaaaaaaaaaaaaagaagaagaagaaaaagaagggataaaggcctgacctgacccagggcaggggaagtggggaagtgagaaggacaaggattgagagaggctcgaagggatgtgtttcctgattattatttttaccagttactgtgtgccgggctctaagtgctttgcacacactctcaggtacacactattgttcttatttttaaagcagaggaggctgagatgggcagaggttattcatttgcaggacgagggatgagtgctagtcttgccaactcccagcagcaggggctcttggctttgactctactccccctactgtgagtcccgggacctcatgatgaccaagcagaggctgagggcgagtgggagaccacatgaccgccagtttcgttggagtggaggggcaggtagacgatgcttcataccccaggaaagggggagcaggaagaggagtttgaagggcactctgaacagtcagagatctgggtttgccactcagagagaggctatggctacatggaactttctggaagtcagaaaaacccacatggccgttgatatcctgggatgatattgcccttgtccacctttgaagcaggtcaaacttcctggcaacccctgcctgttgatgtgttttcagtagttactctttgcagattcaactttatcccatagtccaggtgcaggagaatcctggtgaaaggcaaatcctggcaggggggatgaagggtgggtcttagaggagacatcaaagatagcacggcagttagaactggacctcggtctagactggacattagaacccctggaggggagtttgtttgtctatttgtttatatgtttactttaggaaatattgattcccacaccttggcccagggattctgatttgattgacctggcacagggcctaggcacagatattctccagggtcctccagttatcctaacatgaagtgggactgagacgcactggcctagagggcggaaggcttaggtgcctgagctgggagcgcaggtgccactccaaggtgagcgagttggaccattgccccaacggcctcaggctatcctcagactgtccaacgagaagaaaacacgagttcttcttagacctcgggagcaaaaggaaatgataaactatattaaacccaaactggaaattgctgaagccccattttaaaaaagggatgtgtttgggtcctctgtgtttgtatttcttcacatttattctaggttatatcttgcttcagtttgcaaaaccaaaaatgagcaattaggggtttgttaataacttgcactggtaattaaaaaacactgtgcctcggaaaagtcctaacggactccgtggagtttgccggcctggctgtccttgtgtttctggcagggagagagccgatttgctgagcacacagctacccctggccctgacatccctgtccatccccagcagacgccaaagaccttggaggagatacccaggccccctgggagacttggtgcttccaagtctatgaacagatgactcccagctctgttacacaattctaaatttcagtttttcaactctacaaatgaaagtgtctcagtccagaaaacaacgactgtgccagtggcaacttcctcatttgctgaagtcttggctctcctggaccattctaacttaataactgcttgctgcgtggagaaagaggacatcctagactggaaaacagacgagtggtttagtgatgaaggtgacattctggaatgttcaggaaatccccccatgagcaaaacacagaaggcatgtctgacactcatgcttctaggccagacgctgagaattttccccgggtcctcattacattcccacaggagcccggggagtgcacctgcccatggagctatcgtggagtttgcatcttccacccttcacctccagactgtcctccttattcattaggaagttagtgtcagctgcaaattcagggacctgcttctgaaaggactcatcgtctatgtatttaatttcttttctttctttctttctttttttttttttttttagacagagtcttgctctatccccaaggctggagtgcaatggcgccatcttggctcactgcagcctccacctcccaggttcaagcgattctcctgcctcagcttcccgagtagctaggattacaggcacccaccatcaggcctgactaatttttgtatttttagtagagatggagtttcaccatgttggacaggctggcctcaaactcctaacctcaagtgatctgcctgcctcagcctcccaaagtgccgggattacaggcatgagccaccatgtccagcctctgtgtattgaatttcttaggatattttcactcatgtgacagttttcttctcctcctgtcccaaaccagttgcctgaaggatgcagtttccttcattagaccccaggggattccgcctcactgtttcttcccaaaagtctccagtgcagcgtccctggacttcctatgtgcaccactgcttggcagttcactgtattggagttaactgaactgacagttcagtgtgccatgccttaagcccctggtgacctctgagcatttgggtggcaggagcgagggcatccaaatctttgctctctctgccactgccggcccagcccacagcaagaggcaagaaaatatttgttgctgttgtgtaaacaggtgaatcgcttcagctggatctctgactgtgtccacatatgttctgggctttgtaagtcaggcaggcagctgccaagctccatttgtacagcagaggcccgtgagcttctctccgggcctggggtcacagtgggccgtcttggaagggagtcttagtgctcacagaagatggcagtgttacctagtgggttcaaacatgagcgtcagggttagctggcctgtgttccaaccccagccatggagttgcaatcttaagtcacctgacttctccaagcctccgtgtctttgactataaaatagaaataataataattcttaacacatggagttgttttcaggattaagccacagcacagaaaccaccgtggcatcatgcctgtgatgcagtaatgctcactaaacattagctgtggtggtggttattaggaagaatcaaaaggaacccgtcagcagccctggaaagaacttttagagcaggcagcaaaggcatcatgtatgatgacttgatgtgagtttagcataaatgacagtcaaacaatggcactaattttggagaggggaggttgtctgttatattactactaagtatgaaatctgttctaaggatgtggtttgagaagcctagtaggtggagatgcaaaacccatcattatcatgaaaagctccttgatgaggaagcagcaaacctagcactaaggaatgatgacaattagtcctttgctgaccttcattactggctccatgcaacactcctgggaggcaaacctagtgtctccttcccagatgccaaccctgagcccacgcaaggtgtctgaccccaaggacatctcttagcaagctggtgtgagcatcagcattggatcgcctccgtttctgctttctgatcactgttacctttgtatataatagagctgaaaatgtaatctctcagtggacagcagccaaacatgtgcattcagagttccagagccggccaggaacttactttcgccccggaagcctgggctgggagtttgcaagtagatagcgtgggccatgcaattcttgattgaaaacaaactgttgggctgtgttgtagtcatgtaatcgtctcgttaactcattaatgtaatgtctgtaattgtgatctgtttgaaaccaagttggaccaatgcaatcagcatatattctgtgatgcactttgtatcccggtcatattctcctgctaacccaatgctcaccagatgactgtggggaccagcaagggaaaagatgagctcaccttatgtgggttagaatctagggtcagatgttcaactttgagcagtttcttctactttagttcaccatgttggaatggtgcctaactagcaaatgcagaacttctataagttttgttattggccagatgcttccagcaactgagaataggacctgctttcatctggtgcttggctttggctgctatcactagccacccttttctccgtggctacctgggatctcagaagatgagggctttctccctgtgtgctgcctcatacactaggggcattgaaagatttgacagcccaccaggtgacaccatgtcctagccccctcaaccatgagtacaaagccatctgcttgtctatgtgatgcctatgaggacaatgggtaggtcatacctctaccctgaccgctcatcctggccctctgaactcctatgagacaaagccatcccttagtccctggaggagttgcttttccctgccctgacccagaacgacctgcctgtaggtgtagtcaggtatgggccataggctgaagtcaggaacacccaaagatggtgggggcaggcaggggagtgagaagtcttgctttcagtggtgtgccggatgctttgtttcacaggcgcataaaagaggaacttcatttaacagacctttccatgacactgttggtgagctaacttctggctgtggggaggatagtcattaatgttcctgaagaagggctctgtttatgcctttgttattctgaaagatattgacttctttattttattaaaacctgcgttgattataggtgacagaatatgatagtgttagccagagctgagactttgctgaaaaattaatacagattcattttcagtaactaataagcagaacattttgctcaaaatgaacaagttattgtccttggcagaagtgtctgaaagatcctaattcacttattgtttcacttgcagtggatattaactggccatctttagctataatacacatctgtatgtacattttaaatcaccagtgagtcatttgaaatgtatgcttccatacaaatgcaagtagacagtaaaaaagctgataacttcagcatctaattggtcaatcttcgagaacctagttaacacatcactttgcattaggcactgcaaatatttcttaaattccaacaccacaggaaccaaagagcacagagatatttttctcacctgtgtcagtgaccctcaaataacgcaaatctgttctaattttcatttcgagtttttattaacgtgatcccaactccaatgccagttttgcctgttttgcccagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcaggtagggagttacgtcttgtctgcttaaaaaaaaaaggagtgctctcggcgaagcccttcgtttcacctgcacagccccaggagctgccacctttctgcagagcacactgccttgtgcaagggggcttctcagctcacaccaggggggcagatgccaccctcacctggaactgaaggtctgctaggaaagtctccctctgaacaccctggaaaacctgtccctctacagaactctcatttccttcttctagaacccggacattttcttctataccaatttttctgattttagctgtgatgtaaagttgttctgagtagcctatttttttgttttgttttttgtttgtttgtttgtttttgagacagagtctctctctgtcaccaggctggagtgcagtggcatgatctcagctcactgcaacctccagctccctggtttaagtgattctcctgcctcaacctcccgagtagctgagattacaggcacacgccaccacgcccagctaatttttgtattttttttttttttttttagtagagacagggtttcaccatgttggccaagatggtctcaatctcctgacctcatgatccgcccacctcggcctcccaaagtgctgggattacaggcatgagccaccgcgccaggccgaggagcctgtttttaaagattcatcattattagtggaaaatgtatgtttatacaatatctaaggacagtactttgggtgaatactgtcagattcctggagggaaaaaagactttattcctcctcctgttgtggctgtgactctttggttttctagatcagagaataccgggaagcatagcacattaaccttgtgttccctctttaaatcaatatgcatcacccgttaggaaccaaagagtgtttggggggctttgaacacagtggtgaccaacactgtaaatctccctgctctcagaagtctccactctactgagagacaacaataaagaggacaatttcagcaggatcaactggaagatgataaactaaggcaaagcatagctctattataacacaaaaattgttgagatgttgccgatgcttttatacttaaaaaaaaaaggaacaatctaaattagtatgaagtagatgtttctagaagtgacaaatttttatttaaatctttaaatactttgtgctattattcttttgttgtcatgtggcttatagcacagaaaggaaagcttctgggacagagactttcctttgacaaacccaatgtagctattgaacatttgtggaaagttaaaaaaccagtcctaccccattgtcacttcagaaaatgcctacgtctgaactgaggctgttggcattctttgataatttacttcggccattttcacagggttcccccctgcccctacccttggatatttgtggttgcctcacattttatgcattgattagtcttgaactactaaaagtacattttatgtattttgagtcagagtgttttgatatttttcccaaatggagtctgtccaacttgaacatctggaaataaattatcatcttatgtaactttattatttatatacatgtataattatatctgttcatatagtctatatagatgtaaataaaggccgaaatttctaccactgtaaatataagtatagtgggataggtggatagagagggagggagggagagagggagggagagagggagggagggaaggtgggagaaggttttatatacacttaccactttctgttcaattgaccatagctaaaatatctaacttttcaaacaatatatctgtatacatacatggccaagatagcattggtaagtcatttgactcctttaaaggaaattcaacaaatacagcgttttgtttttcatgcatgaggttggaattaacagcacttgtgttcaacaggcccttggtgtcattagattcatgatcaggttaagattccagatagaaggacgactgcattgaagccatgaagtccccttccagaagcttcctccctaggtgccaaggctttgtgggtgctcacttgttctacaccggctccagggttgataatttttctgcccatttcaattttgcaagctatcttagcgggacaatttgaaagaatttgggtgtctggcagaactgtagtaagttacccaggaaagcagttaagctatggtgaaaatctagtaaaccatctaatgcatttcttttagttaacagtgattctctgtgactattttcagcctttccatcagcagacattgtttaaatggagcagcttcctacagtccattaggaaataggcagattacaactcataagtacaaaagtaataactagttgtcatctgagtcttgaaaacaaaactctaaaaaatgacagaaccatgacgcaactgcagaaataaaattttcagggaaaaaagataaaatcacatgtgaatataccctcatacagctatttttatttttgcgtattttattgcaggaatatccaacagaatttttaaatattagagaatgcccccgttctaatttgattaaagaaagtcctctcttttatttcctagtggggtttatttccaagggaccaccatcggcatggccccaatcatgagcatgtgcacggcagaccagtctgggggaattgtcatggtaagccaagggcattgggagctggttccccttgataatgattccccaggaagtcactacttttatcagactttgtgaagatagatcctttcctttaatgctttttagatttaactctatttttactgtagctgtatttataattttatatatcccacagtgttttaggaaccatttaaaagcaaattgcacacaggaaaggtgggcatgtaaaatagctcagcagaggcaagcctacctcttttatggagaaacattttcaaccaggactttccaaaccaggaattcctcgcagcactggggtgagccagggcattggggttgccctcgtcatgcagctgttgggacgccctgtggtctcaccagacgttcccgtttggatggttttctgatggttctgtctccaagcccaatggcccaaagtctgaggtttttagctttttaccactgcaaatgctttacatgccttctggccagtatacagtttgtctttaaaataaccttattcttggaagtcagaaacccaggtttattgctttacaaggaccattttgtcatatataagctatatatgtttgtgaaaggaaatacagtgggaaaactatttgggtctcgttatgaatgtaggagggaggtagctttgataggcttgccagcagggggcttgtgctccacttcatcagataattaaaggagaggttttcaccctatgctgtccctgctctgaaaatttagtgtctcctctgcaccagacctcagacagggagtatcctcagagaccattcttccatctccattaaacaaatagaaccctgccctcccaagaaactgtgagttcctccatgttttttaaacagaacatgtgtgaatgttcagttgtattacatagtggaaggagttatgttctgctgatgattactttctctccacctactgcctaatcagatattcttcatgaatatacggaaccaacatttccctcttctgtgggttcagagattggtcattaatgtaagcctgcactaagggtcaaagctgcgtggagggattgcccccacttactggatttctggcttgagtggtgactgccttgttttctgtggacctggaggccctgcatgtgatctccaccatggcaggtccttggcaagtttggtttttgtgatgccaggttcacttcaagtcagatcccaactctatttttacagagcagactgtacatttttaagagggaataattttctgtttcatggttccatggtcagttgctactgactttgccacttcaagttggcatcatattttttttagagctggaactcaattcttcataagcatggtaagttctgctgctgtgcggtgctgaaatgggcctgtaacccatctcaccagagtaagcggctttcttcagctcgtgtcccttattccatttccatacaagcatttgatgaaaattccttctttaaaaggatacagggaaggctatttttaaaaaaggtatatgaaaatgaatgtgggaaatataagcaaattatgtgtcatgcaataagattcaattgaagatcaaagttaattatcaggaaatatgttttagcaatttgacagcagttaacatcatccttagacacactgcttacacgttccacatataacagaaacatcaaataggataaaaatgcctcagcacctttgatttctacaaaagtcatgaaatcagcaagatcaacatcttgaccagaccaaaaacttctagactcactttcttctcctgtgtctgtaaagttacattcacgggcatcccgtgtgactgtgcttcattagaggaccacaaatctaagaggaaggaatcaatgtagcaaggaagcagagatcctcataaaattgaaaacaggattgtagtaccatttctgtattttccaatatagagcaaatcattaattttagtgactgaaagtcattcctttttatctaactggcctaaaacagccttgctttggaaataatattaataacatgaataaagagatattttttcttactacaaatgtaaactgtttatcaaggtcttttaagagacattctgtttataatcattgatgcatgaaagaatgtaaaacaatctggcaactaaaaaccaagacattcaatgacacaaaagaatcagaagaatattttttaagggtgaattccttgaattttgtgccagagcatggtaacttcagcccctatgttcttagactgactacattctcttcaccattgtgttattttcgagaaccgatttcctgaaacatatttgtaaacttcctacaacaggaaactctaaaatctaaacaaagtaatttattaggaatttcatctactgtaagattatcttggttccttgatatgctattgttttcttagacagaagcctcattgtaaacactgtcaacaaacctgtaagatcttacatgagcacacttttatccaggagcctcacacagactgtatcagtgtgctctctgaaattcagtatcatatttgttttagcccattttctgttgattctaacagaatacttgaaactggataatttataaagaaagggaatttatttcttacagttacagaggctgagaagttcaaggtaggggggcacacctgatagggcttcttgagggtgaggactctctgaagagtcccaaggcagtgcgggggatcacatggcaagggggctaaacaaactagctcaggtccctcttcttcttataaagccactggtcccactctcatgataaaccatgaatgcattaacccattagtccatgaatggattaatacattatgagggcagagtccccatgacccaatcacttttttttttttttttttttttttttgagacagagtctcgctctgtcacccaggctagagtgcagtggtgggatcttggctcactgcaagctccgcctcccgggttcacgccattctcctgcctcagcttccagagtagctgggactacaggcgcccgccaccacgcccggctagttttttgtatttttagtagagacagggtttaactgtgttagccaggatggtcttgatctcctgacctcatgatccccctgcctcagcctcgcaaagtgctgggattacaggcgtgagccactgcgcctggcctgacccaatcacttcttaaaggcctcacgtccaatactgccatattgggattaagcttcagcatgcgttttggagggaacaaaccttcaaagcatagcagcactgtttcttggaagcctcttggaaaacatcttatctctttcctaagtagcacaaagcaagattcaaacagggtattttccttactccatggtatacaggccttttcagaaatgttgtatataggcactgtttctgtagatcatatatgctaattaactaatttcagtttgtaaaagttaagtaactatattttttagttaatttctagtatctgtttgagccaagccatccaggcactccactaagttaggggtggccaagtagtgcttgttgaatggagaagccgccttccatatccaagcaaaaggttaatgaacccccagccgcaagagtcagagaatcgggacacctcccatttccaaagtctgcctggcaacacaaagagccagcaagaataagatatagctggtttataatcttaaatgaaatgaatggctcttcaaacagatgactcaatgtggtcagatttattatgaagtattgtgaattttccaactgtcctccccgaccaagcacacaggaagaggcaggctcaatgacaacctctcagggctcatttagaatgtcattaagcgtgcttgcacctgtcacctttatatcagcatcatctcaatcaaaggtaaaatgatacttctatggcccatgaaggaatgagcttttcctatgatgcaggatgactttttgcttcattcaatggaagagttttgtggggcaattgtaggaagcagaatggagaccctgccttgaagatgtcatgtaaaaacataaagaatcacacatgtatacgtgcggcatacagacattcctcagccgaaaggaccccaaactggcttaatgaaatgtcaaattatatctttttaagtttaaactaaatgatagcgttttaccttggtcccttataaggaattacattaagtcaaatgttaatgaaaggtatatttctgtggggagggagacctgggaaataaggccaaggagatatgaattatacacctgtacttttgtgttttctttgaggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggcaagtaccattgcttccatctgctttgacagtgtgcatggcttgaagtgtgtgttgggaaccagatgagtcaaagtgtctctggttttctggtcagagcacccagggaagcttccaaaaagtaattccttcccaagaagcaagggtggcctgtgctactctggagagccatgggcagccagatggcaatgctacatggtgtgtacaaggaagagggctgaccttttccttgaggaatggtgggcatggatgctgtctgtgtttagaaatcgctaattatcttcctgtcccagcaagtgttttttatttgagcctacggctccagctgccaggcagtcccaggagccagccatctgaaagcctgggcagtggagatgggccacatgtaaactcactgggcagagtggagatgggccacatgtctttagagggtgctgggtagaaggtatttctttccccagggttggccctagggtgtctctgaagtcggtagcttgggggtttgtagtgtctctgccctgacatcaccttaccagatcttagaggtttaaatgaaatgatttctctgctttggtatattacaatgctgttccttatttaatgctttcctgacactcccgacttggttcaaccagaaaagagcaagacagttccattatttggagtgttcaaacgaagtggaaacagatgcaccttggagggattagagattcagatgtgttcttatatctataaagggcctatcccaaactagaactttgtgctagtttaagaagattctcattagtaacgggaagcatgcgctggatacaatgctatcttctttattataccttgaaaccttatgaacactgactttcatggaacattccagcccaagcctgctctctgggtttcccaaaaggagacactggggcaagaggcaagtgctctgagcagcccagtgactcatctctgtgaagacttgctggccaggggacaagcgtggtgtgaggggatacctgctactgcggtttaaaagacccagtagagggaggaattgttaaagaatgtgtctgtgctttttcaagcaatagccttgtgggcctcctgggaaatagtttgtagggcattgagttgcccttgaaacaagaactgagcagaaccacacagctcatcaggggattgtcctttcatgggagccatcaggaggcatcttcttacagcaagtgactgattcctcatgttcatcgcccccatttgggcagaggcttcaggggcatctttctgtttgtggttccctcttaagcataattcaagggagtcaccaagactttgttgaggaagttgctttgtgagtgtgtaatgacagaaaccaaggatctgtacacaaagtcaaagtactaaccgataggaaatgaaatattgcaaaactcaagatactaacatgtgtgtctctccaaaagggaggccaccctaaaaagtaatatgttcctagtcactaaaggtgtctgagaggaagcacagtaattgtttgctggacatttggggcaaggatttccttcttagggtataaggttgggccaagggcctatagatgccttctgtttccaacatttcacaagccctgatcgctatgctgggccacacgctgggtgactttcagacagtgagtttggcaggagactgatgtgcaactgagtggccttcgtgttttctcactctcaatgaactcatagccatagaaaatgcactgtgtgtctaatttccctgatcatcagatgggcacaaatacattagcctatgggcctccagaaatggtttcccatgactaagaagatcatattgttaatattgttaatgttttttaattattgataaaccaatggaagagaggaaaacctagatcaagaacactggacttgaagagatctggttgtcccaattctcacaccattttttaaaataatataggcagtttagtaaccccctggctcttacattcctcatcaataagatgagtgagtcagtcttcatccacccatccaaccatctatccatccacccatccacccttccttcctcctttctttccatctgtctctccacccacttgttcacatattaaacaaatatttttgacccctgtgctcgtggggaggaatgcacagatgatgaagactctacagctctaaaaattatataattctgaaggcacaatagcaaggcatattttctggcactctatatggttttatctaaatcctttccaattggaaagtcttcatggcagtgctgaagaatgcaagccagatcgccccagagatatttgaacaccgtaggtagaaatggtattgttaagagctcgacaaatcatttaaaaggcttttttttcccccattaccaggggtttgctaatagcctttatttgatttataccatattagcaatttctgagttttctcttttgctgagcttgtgcttttgtataaatcttttctatttgcttctcatttatgatcccacattcctgtccagagagtggtgtttttaattttctcagatggaaagcaacttcctaagcaagtaggtgaattaatcacaaaagcccacagtgagggggaggtcgagcggctcagtcaaccctcagtcatccatcacccgtggtggagttttcccggctgctccggtattatctcaaaatggtggttctcttacctcatagtgtctccgagagagtgggagaatggactcaatgagatcacatgtctgtaaattgtaaatcattccacaaaggtagtatattattacttagcttacagggattttggaactatcaaaaagttaaaggctttttcagaattcctactcatcattgctggaaagactcccagtgcccttagcagtcactcagcagcatgtccacagtttccgtgtgatggctcactttaaactggcccacatccaaacaccagccagcctgtgtcttcctcctcccaccactgatggaggcttggggatgtcagttaaattcagtctcagctccaaaggtgattcagagatgaatcagtaactgctttaatgatattaacatctcagaatcaaaaagaaccaagtattgtagatggcttaaaggagaaaagtatatcccttcatataccttgtttattctttatcaaaacattccagaatcctaactctgaaaacattaaccaattgctgtcactgacaaatgggacctgaggcctgtaaatacaaggatagagtcctatttcaacttaagacttgtgtgacttcagttgcacattgcagggatggttggagggggttccttatggattgtatcattaattactgcaaggctttaagtgtgtgtaagagtgtgtgttttatgtctctaaacatttaagacctgtcctggaaatgactctttggcaaaagcagtatctggggattcatgtgggagtttaactcagttgagtttatccattaatgagcttggagcccttggtcttagggaggtgagggctacgtatgctgcatttataggagtaagaaaattgtgaatgacttgaacactcatagcaaagaatatttagcgtaatagtaaatgtcacttcctagagtaggaaaaaaggcaatattaacattcaaaaaatgactcttacagattcctttttttttttttttttgcagaaagtttctgttaaatgagagttggaggaatagggccatctcctcgggtggggtaggtgaatctgcaagtcatattcaccgagcccctgccactgttacacactgataggtgttagggacacagctgtgaacaggacaagcctgtttcttgccctcttggaactggtgttctagtggtgaaaagagttgaaaaatggaaaatttaaaacttgcagtttgggccaggtgtggtggttcacacctgtaatctcagcactttgggaggccaaggcaggaggattgcttgaggccaggagttcaagaccagcatgggcaacatagcaagaccctgtctctatttttaaaataaaaaaataaaagtaataaattgcaggttggaaggagtgctgtgaaggaagcaaaggaagaggacaaagagaggaaacatggggtgagggagcccactttaagtgggggtttgggggaggccaaaaggaagacagggatggagagcctgcaaagcatggaaggaagggagttcaggtgcaggggaccatgggcctgtgggcgctgtggggacaccttgctgccaggagccttggggctgtggggggctggagggaagtgatgctgggtagaaatggaggaaccagagccagcaaagcccagttggccagagcaggaacgtggattcttatctgcagagcagcgggacatcattgaagcttctcaggcaagataggaatatgatctgatttatcttttaaggtttcctcatttttaagaagaccatgcagcctctgagatattgtagtttgccaagttaaggggttttctgtctgtacaaaaaagaagagggaggcttcctttagaagaacaagtaataatagtgtgtgaattctagtttagttctggtgtaattcataggcatttggaaactgtgaagaggaaggatccttcaccagcacactcggtgctcatcacgccacgctccacactcacctctccagccttgtacacttgatgtaaaatatttcttttggtttgagatttctttttccttttcctatagtgagcatcctttagggattctgtcagagagccaccaaggagcacattcacattttcttcatgtgtatctgaaaagaattgttgccacagttgtcacacggatgctgaaatcaggagtttgggcctgtctgggttttgctgggtctatactggcaaatggcttcaactgacgagtgtgtccccagctgccaactgggagttggggcgggcagcgtgttcgtgttgtgcactgaggataatgtgggatgagaaaataagcaaatgagggttaccccctgctctcctggggtgcaaatcattcacattaagctgaggtcagaccttctgcaatctacacccagatcaaatgaccacgtttaaggagaatgtgttgccatcctacttccccgcaagcatgtataactggcccattcgattacatttaattccattcaggacacattcatggcacacctgcctggacacggaacacaaacagatgtgtccccaggtctaggtggcctccacccaggtcagccttctctctctctttttgtttttgttttttgagatgtagtctctccctgtcacccaggctggagtgtgcagtgacacagtctcggcttactgcaacctctgtcttccaggttcaagcaatcctcccacctcagcctcccgagtagctgggattacaggcacacaccaccatgcccagctaattttttttttttttggtatatttaatagagatggggtttcatcatgttggacaggctggtcttgaactcctgacctcaagtgatccgcctgcctcagcctcccgtagtgttaggaatgcaggtgtaagtgaccatgcacagcctcggccttctctaatgacatcagagaagacagcagccctgcccctgactcaggacaagcttgctacaggaaatgaggtcaacagacgagcagctggccaccaggcagagcaaagccactcatttactccactagtacttactgtgtaccctctagaggccagatcctggggagcagtttcggagcaggcacagaaacacaaggcaggatccttgacttcagggacctcactgcagggtacctcatcaaatctgcttacacagtccgggtatcaagcaccatctagaagtgatttcagtgtgggcctctaaaagacagagagaaaaatctataaccataacatcatttcacatcttttaaaaagcgaccaataatttattgcaaacagggagcaaaggttagaagaggcagcaggcagaaaagatatcctggaatagagtccagtctaaaccgatctcagaagaattaaatacaggctgggcagaccgctccctgaaaattcctacctcatactgtgggaaaactggatttctcttggaagagatttctgcctgaaaaggtgttttaagagggtaaaatgaactgcaattttcagtgaaaaaaatcccccaagggctttggaagtggtaggaattgatagaaattcaatgtagcgggaaagtccacactctgtagaacttgctttcctgaaaatcagtggacaatacatatcgttagaattctccctcgaactttggggtgctgttggagattatgaaatacatttgtcatgctggaattttaccaagatggaattgaagggaattatttttccatcttaactcttcatttgagagtgataatttttttctcaatgaaaagtttaagaaaatcttcatttccttcctcaaagtgttaggtgaaaaaatggaaatctttatccagagagagagaaaaaaggaggaacagctacagaatgaggaactctggtaagatgaaaacactactagttagaatcaatttaattactcagccagagtaatggagccagctgtaccccgacattatcacagggaaaaatgaactggcaggagggattcttgaaaacagttcaagaagggcgcatcaatatacagcctgttcttgtttcttctccatgtaattagatattgctcactggaaaatgaaagaatttgtgtgcaattccattagaatatgaaaagctgctgcccaagttagaattgtcctccccgttaagctgtacacaaaatagaggtcaagctcgggaggctgattctgtgtggccactgatccttgaatatccagtttaggggatattgaccctgaaggactgcattcatggtgtcctgtttcatcgatgaactttttaaatttaatttaatttttttgagctgagcctcgctctgtcacctaggctggaatacagtggcacgatcttggctcactgcaacctccacctccccagttcaagcaattctcctgcctcagcctcccgagttgctgggattacaggtgcacactaccaaacccagctaatttttgtattttagtagagacagggtttcaccatgttggccaggctggtctggaactcctgacctcaagtgatctgtgagcctcggcttcccaaagtgctgggatacaggtgtgagccacgcacctggcccatggatgaacttagtgagatggtcatgactatacctattttattttatatatatatatatatatatatatattttttttttttttttttttttttttttttttttttttttgaggcagagtccattggggccatctcggctcactgcaacctctgcatcccaggttcaaatgattcttgttcctcagcctcccaagtagctgggattacaggcgtgcaccaccacacctggctgattctttgtatttttagtggagatggggttttaccatgttggccaggctggtctcaaactgctggcctcgagtgatccacctgccttggcctcctaaagtgctgggattacaggcgtgagccaccgcacctggccaactatacccatattactggagctcagagtgttaaatgaactgcttgcatttttccagaccgacctaagtagaagccccaggacataaagtcaagcggctttttcccagtgtgtttgacacatggaagtggccgtgaacacatctgggctttatgagagaactaaagctgcctcagtacagagccatgtccctgtgcaacctctgggaggtgggaggtagccccatttttaagccatttaattctgcaaacctccttcaatttatgttccagcagcagagaatgctttcctgtcactggctcgttaacccagcattttatttgttgtacagcatgtgtgaaaacatttcaactgaaatcctgccaatcctgcaatccccctcccacacacttacccccatggcttcctcctctccccaggcacagaggccacagtgtggggtaaagggttatttctagacttctctacaacagacaatatccaaaaggactcattttcagctccacaaggtcaggaatttgtgttttgtttattgctgaatccccagcacctagaacagtgcctgacacatagtagagctcaataaatacttcttgactgaaaggatccatgagcgggtggctggatgatggatgcatggatgggaggaaggaaggatagataaataataggtagatgggtcagtggatgaatggataatgggtgggtggaatgatggatggatggacggacggacagacagacgaaggatggatggaaagaaggaaagatgggtagatggataaatcaatgataggtaggtggataggtggatgaatggataatgggtaggtggaaatggataatggatagatagaaatggacagataatggatagatagatggtacaatggacagatggatagacgttggctgggtgggcggatggagagagggatgatgagtacagcacaattagataagtgcagagtgaggttttctcttcctcatctgtgtaatggcaaaatctctggggagaacgctctgaggccactgtcttttgtactaaatctagcaattgcagcagcagcattttcattttttgtttattccacatcattctacaatggatttacaatagtttgtaatgatacacacaatacaataaatagaagaaaataaaaacaaaatagagcagagaaaacccagataaataggaggcagagtccactgcttttctgtacataatccatggagacctgggtgagggaaacaatttgctttcaaacagtagagtctttccagcagggccttcccctgaaagtctttgcttaatttagctaaagtgggaagagagagatcaaaaatatcaaatctaaaagcagttgtgagcataagactttgtagaaccattctccagtttacaaagatctttggcatctcctttcattgtcacagccctaaaaataaagaacaggtacaatcgtctccattttacaggtgagcacactgaggctcaggaaggccagagggcccacaggtggtcagggtcattctggatctcagcctgcagcctcaggctcctgatccattctttggcctttcaccgggtacctgtgagcctttggctcgcaggcttggggatggggagggttgagagggacagctctttcccattcttgagttccacattgccctggtggtaacttcagtgtcagttgctcagtggggcaagaactgggcacgtgtagacttcagccctggtggcaggcttgtagatatctaccgtgactgctttttctatcatgtttgattagaagcctctatcctgttacaggcttgctaagtcagcagaaagaactagcgtattctgtgcaggtctgtctactgggctaggaagaaagggtggtaccatttcagacatgcccactgtccattattaaccactgcatctgtccatgtctacgagagtctgctcctccaacaacccccacacaaattcagcagtcatttcttgcaatgaagctgagtagctcgtctgatacatggcctctgatgggctgaggtccttttaatatggacactgtgtcccccgcccctgggttcttggtctttcaggacttggtgcaggaagaaatagccatcgtagctcagaagtgaaaagtccactttctggtaacgtccagaagcttcctgtacatgtctcaactgaccagagctcagttggtgactttattaaaaattctgggaaattatatttgcacttaaattggtttcagggaggaggagcagaggtcaaagttcacaagttaagaccatgaattataatgtgctgcagatggctgcattctggggcccaggtgtttgctattaacaatggaaatggcctactaaggatctttctggtcatttgctcctggcctggtggttttcttagctttctgtggtccgtctggttggcccactggctcagcgtccagttataaggcagtcactttctgtttctggagtggacgtgaggatggattgccccattagcttcagcctcagttctgttctatcgtttgagcctgtgtggtcagagctgtgtccctgtgcaccgctgggcaggcagagtgggctgactcaggcccagttccctctcccatcacaccgtgaggaggagtcacgaggcttttgaggcggggcgcctatttcccctgcctgcagctcattagggtctcaacaggcttgcagccctcctcaggtgtgcacgatctggcccaggtatcacctcaggctagctggatgaatcccaagactgggcctttgtcttctgttacaccaaagacctttagggaagtcctctaaggtacacctggaaggaagtgtagaaccttgggtgttccttctgtttacgtctggctccagggagtcccgaggcatcggagcagctgcctctcccaacccatggatactactgctgctggcatagccatttgtgctgggtcatgcctgaggctgcccagaggccctgccctggggcagctcctgatagccctcgaggcggtgtggttgagtgggaagaacacaggccttctagtcagatctgtgctttcagtctccacgcagaaactgcagggtcccggcaaggaacccaagctgcctgcactcagcttcctcatctctaaaataggagtcataattggctcccagaggtgtcagtgagagaatgtctgccaggcttctggtccccagcagggtttcactaaacaaatggtagctcctggccagccccgctccaggcaggatggagtaaaaagcccctaaaatgatatgacctccttgcatccacagcaggcctgccacggcactgaacatgaggccggtcacctgcgagtacaaatgccaccgccctggcctaccaggcgtgctacttggttgcacataaattctgtgtgtggtgattgaaagtttttattgttgggcataactggggaaagacctgaagattttcctgaagatggccctagaatttttggtcagcagcttgtccaagcaatgtccattccccacactgcggtcccctgccccctcatactgtaagaggacctcgctctcacttgggaagagaagagggaattcatgttgggcttatgcttctcaagggactaggaatatgtagaactggctgtgaactaagaatggctaagttgtttttggaaaagctcagcaagctagttatggaatgaatgataaaagttgtggccggcatggtggctcacgcctgtaatcccagcactttgggaggccgaggtgggtggatcacccgaggtcaggagtttgagaccagcctggccaacatggcaaaaccccatctctaataaaaatacaaaaaaattagccaggcatggtggtgtgcacctgtaatcccagctactcaggaagctgaggcaggagaatcgcttgaacccgggaggcggaagttacggtgagccgagatcgcaccactgaactccaacctgggctacagagcgaaactccacataaaaaaaaaaaaaaaaaaaaaaaaaaacagtcattagattgtcttctccagagaatggatcccacaatttgtggccacgtctcactctgagctcagtgcctggacttggctgtggccaggaaatggacggaagatgtggggtgagctcatgtgacatgagctttaggaaaagggccagaaaaaagctttcaggaacagaagacaaccacagctgcgtagcaggtaacagccatctaaatggcgtttttgttttgtttgtggattgcttcattggttggttgtgctcctaactacatgctcttgttgagctaaagaaaaactggcccttccagaatggaacaggctgttttgcttctttgacaccatctatgtattaaacggagggaatgatctttaactgtttgctcatcccttcgcctcctgaatcatcttgctctcaaatttacttgtatttgtggttttacagtgtaaagcgtgctctattttggctacaagtactacattctataccatattggaaatgttcttgagcactatcatatacggggggattcgcagtcagggcaactcccaatgggagaaagaaagacacatcttttgcctgtcagtactaggagctagcatttcacagtgcttggaagttaaccagactttgatctttttgtttgaagctcgtttagcctccacttcagtgcaatgaggtagttgttatccctattttatagatgtgaaaacagaggctcaatgaagtacagataggctgctcagacttaggcttcggacttgagttctcaccacacgcccaggtaaagaagagcctcctgggtctgccgaatctgtggcatctgctgtcaggagaaaaacaaaactccattttggtctgcaaaaagaaaccagtgggaagcagaatgtcagcaacatattttccaaaaccagttagccctttaccatctaatcatttgtcagctgtggacgatatgaggttgttttttgttttgttttgtttttttcccccaatcagtttaaactgaaaaatctggatggattcccatccccggttccctgcaactttggcttttcctatcacacagttatgtcggctccaagctgttctcagccgctgcctggctgttccatccttcttcctcggtcacttccactcctttcctgccgtcagcactcagacagatgtgagcccctgagcttggaggtggggaacctagactcagtgcgtgtttattaatgaggccgcagagtcacaggaagcagcaggaccctgacctgcagccccccttgaatccagcctgattatagctggtttctccagacgcctaatttccagcaagaaaagcagttgtctccaaatcatacccagagagcttttgcaagtcagataactcccgacttctactgtcaaggttgataaattggcctagtgtgattcacccccaagaatatagcagtgagacgcacaataggctcctacaagaaaagaaccttctgactgcagatttttcaaagtaaaagtaagccctaataatattttacttggcagctttgtgatggctaaaatatgaagctgtgactgcctttatggtggggagctgtaagtggcattcctctttttaaaagtggtgtttttttccccaaaatcacccagctgtctgtttcatcctctttttatttttaaccttgcattcaacatggtaaacttgcctcaagtgtccctggtagttaaatattagagaaaaaggaaagcaaggctaacaaaagaggtcacatcgtagcgggggccacagtcaccctgccacggctttggagataaattctctgcctctgagctgaaagcagcacttttttttcctgggccgcaggtatcaccattttaaagcattctcacgccaagggaaaggatcgtgctaaagggcttctttcctgagtaattctccagttttattgctttgcaccagtctctcactgctataggtcacttcagttagctgctgtcctggcacatgtgggataatttattagacatgttaaaaagtacattgtgatgagcttgccaaaagctacggaagaaactgaggcttgtctttttaaccacagacgaggggctgtatgagatctttgatgtcatgagcaactacctggcccaagtcaatgttcttttcatggatgctccggggaataaagctgttaaataagaaaaatacaagcacaaaggaggcacaatgaccatgtaccatactttggatttggaagcaggtggaagggaaacatcactctgttcacaaccagaacttttcctacactttaattactgtgcagtatgaggattagtcaatttcacataacacttccaggtacttgaaaattcatttctgatatgaagtttgtttataagacagatactcttgggatttttagcacatgcctaaaatcagatcagtagcatcttgccagcatcctctctctggcatggctaagtgagccatagcagtcttatcaacgatcgcactgacagatcctgcctatgattccttgccttgcctgttgtccattggcacatctttcatgtgatcacaaaatcaggtcaggttttcaaaatgccatacattgggcttttcttagaagatgggacaagagagcaaaacagaattattttttaggatatgacaagtggcccatggtgagtctagattgcattttttattgtcacgacacaaataggtacaacagcatttgaattttaaatctagggaagttgtttccagtctctaatgggcatcaaaatcacctggatcattaacagatgagcagatagcaaattgtggtatggtctcacttgcaatggaatatcatccagccataagaaggaatgaggttccgatgcatgctaccatgtggctgaacctcgagaacactattctaagggaaaggagccaaacacaaaaggccacatggtgtaggattccgtgtacatgaaatgaacagaacaggcgatctgtagagacagaaagcagattcgtggttggcaggggctgggtggggaatggagaatgaggagtgatggcttcatggatgtggggtttgtttgaggggtggggggaagttctgcagttagtagtgatggctacacaacattgtgaatgtgctggaaaaaaacattggattacatatttcgaagtgacttaaaggatgaattttatgttgtgtaaattcaacatcaatttagcaaatcgtctgcagagcttattaaaatacaggttgctaggcccctaccttgagttttctgacttagtaggtctgagtggggcttgagaatgtgcatttctagaaagttcctggtgctgcttgtcctgggagcacactttgagaaccactggtccaggcatatgtgggatcacagcaggatttgtctcctgtgtttaaatcggtacattgaggattaatcaatcaccttctgtgtttcagcattcactgctggtcatccagtgctgaactggcactggtaataaagaaaatggtttttagtacctgaacgtggaatcataagaattggtgaaatctagtactgccatcccctaactgtgaactgtcaaatcccttcacctcatttgcaaatggagcaataataactgtttcattggattgttccaaaattttaaattcaaaaaaaagtataaaagaagaaaaatattaccatgagaaagcaccaccatatcacctagctaaaagcaggtactccataaatagttatgccaaaaaaattatatattttaactcaattactagtcttgggaatttataatgttgtggccagaatatggtgacacatgaaggcagcgagaacttacaacacagccttggactgcacagttccactcagactccatttatgtggcataaaagatatgtttctgggggtttgggacttcaaagaccgtttctggaggagtggaattatatgggccttggagaacggctggagaggaaatgagataggagggtgggcacatcccttaaggaaggagcttggcaaggggggcatgggaccaggttcaggtcatattggaattgggatcctcttcagtgctttgagtataatagacacttgaaaactattgctccataagtgagtgaataaatgagagagttgtgaatttgccactcaaagttgtattctgccatcatcagaggtatgtaggcagagtcagcacctggggagcaggtgatgcacctggccttgctgagcattggcacctgctttgctctaggcactaggtaaccagtggctacttaggatgtagaaaatattctaatatgtgtggattaagatggtgttaccattagaggaatctaatattcgctactggcaaatttcccttatctcttaagatttgaagtaattttcatttattaaattttttgtattggggggcagtcattgggtttgctgtaagttttccatacttagttctgtgtcttgatcaaatgagactatcttagagcagcaaaagggagatgaggagcagacctttgcctgcttaaaaagcagtttgctttaaaaaaataaaaaggtgggggaataagggtttggagttcttatgaaaaacacctttaaatctttaatccatcttgagttaatttttgtaaatggtgagaggtaggggttcagtttcaatcttctgcatatggttagccagttatcccagcagcatttattattgaatagggagtcctttcaccattgtttatttttgtcaatttttgtcaaagattagatggttataggtgtcggggtttatttctggggtctctattctgttccattggtctatgtgtctgtttttgtaccactaccatgctgttttggttactgtagccttataatatagtttaaagtcagataatatgatacctctggctttgttctttttgcctaagatagctttggttattcaggctcctttttggttccatatgaattttaggatagttttttctaattctgtgaaaaattacattgttatttacattgtaatctgtacattgctttgggtagtatgaacatgttaacaatattgattcttccaatccatgagcatggaatatttttttgtttatttgggtcatctctgatttctttcagcagtgttttgtagttctcttatagagaactttcctctccttggctagatagattcctaggtatttcctttttctgtgtgactattgcaaatgggattgtgttcttgattttgttctcagctagaacattattggtgtagagaaatgctactggtttttgtacattgattttgtatcctgaaactttactgagttcatttatcagctccaggagccttttggcagaatttttagcattttctatgtatagaattatattgtcagcaaagagagaaagtttgacttcttcttttcctatttggatgccttttattttggctttggcaaataatttatggctgagtccccaaaagcaattgcaacataaacaaaaattgacaagtgggacctaattaaagagcttctgcacagccaaagaaattaccaacagacagcctacagaatgggagaaaatattcacaaactatgcatctgacaaaggtctaatatccagaatctacaaggaacttaaatcaacaagtaaaaaacaaatagttcaatttaaaaatgggcaaaggacataaacagacacctctcaaaaggagacatacaagtgaccatatgaaaaaatgttcaacaacactaatcatcagggaaatgcaaatcaaaaccacagtgagataccatctcacaccagtcagaatggcgattattaaaaagtcagaaataacagatgctggcaaggctagccactgtggaaagcagtttggcagtttctcgaagaacttaaaacagaactcccatttgacccagcaaccccactactgtgtatatatccaaaagaaaataactcattctaccaaaaagacacgtgccctcatactttcattatagcgctattcacaatagcgaagacatggaatcaacctaggtgcccttcaacagtggattggataaagaaaacgtggtatggaatactacacagccatcaaaagaacgaaattatgtcctttgcagcaacatggatggagccggaggccattatcctaagcaaattagtgcaagaatagcaagtcaaataccacgtgttctcacttataagtgggcactaaacattgaatacacgtagatgtaaagatgagtacaacagacactggggactattagatgggggaggatgggaggggagcaagagctgaaaaaccacctattgggtactatgctcactacctgggtgacaggaccccagaccccagcatcatgcaatatatccatgtgacaaatttgcacatgtaccccttcattgctaataaaagttgaaattatttaaaataaataaaaataccttcagtcattcccagtgcctggcccatacagaggcacagctcccagtgtattgacactccatgggatcttctcaccatcagcatgaccttgacctatctaagaatgatgccaagtagaaaatgggttgcctctctgggtgtgtgtctgcaggaagagcagactgtttcccactgttgagtaagttcctccaggccagtcctgtctgcagacacttgtaccagctctttcccgaggtgcactcacaccttcttcccttcgggtgaggggctcaaatgaccctcttactggtgaggtttcctggtgaggtccactgtccctaaaagttcaatacacaccctcttcccttgctcttttatttttttctccttaattctactctttctaactcattctgttcccttagcttgcctattatctgttggccccactgaatgcaagctccatgagggctgagatttttttgttctcttcattcccatatccccaaagcctagaacaatgcctggcacctagtcggtgttgaataaatacttggggaataatggaatgatgtgtgataggctgttctgattttcttcctctaaagcctgacttcctctaactgcccaaatagggttcataaatatcctatcagagtgaatagtcacctgcctccttgctgagaaatcatgaaaggatgggatgagtaatgacatcctacaggtagaaaatacttctcagcctcatcaccattcgtcatcaaaagtaagttcttgaacaataaacgaggcatttttttcttcattacatagaggaaatggtagcgatattggctgacccagtccgaggaaatggcaggaatgtttgtggaagggctgctggactccccattgaccttgctgggtcgcctgagcaagtcagaaaaaccccaggttggtgggaagagaagccactcacacctgctcatggctggagctgtcacccatggtcaggagttgctggaagtttgaattgtcctgacctggaaggcaggcggcatgctggtgagctcaggccatgtggaaaggagccctgagaaaggatctgttcagtgttggtgaattcatcaagacctcatttcgcatctgaggaggacatcgctactttccttttaaaacagaggcatccctgaagaattaatgctaggatgctgttcctcagagcaaggttgaaaacccgtgaattggatgacgaccatttatgtatgcatgattctaaatgagaaagaattttgttaacacttgggagttgtccttcagcagaatgaggaaaagctaagggaagtagaaatagattattacacagatcactatacagtctgacaacacccaatgcagacacaaaaatacaatgatgatctttgccaatgatgatctgttctgttctcctctcctacacattctgaagtttaaatcctggacttaaactgttctccttcatcctatttggatgggaaacccccaaaaaacccaatgtttgtgtgtttgttgctttgaaaggaatgagatggggaaggcatgtctgagcttagtgaacggagctggtctcagctctccaatccctggggtctacggacgttctctgctcctttgggaaacaggccaattcagaccactcttttccaggcttctcttaattgctgtgattctggctataaacccttcctgagacttaacatttatcctagagtctttcctaattaactctaatattttctagaaatcacttcccttctagaatgaactgataatggtttgtcacagaactaagttgcgtatcactgagtgagaatgatgtttcatctcctagatcaggcctggagacatatatgtcctaggaaaactctcagatacagaagaagtttccatctgtacctccatgaaattgatttttatttctttctttctttctttttgcaaagagaagaactgctcttaagtccctgtgtaatataccaattacttcaatataatacccttctaaattgcaaaaacattatcatttttcttgtgaatcattgtttgaacctagttagtatattttgataccaggaataaccagtctgtctgccaggggaagttacaaagatttcaagattgttacagcactatgagtaagtcctggtatgttgcctttgcatccacagaggagcactttcatttattaatttatttgtaaattagaattattaatatactccagagttaatagcccgaggttgatagaaaccacttggagggaaaactaatgcaggaacagaaaaccaaatactgcatgttctcatttataagtgggagctaacattgagtacatatggatgcaaagaagggaacaacagacactgggaaaggagaggatcaaaagactccctgtggagaactgtgcttattgcctgggtgatgaaataatctgtacaccaaacctcgctaacatgcagtctacctacataacaaacctgcccatgtacccctgaacctacaattaaagttaaaaaaaaaaagttaagggccaggcttaaaggctcatgcctataatcccagcactttgggaggccgaggcgggcagatcacctgagctcaggagtttgaggccagcctggccaacatggtgaaaccccatctctactaaaaatacaaaattagccaggcatggtggtgggcgcctgtaatcccagctacttgagaggctgaggcaggagagttacttgaatccgggaggcggaggttgcagtgagacactgcactccagcatgggcaacagagtgagactcggtctcagaaaatgaagttaagaaaaaataaatacctggtcattaaaaatctgtgcctaatagtatgccttatatacttggggaagaaaagggaaaccactcggagaggatggtgcagtgttatcagtttggtcctggaaatcagcatgatctcaaaattcaccaagctcaatcattaagtggccgctggtctaccatcatcaggggagcgtagcagcttgcgttggtttggccaattgattgagatccagttctaatgtcatccttataaatgtctccattgggagagggtgcttgggtttgctggacagcagcccctgctccctctctaagtaataaaactttctgggtttctggcatgcttataccttaataatccttgctgcctcaagacatgggaaaatgcatttgtaaaaagtgagacactctgtgtatgttggataacactggctgctttggaatcaaaccccaaatgctcagtgggttaccatattagaagcgtgttttccttctgtatgatgctctgaggctctaggctgcaggtggccttcctccatacagtgagttaggaccagatgccatgcctgacacctccatctcctaaaaccgtgggatactctaatctcagctggcagatggggaaagaaaggatatgaagaaggaatactcgcttaaataccatcagccaaaagtgacctatatcacttttgttcatgttctagtgccaagaatgtcatacagcccacccaggtacatgggggctgggcagcccttctagagcacagaaggggagcataactttgctggggagttggctgaccctgccacacccggttgtttagaggcacccggttgtttagaccctgccacaccgtggaatttagagacaagggtaagacctgcatttctggatcacctccattctcttacaactgtgctgggggaagatagggacttggcctttatagacctgaatgccagcatcagcaggccctgccctacagtggaaccatgtgtccttggaaccatggaattaataaacaccgtcatttgtactcttttcttctttgcactttccaataaggacattgttatgtgtttgtattacaagctacagtccctacgaattcacttttcgtagcatcatttcacccagaactattaataatgtctttaatgagactctgcctgaacttattgatttgaaaaccatcgaaagatcatttcttttttgataaagcacttcttcatcagccgcgttggcactgtacggaatggatgtcgggatggaactgaatgtgcctcacttgacactgcatatctgagttttttgatatgcattgttcattgagaccaccagtgaacacctgggcagatgtggccagtgggtgccttcttgtgggcacaagaagggcagacaaagccattccatgccctgtgacttactgttctgggctctcctttctcaggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggtaagaaccattcccagaacaaggatacaagaagacttgtatcctcggctaggcaaagaagagagaacttggaggaactgtacagccagatgaaagtactagaactcaggaaggaagagtcctatctgcccatcctgaacaagccccgtgagctagggtggctttcttgaattttaactattgcatggaataagtgatcacttcatttaaaaagataaataatcctatcgaagggtacagcattctcagcaagatgaggccaaaaacaataaaaaaaagtgtttagctttgagtttgacagagaagaaagccctggaattctagcttcaaatagctaataagcaccatttctttttcttcataaggtgtgctaccagaggggaatctgaataagcagcattcatttttaaccaggagcttcctctgcagttgaaattctgccttgctgctgcagacgcctctgtatgcatgactcgaggcttctgcctctcgagctggtagctttcagaagcaataagtgaaggcagggaacgtttttatctagcacagggcttaaccctgttttccagccaatatcaggaaatgtccttgttttaatagggcccaagataatcactataaaaattataaaagtcactttttaatctctgaataatctcaagaaggaaagagagaagacagcatgagacctcctagtaaaacaggtgccccttcgaagtctggaggaggttgtgtttagaataaatcaaagcaagcagttgtacagcaggcagcctccatgtgggactccctccccgagagtttatgcaagctgaaatagtagacaagttcaaggcaggcttagctaaattcacagatggacttaatgagggcttaggaagagcatctccaagggctgctctgaaagagggagtttagggtggaggagaaatcgtgttgagactggcgcatccggtatattcctgtgttcatcacacaaacaactggcaaacagaatgttcatcatatccccatcttcaagtctctgaggttttccataccaggaggaatgagcttggtctgacagtttctgcaagaacgctggaagtatgtaagtattgggtgggagtaaggggggatgtgatgtagaagtggtttcttcaaatgtttttatgcccttgccaaactcagaacttaaccatgataatgacattgtctggaggggtgtctaattttgctcaccatgagcagggaatggttgctgtgtaggagcaagtcctaattatagtgttacagaaactcttctcaagattagcagaggaaaacttaaaaccatcatgggttggggtatgcaaaggggaaattccttgtaggccttgttaatttcttaaaggaaaaaatgaattagtttaagtttctcacctttctcaggagaggccatgttggctgaaaatggtttgtctttgaacttcttatgattgtttgttcatctaaataaatttgacagctcttcatgaagccatgaactctcgggtttggaatgatttcgttagcagtcatttactccatatgccaccagcagcagccacatcactgctacaatcacgaccaccattgctaacatcaccatctccacaatcgccaccaccacctcctccacccaacatcatcaccatttctctcatgaccatcatcaccatatcactgccactgccgccaccgtcatcactacagccctcaccatcaccccactattgtaaccactgccatctccacagctactgccaccaccgtggccacaccagtatccacatcgctaccagcatcactgctaccatccccacccctatcattatccccaccaccaccatcacatcagcaaatgcttgagtgcctaaaatgtgtcagccactcatattctgatcctccctcttttctccatgaaggagtcatgcggcttgacagggtgctgtctcgccaggtggcatgttgcattatagggtagctttgattattacaaactccctccttgtacagagccaaactgcttgcatgcagttaccaactttgtatttctgcggttaaggtccttattttgtaggataacttcttgatatttgaagatagctctcattcccctcatccaaagttctttctttgaaagttacaggtgagccttttgcctcactttttagatttgcttttttttattttttgcttttcaaaaaatagtttcaagtagttattattagaaaataatagtttcaaggttcaaactcaaattgtgtttggcagtgtgacaacctatttacagtttccaaactgctttgcctaagaattttaggcaaaaagacttgttaacctgggttctttatccccctacccagtgctcaggccctggttattctgcatgcccttacatcagattgacctggccattccctggcccacagagggacccagtgtgttacgacatcagggaaggagtagtaaatgggatccgaaaaacaactgccagcacccaatggaaaccagcttctcccttgctcccagaaataatctccatcattttcaagaagatggcttctagtcttctcccagttcattgtgattaagaatctgtgtctgctacctacaacctgagaatgacaattagggctttgcagagaattctctaatgctttcattattctttcttctttggagacttggtattcattggctctgttggacttctctattgaggactaaaataatcaatgtagcagcagatgaagaatgtgtctcttctgagaaatatggtactgcagaagaaatagatcctgggtggtttgaaggcaggttgattgctgaagccttcccggacagggcattggatttatatcaacataaggaaatcctgacaactcactcattcttccagctaacaggattgggaaagcagccttatctccttgtttaaagtcaataggatgccagtagcttgcgaatatcttttaaacttagttatctttctcacattatcatcccctttgaagtcagagccatttggcatggctgcatttccatttgagctgctgcttatattactgggtgatttgagagaggggggaagatatttcttaaagaattttaggacccagatttaggatggctgatttaacatggaatttcaagaaaacttgtaatttggtaaatgtgtcatccatagagccatttagaccataaggaccaggatagcagtggtgtgcatttgatgacactgatttaaaaatgcaattaatggactactttttttaaaaaaagttcctaaactcttttagaattgtaagtccacaagttagaaacccttactgtcataaaagttacagctatgacttctggttgacagttttatcttattgtatatattacgcattctggatgtttataaagtcctcaagcaaatttaaaatttaataactttggaagtctgtataatagaatcaaatggaacatcaaatgagagcataattagagttttacataggatatagtttcagtatctgggtttgccataaatcttctggattattgacaaaattttattaattgcatttataaaactcatgataaatccattcaagaaagatggttttcaggagtaaagtattatattattaaactagtatgtgattagcttcaccccagccaatggtatataaatttttcaaagcatatcatatactggataaaataaaagaacattgataaattactcagtattaaagatctatgaactgttccatcttatgataattacatttcttctaaaatgtgtaaactgcagttacttgaatgttctcaagtacaaggacttcacttgataaatgcgtgcaggccttttgttgagaactgagcgaaaaatgtcaatctcttgtttttgttaggaaaaaatggaagcaatgggtacgtgtggagcacagcattataaaggagttactttcttttctcacttttgtttcagagaggacagtacatctaatgcttgaactatccatttaaatccctcgcaaatcaatgggcacagcccacaggcctcctgccggccacttgcttgttataaggtccatttctgactttccgagtgatggaattgtcaggccagacaacttacccgggctgctcaagggtctcatccacaaccctggcgagattgcagggaattgtggttgaaaccactggtttgacttcatttcctgccagtactctctaaatcaaaaaaggttcatttttgaagagtacagattgtatgcatctatgtatatttttgattgggtaatttcaaagtcctccagggatcctgatgcagtccactgcaatgagatccgcctggacacccctctacagagccccagtgtactgctgactagagtgatgtccccagccggccagcctatgttacaactgctttacctttcatgagggcacttgtgtgctactggctttttccagggactcgtagacccagttggttcataaacagcagaagctttgctttcctaacagacggaaacaggcaggtgtgcagttcaggagctgggccctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccaggtgagtcaccggagctacaacttgacccccaggtcgccaacaggttcaggtggttcagatctgatgcagggcaagcagtgtggctggaaggtttcccagcactcaccacagcacgcaccatccctccttctcacgccagttggtgttacccacctcttactgtttagcttccaatcttggggtgaaatgcacgcttcagttgccagtcacttgtgtttatttatttaggggctgacaactgatcagaccgataaaccctagttcaactttaaatgctccatttgtgccgtcagaggcacatggggttctactatgctgacaagaagagcaaggcgagaacaagtccccatccactgtcactcaggttcccccaggttcatcttcttgatcccgcggacatctgcctgctggcttgtcccagaagttttgtataaacaactcaatcttaatgtcctcccaaaagaagttgccaccaaccccgcccagccaagaatggcagttttatactctcgccattgctgctggctaggactgcgtttcttttggcagttccattgtctcattattcagagctgatatctgagagtagaagcctgagcttttgattcaacagttccaagggtagagttttatttcattttaattaagcaattgatcctgacattctgcttgcaggaaactccctcttagctgccccacgtgagcacggtgatttagaagtgcattataacatttaatgttcggctttaaaatagccttcatcctcttcctaatgctgattaacttctggggaatgttataagcagctggctctccctggctcccagtaactggtgaaggaaggtgcctggaagggagtcgggggaagggggaagcaagtctgagcctgtgcccaggggatgcccaagtaaggggagggaggaccacagggcaatgcctgattgtggttcacttttaggttatgactttttaacaattgctttcgacttccagatcttctagaagttggcaggggtcttatctctttgcgtttgaggagtatgcagggaactaagcccaggactcgcagggttccctagctgtgtagcctcagacgggctactctgagccttaatttcttcaaccacaaaaagctgagccattggtcagatggcttctaacatcctttacctctcccttgttcttctcctgttcttcccataaagcagtaaagagagagttccagttctatgatttgacgactgactaaaattgctatcgtgattgtgaccttaaagttatttttattaacttgcccacacatgccaacaccataaatgcaaatgtccccttgaaatgtgtcatagtgttgacacccagagacctttttcttaagaatcaaccaggccagcagccaacgcttccctccttcttcttcctctgaggtgccaagtgccagcagccagcttgtgtgtttcttggagaaccctgatgttgcatgacattaaccagaggctgctcttggttgtcccacccactttagagtggaacagtgaaccccagaacgagaatctgatgatttaatgaggtatctctacattagaagcaacttcctttgaaatcctcaccccttatgtgggacttatggccttgtccactccagcccaggagtaatgctgagagctgcctctccctttccccgggtgcatgtgtcataaatggccctctccttccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtacgtggccgccacaagctcggcatcaggagaggcactggcagacctgggctgtgggactgggggcatgtgctctgttttggttagcccccactcctggcgggcgctgtccacacagcatccggtgtgttcagtcgggagtgattgactcccagggagggtctgaggccgcactgggcatggggtgcacagaaatggacactgcctggagcctggccttaagaagctcagtgcggtccaacaggagctgcaggagcacctactgtgcgccccgggggatacagaagatgcaggagcacctgtgtgccccgggagatacgggagctgcaggagcacctactgcgtgccccgagggatggcagggatgaatccaccatgactcctgccctcagatagcatagcacgtagttggacagacagacagaactttcccaccaccactgagattttagtaatgcccctttgtactcataagaggaccccaaccaagtgaggggcccagggctccatggggaaggccctgatcagacttgaagcatgagtgtgtctgtaatcggaaggcctgagagcagcagtgagtggctctcaaatgggaaagtggggtggttgcgtcaaacaagagaccatcagttcaccatttcaccagttcaggctgggcacttggcacagtttgtctcttctgaccctccaacaagcccctgaagtggggactatgaagctttacagaagatgatgctcaaactctgagaccaaatgtcagtttccccaggtctccgggctaggatttgaacctgggttactgtgacccaatgcccatgtgttactcccacaatgcacagtcaccctgaagagggaggtgttgctctaaagctccaccaaagctccaaaatgaagcagaagctcagatgcaaaagggaagaatccatcccctgcgtgtctctcctccatgccccaccttctggggtcagagatccaaggcctcattgggcagccctggactccaaggccccgtcaccccagaaccatttgagattcaatgcctgtgtccagctcccaggagtccaaccgtgaaatccacaagtgcaggccccaccctgtcctgcagttctctttcccttatgataatgtggttgagtcctttgtcactccctcctcctgctggctgcagaaatgacctcagcccaggccagagaccccagctctggcaaggcctcttgtggtcggccaggcccaggctgaaagccaagcagaatcaggcaggatctctagcgggagggaaacctgataggacctttgtcagacttttgttgtgaggctttggttttaggagtgatgagggaaataaagtggaacagaaattgatgactaaacctcgaagcctgggttttcaatggaatgtaaaagccacgcccaggcatggaaaacaagatggatgtctctcggagctgggtcctgctgggaggcccatgtcccctgccagccagcgatgtcctctgtacttggagctttctgggggggaaaagaaagggcagcttggtagcaaggagggacgagcgcaggcctctttagctcggcctctgaggagttgttctgatgctcctcagcactcagggatgcgcgtgggcaggtgggatggggaggcctgcagttcccgggcccttagtgcttcatccttggaccctgagcagccctcagtcctggcatcatcgcctgctgggccttggggcaccctgggcaaagcagggggcaggagcagtgggggacaccctgttgcaatgacaaggactaagccagtactcgctatacacattgaatggtgtttgggcttgacatggtttagtgacttcaggcagcttttagccaactgaggtcactttgggactgcggctactgctgcaggccaaatcttcatggcttcaggcatccctagtgccgtccccgtcccagcctttctccagaatcagcagtctccttttcttgagttacaagggctgtgatgaagctcctttccaaaaagcattttgtggccagagcacacacaacacttggagctttgggagtgaaatgtgttccttaatgccctgccgtattcgaacagctggccccgtttccagagtgaggtcagagggaactcgacagtgctgtctgagccacccccattgtgtgactcagctggctgtgtgcctctgattcatggtgaccaaagctggtatttattatctcatcagtctagtccttctgtagctgcctgaccagagagagaaccagacaggcagacagactgacaacctgacccacagactgagcttttcaaaagcaagagcaataggaagtcacctgcttgggctctcatcatccccatgatggagggggaggctggaggtctgagcacccaggtagccacgtcctcttcctaaggagggggcttccctgggagctcctggcttagctctactctctcccacccactctctccctggtaaccaggaggcctttgctggggtggtggtgggtggtgtcgtgtgtggccactgcacacagcatggaacatccatggcatcaggactgttggtaacaaatgtaaagttttggtgaagaggctttatctttggctcagggttcctgaaagccacagcacagagaccaggcttgggaagccacctcgggcttgtgacttcctgggttttggtctgtcctgcccgcccctcctcagttcttcagatcattatacagacttccttgggagagcagagagcagggaaggctgcaacccactgtggcccttgatgccagggagctcttggaatgggcctttgaccacctcctttgggagtgcagtgtgctccttcctccccttgtcggtgtttccgcctggtttccagtttacaggcgctgtgtgagtttcccatggctactgtaacaaattagcacaaacttaatggcttataaatgcttcattttacagttctggaggtcagaaatcctgaaatcaagatactggcaaggcagcattgctttgggaggctctggggagcatctgtttccttgcctttcccaacttttagaggccacttgcattccttggctcatggccccttcctccatcttcgaggccaacagcacagcatctgcaagtctctgtccctctccgacttctgcttctgtagtcacatccctttctctgacactgactctcctgccttcctcttataaggacccttttgattccatcaggctcacccagattgtccagggtgatctccccacctcaagatcctaaaagtaatcacatcttcaaagtcccttttgccatgtcagataacatgtgcataggttttagacaaggatgtgggccttttaggggagccacaggcattgaacagaccacttactagcaagggaccttctgcaaattgctcaaccttgttatgcctcatctgtaaaataaggatagtgatctacctaccccaagggtctgttatgctccaacatagcctataatctattccatgtaatatatgtggttctatgctagatgcagagctcctagtaaatctaaactctataaataagatgcagctgcactcccaggaagcttagactagtgagcaaggtactcaaatccttggggtctgtaaaacgggctgtaagagggtcatgggccagatatgttggggtggaggaaagcagccaactaggaggctttgaagacaaggttgccgtggaatagtggtttgccaggggtggaagaggatggatatttccagtatacagaatagcaacagctcagggcacaaagggacagtggggccaaccagggcaagtgcaggtagttctgtgtgtgtagagcttgggctgtgccttgaagagcagagatcctcaactgccacaccattctctcatttgtcaagtatttgttgatgtcctgctgtgtgtaagatgctgactcaagagccccgactctgccagagtgacacacttcccacagtccctgtgcactcctgcctggatctggaggggagtgcggatgtgaatccttcacaatatcctcccgggaggcatggatcccggacaaatgcagtcctgggagcggaggtgacttcctcagccaggcccctggccagccagatataccattgagaacatttcaatgctttgttgtagtggttggtttgaattagcttttcatgattcagaaaggaaaacttattgtcaagtttgcatttgcagtatttccccacccaggagcaaatgcttcaggatctggatcacgtatgcactggggtcatcacaggcctcctgggaaatgtaggaactcagagctctaagagtccttgagtccttgccccaccggcccttgacatttgcaccccagtgaccttgcccgagttgctgagttgcccagaattctccagttacattcaggatgtccattactcaccctccagatctggcgacccaaacactgactggacgaagcccttccttccaactaatgattcccttttgaaatgggcttttctcaatctggcgttatatttcaataaaacaatcctgcttccaaatctttctacaaataaaacaacagaaaattcaaaacacatgcctgcaacttctaactggcaaagcaatacactttgagaatgcctttgggttttttgttcatttatttgttgttctaattgtttttgttgttgataacgtacgttctcgttggctgagagtataatttttttctcactgatttttgtcccacaaatctggtatctcaagacttcctatgttgatttcaaacatacaaatgttattcacagttcaaactgtggttggcgtttagctctctttgcccagtttagtcttaatatctacaaagattttctgtcaatatgacatgacctttactccttctgaaatatagctggatatttttgtttaggtagcaaatttacttttaccaatgttttttgtgagaaccaccagcatggttactgaaaatattccttggcaattaatcttacagataactacacatctatagtcacaaacaactggcatcagagaattcccgaaatgtgttagttttttctattttatcactcaccagaatctaatgtttggtttctgcagtgtgagctgaccagaccatttttatgggctggtgaatactcagtgtttatttgcaaatctggtttacatgagcttggtttattgtgacccacttggggcagtgcatttatgaatcacctacaactcctgtggccacagatgggaaaaaaagagatttttgccagaagtcttattgtttagaagtcaggaaagtctcccttttgtcccatcaagtgagaaagaaatgatcaaatttgttcatttggacttcattttctgatgaatacaaaggtctgtctgaagaagagagatgggaaggacaatacagtctccagttgtctgtaaaaatgcctttgtctgtggatgttagtggcaggggttagggaaatcagtgacacagggaaggaggagctgatttgactgaactggggaagtacatttgcatcgtggagtcattttaagtaagattagattgagtaaattgtgggcttaattcaagatgccatcatttctctttcaaaaaaaacataatgacattgggaacttccaaactacaattacaaatataagttatagcactctgaagataaaactggtaattaaaatccatcactttctacatcattataaaatatagtatggtgtcaaaattccctctgaaaggctaaattttatcttttgataatggcaaaatacctaagtgttccattattaaggactcaaaggctctacattgatgtaatatggtagtgataagaaaaccattgtcattctttctaagagatgtgaaatcgcttgtcttcatgaagacagacattttttaatgcagcaactttgaaccaaatctctgcctttgtaacatcttacaagtggatagaagtcatttgcactttttaaattattgaccactctgtctctaagataaatgccagatggcagctaacgcacaaaagccacgggaagcactctgttggcccctcctccgctatcctgaccgggatcagcaggttctggacaggcagggcgcgcagagagttgcctgcgggctccgtgcctttgagcctctttcctttaatgatgttttctttcagtgctggagctgcatctgctcccaaggtcagcactcagccccctttggtttccctgcttataagttttcttccttaactttgagggaataacaatttacctttccaggaagtaaaacgtctgtctttttatgaccttacataagatcccacagtaatacttcatttgatgtcaatgaataagtggaaatccagagtcatagaaaagataaaccagcagacagcgttcatttacccaggctgctgtgtttgcagaaccacagttgacttcctccgggaagggcattggagacatgatgtgctttccccaaatggcttttcactcattcgttcttggaacacatctgctatgcactggcccgaggcagcatccctgcccacaggtaggagccctggggcctctcaggaggcaaaagcaagtgtggtaaatacaagaggaagacaaccttgggaggagggaaaggagggccaatccctgcctccatggcaaagctgggggcagaggagagccctgaaggacacgggagccctggaccctgatccagctggctcaggcatcgagttccaaggaagacactgactcccctggcttcggtcgtgtgcccagcattgacccgatcatataacctgtgggatggacctctctgattcaatcttatgtgcatacctctgccattagataggaaagttagctccaattaactataaaaaatggatttcccatggggaaaatgttctcgttcctagaagaagggatatgggagaggtgttcaacaaaacaataaccctgtgtctcctaccccacaatccgttttcacaaagtgctgttgctgctccaagctcccggagcaacctcctaccacacaggtagatttcaccctggaggggtgtggccagtgtgtgcttctggaaggagttgtgctgaatcactctggcgaccactagctggcagctccctggccccaggaagtggcccagagcccaccatggtaccatcctacaacctaacattggagtttggggcagcaggggcgtgttgcaaacaggaccaagttccggccgctgcgtccttagaagtttggttcatttgaaaccccttagcctttaaacatccgtgttcctcatgggagatttctcattacagcctggagactccagggtaaggcaccctggccaactggataagagtaagcactgtaaacagggctctgctccatcttcctcccaccttccttgcaaaccctcaccaccactaccaaattaaagcagcagcagtttcagagggctgataaaaggaagcaaaagatcgtatctattggggctacccgtgagttagccacttttcttcattctccagggaagagaatgaacaaagtagatgacaggggctggagtatgcattcgggcctttgattccatagagaaatgcatctgtcctatccccgtgtttacatggctgatgaaatcatagcctgcctctcctgcaaatgccccttttctttgccatgtggcagtgagccctatcattgctgtgcctcagggacatcacgtcctggccatatttcagtggtaaagtatgatatggcatccctcactccctcatgttttgggtgaaagctcaaatgaatgaaactcttagaaggtgaccgttattgccttcctggaggtagacagaaagttaacctttagaacctcgcatcgttcaagccactggatgaattaatggcagagtggagtcagttttactggccaaacttcactgagatttatttcttgaggaactgctccctcagaggtttccaagtcattctactccgaatttttcatttctttccctgaatcagtatagatgcaacaaaaagcatacaaatatctgctgcctgcctccattgtcccagttttaaagggaaatctcactaagcatgctcaggtgcagggggtaggccgtgacccaggtcagttcagcacctgagacatgagcatgaggcagctgtcgtcctcacctgtcaggagattttttggaaaaagatttggtgaagaagaagttgactccatgagcagctggattacaggagaatatgttggtggttccgaagaggaaaggatggcagggacaggagtctatagtcaagtagggggtttccaagaggaaggcagcacaggatcatggctggatcatgggttttggctttaaacccatgagacaaacccaactttgccatttacattgtgatcttcggcaagttgctaaaacgctgagtctaagtgaaaatctctgaaatggggagaatgtagaccttacagggtggctataaggatcaaagatgataccgcgtgctgtatccagcaccatactttaattacaaatggcctgctgatgatctaaaatgtatcgttcatttaaagtgtgtgtgtttgttaagagcaaggagagtaatgacaggaaaatgatctttgttctagggttgagtggcataaagagaagtcagactcaagggtctttgcccagggttgcctgctgcctctttcaatgtggcactgggtgctgactcagggggagtctggaagcccaggccaggagggttcccagaaccagctgggatttgggggccgtggggaaccacactcattgaaaggagtaaggggatgggtgcagggaagttgaaatccttgtgctggatgataattctgatttatatgcaaaggatgtgcaaaaactattagggtttcagatgagattctcttctttccttctcatttcctgaggcatctggttagcccacagtctccactagttgcccttaatgtgtaaggccctggagaccatgaagtgtgagggagatggatgtaaagcccctactgacgtgatcatgaatcgttacaggtgtggtaactgatgcgagcaggggctggtacaaggaactctcttctccccacacacacccccagccctaaagtccagaagccacaccttccccacagtccaaggtggtcttcattatcacttgggtttcctaggggtctgccacatgccaggagctctacacactgatgcacctccacagcacctttgagtcaggtccttgtccccattttacagatgaggggacagaacctcgagagcttgtacaacaaggccttttggacattgaatgccagatcagcccgagttccaagcctttgttcttccaactctgaagcatggttactgagtagatcagtcagacaggagggggcaatctaaaaaggctgaagactgataggcattaggtatttttcttagaccccatacatgcccagctataaaacaaggcttccccctgaaagtagtcagcaaaaagaatcgctaaccactgacctgtcactctctcagccacaccttttggatgtcgcagagcaggtgggaaggcgctttggcgctcatcatcctgcatccacgcaggttcatcaaggctgcctgacaaaatcaggtttaaaaaaaggcaggtgcatctatcacatgcttaaatattattcttcggctgtgacttcatcccattttggttattctggtaaaagagcttttaagggttcactttcataagcaatagagtgggtggttcagttgtggaggttatgaatatacacccactgggctaatagagaaagtgctcactttctctattaaaaagtgttggaagagtgggtacttgaacctagaaacaagatttccagcgataacataacagaagaaaaaatgtcagcatcttgagaaagccggaagtgcagggaatgtgccatggaaagcaagaagactgagaccaggccaggtacggtggctcacgcctgtaatcccagcattttgggaggctgaggtgggtgaatcacctgaggtcaggagttcgagaccaccctggccaacatggtgaaaccccatctctactaaaaatacaaaatattagccagtcgtggtggtgggcacctgtaattccagctaaatgagaggctgaggcaggagaatagcttgaacccgggaggcagaggttgcagtgagccgagatcacaccattgcactcgagcccgggcaacaagagcgaaactctctctcaaaaaaaataaaaagactgagaccaaaggaaacgtcatctcagtaaaattgttccacggtgtgggagaggttttttttttaagacaatctaaattaaaatgtgattcttttaactgtttctcattaagttaattgacagcatattataagatgatgcttgactgtgtcatctgtgttggtaaaaattcacatattcgaattggccacaagcctttctgagggtttgtctttgggagaatggcggtgctcctgaaatgccaggtggccttctgctggggcgtgtaccatgcttctgcgttattggtaaacaaggcattgcatcttacacacacctggttttctgagctgtgctgctccaccagcatttggggcattacaatcataagcacaccctgtattagtctgttctcacactgctataaataaataaatacctgagactgggtaatttataaagaaaaaaggtttaattggttcttggttctgcaggctttacaggaagcagagtagcttctgcttctggggaggcctcagaaagcttccaatcatggcagaaggtgaaggagaagcaggcacatcacgcggccggagcaggagcaagagagagaaggaaaagggaggtgccacacacttttaaacgaccagatctcaactcactatcccaagaatagcaccaaggtgatggtgctaaaccattcaagagaaactgcccccatgatccaatcgcctcctaccaggtcctacctccaacattgggaattataattctacatgagacttggtggggacacagatccaaaccacgtcacactctgacccagaaggctcagtgtgtttcagctttggattcccaagtagagatccagtgttttcacttccagaatgcttttatacttgattacacactgtttccatgcctttgcttgacttcctatcataacgatagccctttatctggtattcacgtatcaagcttcccctttgctttgccagtacatttgcagcctcttcaatccctgttgaggttggtctctttctcgtcctctctctctcccccttcctctctttgtttttatccttctgtactccccagtccaacctcgtccaactctcctcccaggctcctgttgagctgtttgtgagctcacgtgtctgaaactgcccaaagtctctttagagctccctataaggaaaacaaatgtatcaactgacatatttgaattgtgtcatggtatatgtattttttaagtggtcacaattcccaagaaagaaattactttataataaaggtagcagaatctaggacatcagaatagcattgcgtgcaatggcacagtgatgtcaactccacccacccatttcctaggagctaagcagtcactaggagctgcttgtatttccgagtcctagccttatgaagtagggaaagaagcaacaaagccatttcctgccccattttcttagcccttccacaggcagctgcagcagcacaccccacatccactgaacctgttgttgcttgggctgcagggccaggtcttaatctgctctctacacctgagacccagtgcagggtccagcacctgtgaggatggagcacaggagggaacagcccagaagcctggcttcacccttagatgatcctgccttcgttacctatgtgaatctgagaaatatatttaacctctgatgtgctaattttcttgtccataaaatggaataatgagacctaccttgtaggattaaatggtaggattcagctcatgatgtcttctctaagaggtcttccttgaccagcctgcctttaaaagcaacagtcccctgaaccctcctactctgtttctaccttcatagcattccctaacactgggctttagaggaacataatcatttgggtcttttttctgtgtctccttgcaattttcaagcaagcaggaggtttgtccagtttggtccctcttatactcccaatgtctggaagatagtaggtgctgaataaatacatgtgtctgattgaagcctgcaacatgatggctggctggctggctggatggatggatgggtggctggctggctggctggatggatggacgggtggctggctggatggatggacaggtggctggctggctggatggatggatggatggatggatggatggatggatgggtggctggctggctggatggatggatggatggatggatggacgggtggctggctggacggatggatggacgggtggctgggtggctggctggatggacgagtggatggatggatgaatggatagatgggtatataaatggatgatggaaggaagtaggaagggaaggagggaggaaaaagagggaaagaaggatggttgggagggagatagagttaggcaagcaacaaatacatagggtgtgtgcaaaaacacaaacaattgttgaattgttactattctagatgccagtttttccaaactgctttgatcaatcagatcccagtactttgatcaaaagtgctgccaaacaggattaaattaagcacaaagtgcaggttccacactgaggctctccctccccatccttccctgctctgacagatagacgaaagagaaaaagaaggcagaatgcggacaaatcaggtccccaataggagctgagtgtgtcggtggtgtcatcctactgtgagcaaggcagatgtggaacagatggaaggaaagggcatgtgatgtgaggagctagggacctcatctttctccatgacagagaattgtgtccagtctgggctaatgcccctgaaaaaagagattgcagaggcttctctaacatggcttataaaagaaatgagaaaaggagaggtgcaaggctggctcattgcagagattggagcactgagcacactgttcacatcaaatgatggcaaggtggtgtggcacatgtgtgttgaatgagatgatcatgtctgctagtagctgatgagaagggatcaggtgcaggctaacgaagggggatgtttttagtaagaagaacatcttctgttccctgggacgaggtatcttaaataaatccgttgtcaccttggaaagcaaagcctccccagggtggagagcagagaagggcaggagtcagagtgaggctctggagtgtcggcatcctggccatcagaagcgatgtgagataaagtgccaaacaggacaccaatcagggagagaaaagggaccacgccgcagggcatggtttgttctaaagaatgtggcatgttttcttgacttgctcaatagtcttcaacagacatcactatgtccaggattcaggagtcctccagaactttggctgcaaatgctgattatatgtgctctctccgtggctggaagatgtgctaaaaatggccatttctgagctctctggctgccatgaccctctttgctgggaaccgtcatgttgtacatagggattaccagggtttatgactccatggcctctgagagaaatctctgccttgcaaataaaatagaaggtattaaaagaaggtagtactttctcttatagggagctttatgggactaaaaatatcatagaagatatcttcattgctcctttggagcctgccctggcttgcatttcctcaccggaattgtgtgggatgttgttaaagagagcaaacttccccttctctgcagccagccagccagccagccacctcctttctgccctggatcagatctcattccacagccaggcctcatttcctgagaggccacacatgccacaagcccagagagcagacctaaggaagagtaagcattggaacatgtgctctgccagaggccgagtcaagagaggatgcgagctgctgacaccctaggcttcccctggccagctcccaccatgagtcgggacagacactgggtgtgattgctttgagcacgtctccccgtaaccatttgagaggcctacagccatgaaaaaaaaaaaatcacctgcaggagatgaaaatgcagttctgcttctgtttcaggtgctaaacctgcccctgggatctgctttgagagagtcaattctgcaggtgatccttatggcaactgtggcaaagtctcgaagagttcctttgccaaatgcgagatgaggtatggaatccagacatcctggcaaagtctttgctctgaccttcccacattgcatagggttggttccaaatggtttctccttgggaattgtttgttcttacccttccagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaagtaagacccaaatgtttgcttggatcataaatgtaagtctggaacagggcccattgaaaaacagcaagaactgggttacaaggtttgttggttttcctaaatctacttcttctcagatgcacctagaagaaaaagtcaataaatcctagatcctggtctgactattaaaatgcagattggggaaaaatcaagcctgtcttcttaggccttgagtgttaataagtcatttctacactccaggtggcatgaggacttctagccaggaaattactttggaaagaaatacaatcgcatattctattggttttggatatgtggcttggtttttagcacagagttcttgggggcttgtcctcacctgaacagaatgggaaatcagatgtatttttagaaccctgtagagagaagaataggagagggaaaggagtggaagaaactcaaaaccagaggggagtcctttcagagaacagggagaaagatacatggagatattttgaggtttagaaataaagtcaaactttttttttttttggaagaaaaaaagaatttgagattttcatgctctgccatactgattttttttttttcaccaaactttctcatcagactaaatgacagcaagcgaatacaatgttttaagaaaaggatgaaacaacccccaaatgcttcttaggactccattttcaacatggtcttgaaatcactcactaacatgaggtcacacaggcaagaaaagacagaggcagagacagaatcctgaggacaggtgttgcctccactctcctgtctttggccccacacaccctgagccacaaatcctttttccttgagaaataggatcgtacatgaatcttcttatacattctgaatgtctccttacccacatttgctcatattcaggccttgacattaaaatgacatctgatatttttaggctcaaatcatattttgtcttttaacttttaggttcaggggtacatgtgcaggtttgttatacaggtaaacttgtgtcatgggggcttgtggtacagattattttgtcactcagatactaagcctagtacccattagttattcttcctgatcctctccctcattcaccctctactctctgataggcccagtgtgttttgttcccctgtatgtgcctatgtgttctcatcatttagctcctacttataagtgagaacatgtggtagttggttttctgttcctgaattaatttgcttatgaaaacagcctccagttccatccatgttcctgcaaaggacatgatctcattcttttttatggctgcatagtattccatggtgtatatgtaccacattttctttatccagtctatcattgatggacgtttagtttgagtccatgtctttgctattgtgagtagtgctgcaatgaacatatgagtgcatgtgtctttatgatagaatgatttatatttctttgggtattacccagtagtgggttggctgggtcaaatggtaatttctgttttaggcctttgaggaacgactgcactgttttccacaatggttgaactaatttacactccgccagcagtatataagtgttcctttttctccacaaccttgccagcatctgttgttttttgactttttaataacagccattctgactgacaccttttttttaaactgtagcctgaacagccagggccaggtgcatctggacattccaattccaagggctcaatttatcatcaaatttgttttccacgttcaagatgaaatgtgctttgatctcagaaccttggttctctgagggctcagggatccgcagtgattcccatgagggtcctgctgtgttcactgtaatccaggacaggttcttttatcagctggaatgtgaccatccccttggccaggattcgcacccaccgagtgggaatccctcagtgctgcttgggccagcgcttctcccaaaggctatgcctcttgcccttatatgagctgttggggtcggatggtgacctcctcaataggaaggttctacttgattaaaaattcttctgccatttgaacgttagactctttttcctttgactccacggatttgtaaaatcttataggagataaagggctgcatcccttgagtctggagtatattatgcacatttgaaatgaggctgagttctttcagccagcccagtatcacttaggaaatgcctaccactacaacagcttgataaattcaaggagccgtctgttttcctctgctgagcctcgttgctgatggtttatgtcattgatgatactacttgtcagtcagtatctggaaaaagttcccatatttcaacctctcccttaaaagactcttcaaccctggattcttggagtctccatctatgtctatccaggccctgggataaggagtaatctgtctcgccctcccctatatcttttttttttttttttttttttttttgagacggaatctctctctgtcgccagactggagtgcagtagcatgatctcggctcactgcaacctccaactccctggttcaagcgattctcctgcctcggcctcccaagaagctggaattacaggcacgtgccaccacacccagctaatttttgtattttcagtagagacagggtttcaccatgttttccaggagagtctcgatctcctgacctcgtgttctgcctgcctcggcctcccaaagtgctggtattacaggagtgagcaaccgtgcccaacctcgccctctcctgtatcttttaatggaagaaaaaaatactgcagtacatagatttctttacaagctccaaacaaaactcataagaaaatcagttataattttaggatcaactgaaagttatattaaaagccataaaatgcaaaataatttaatagtgttgacattgaacttagtctcaaaatgtgctgagtttggaggagtcaggcaataagatccatgcctgagtccagtataaaatgtattgttatgctccatccgtattaactgagacaaggttgggtcttctccaagctttcttttgcttgctttttgtttgaatacaggtatgtatgcatgctggaggggttggagaaatactaagagatttgctgtgttttcctcctcctacagatctgcctgaatcgtcaatgtcaaaatattagtgtctttggggttcacgagtgtgcaatgcagtgccacggcagaggggtgagtaggctgagctgcccttttacagccagcccataacaagttaagtaataatacattcatttgtaaaaggttttgcaatccatagcattttttaaatagagcagttattgtgtttgaaatattttcttctaaaggtattcatttcttttgaccttttcatgtgacttttatttaacaaagaaaatcagactgagctgtaattaccttttaaattaacattctatgattttaaaaaagacttttgttgttcaaagtaatttgaaaagcaaccttccttcatgaagagtttcaaaataacatttcaaactgtgctgttcctcttactaccaacattcagaaccagtgtctgaactgaaatatttccaaaaggaattaaaacaaggacaacagatcatattaaacacatgttcttgaaatcacacacaatgggtttcaactaaagaaggctgttattttagttcagagaacctttagggtagaagaggactctaattgctgaaaacataatttatttttcttgatgggcttatttccaatggaatcatattagtcttgattaaccacaccagaggttcatttgttttcctgaaacctttcctacagaaatcctgctccaaattctttattttaaaacttgtagacacttgccaatgattcttacacagaattaccgggtgcatggggggagggggttgtaaattaccatcatgctggaaccataaaggatcacagtgtcacctcagatgggggtgttgacggtaaggttagctaactcccaatatacaatggaatcttcttatgtcttcattggatcatagattattttctgatggctgttaagagatgatcaagtccagtcctattattttactgaagaagccaggccctgagctgtggggatggtgtgcccaaggtaatatggccggcaagctgcaagctggttgaggaccctggaccactccctttccaataccccttggccttatccacacatgggagcggagaggcccgcatttgctgggtaggtggagcctacccagccttgctgaagggtagcttggccacagtcccaccctaacaagggcaggctcccggcagcaccttcctgtgggttttaaaacaaggcgcatgaccacaagttgcagagagaagccatgaggggcaggcatgaatctggggctagtacgtccacagcagcatctttgaggggacaggcaagacacttacatttgacataggctctgccacttgctgacaagttctactcaatttctgctttatagcagtctactttctaacttattaaagcctatcttgacagtcggccttcttatctgaagcaatgagggtaggtggttgattcatcaaaacaagtcggttgaagcaggaaagcattacatgggagacatatactctacgcattttattttgccttaaaatatgaaagtgtatatctggcagccatattttgatggcgggctgaggcctttaggattgatttactgaatgtcattgtgcatcgacttcctgatataaaccacccaaaaatgcatcatcaacaacttctagttcgtttctttttgtggaagggaaccttagacactcaacagcatccaagaacagcctcctccttgtcctctgcagctcttcccaatcattgtgcagtagtcccactcattcctaatttttcagaaattcttttagtgatttctcttttttaatccagtgttcccaaaggattcaacctaattttttttaacttttttttttttttatctttataaagacagggtttcaccacgttggctaggctggtcttgaactcctggcctcaagtgatctgcccaccttggcctcccacttgctgggattacaggcatgagccaccgtgcctggacttgacaacctaattttcatagaaaaaaatatattaaatatatatcatcttcatggtcatcttccattggatcatgtactttcagttagttacatctggcataatagcgagtccaaccagcatggacaggcttgggagtggccgccatcagtagcccttggtaaccaggtgggcaggggctgctggcccctgcatggaatgctctggtctatgagctgggcccaacaagggtgaagcacagcctcctcgggctttcttggtctccctttcccgccgtgccagaaccattctcttatttcacaatgaaaagaatccactgttggattcgcaccctggtgcgtgactgggagccagggaacagccactgggaacctctgcaagaaggaggcaggcgttgcaggaaggacacacggggacaggcttcaggaagtattagtggaaatcccatgcaccctgctaggattgcaggaaacaggattcctttgctcaggaaacagggggcctgcctcggaccccagcctggcgtgggacccggcagtcaccagcctctctgagccttctgtctgaaggagacagggatgcgccaagcatctgtcaggtcccgcggtgccccagggctctgggtctgtagccccaaagcacggtccctcctcactgctgagggggcttctcctcatggtcagacagttttccagattgaaaaaggaagatggggagatggagaaggaagtgaggtgggtgggggaggcaagctgatgaacccaaataatcttcatcactctctttacagccactaataggcagatgatgcatcttcacagcctcaggtttggtcgcccctgtgtggtgtgtagtgccggctttgggcttattcgcaccatggcgtgtgctgagtctggctgtgtcagtgttgggggggggctctgaccatggccccccttgcttctgctgtggtgatgcacagagcatatgccctaaccccacgtccctcccctctgccctgaaaggtgtgcaacaacaggaagaactgccactgcgaggcccactgggcacctcccttctgtgacaagtttggctttggaggaagcacagacagcggccccatccggcaagcaggtcagtgaagcccctgcatcccggtgggaggaggctgagcacctgggggcgggtgggctcgccagctgtcagcatgggtgcaggtagagccaacaagaaacccagtggggaccccacatgggtctacacagcctagggtctcccgcagtttccagatgcccctctcatccctgcccgatcttctctgaggctccttgctctctgctttgactgagtggctgagtttgccagttccttagcctgcgacacttttcttaactaaggtcatttctatagtgaactgctgaatgggtatgaatgtcatcactgtatcaaagtactttgtaaaggccgacatctgtgtggtagggtgacaaggtgtgaagtttaatgccttttaaaaatcttactggaaagacacccacctcttagtaaaggtgacagtcacggcagcagtgggagtcattgcaacagcttttgcatatggaatgatgtgtgcaggtgctgtgtggtgcattttatgcccacgatgtcatcccctccttatacaactctgaagaaggtggtatgattcttttctcacatacctaggacctgaggctcagggaagttaagtaatttgcctaatgtgatctcgctaagatttacacacacacaggtctgcctgtcccccaagaagctcttagtagcagctgtgcttgaactcgtggccatttctcctcggatgacctttagaaatggtttactggtgcggtgctgttttctctgagttcttattgggcaattcaggggcaagtctaaatgatgcctcttttcgagggaaagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcctccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacactaagcaagaatgacatggcgtaagtgaggggtacgactgcagggagagagggcatcatgggaggggagcaacccccacagagcggcagggggttgtcaggaaggctcctggggaccctgcatctgttgaggtctgaagggggcgagggaaacatgcattctgaagccgagatagctggctgtgcgaagatctagaggagtgtggactggcctgggctcagattctagagtgcggactgggccaacaggaggggacacaggacacggtgctcgtgctggtcctggggaagagggaaatggagtcagtcactgcccgggcctctggcttgagcaaccctggggagttcagcaggttcagtgtgggggccctgtaaatgttcagtttcatagattgatgtattgaagatttatggattcactttatggaactagaaattatagttcaagatttttgctgttcactttttaaattaactttaattaactttgttatgagacaccagaactctagctagagccccctgtgatcactactaagggtctgaaaagagtgacattttgcccaggaaaccagaagcaatgcttttccagtaacaccaacaagtaagtcaagactgtcatctgttggctgtcttgcttaggctaagacacatccctgataggccttgttagtgggggatggggtccagaaaccaagaaggtgtgaaagacattctttccctggagtaggagctgctgctgcagtgatccacagccagctgagggtccaggtgggaggcagggccgaggagagcccaggtaactgcatcacggcgatcaccagcagccggaaaggactgttgcacacttacctgatgtgaagtacaccctgatccttgctgatgggaagacaaatgaatcaagatccctgtcctctaaaaattcactgtccagttgaaatcacaggtagacctcctctaagtctgagcatttagagtccttcccagacagccgctgaccatagctactgtaagaaaccaacctgatggtttgatttttttccttcctttccctacccttgaggaggctcttaactgtattaaacaaaatggcagcaggtcatagaaaagaagatgttttcatagagaaaatagcttcctcccaggaaaagggtttcccccacaaaggctgtgtttttaagtccccaacataacaaagcaaaacccatgggtgtttcatttaaatgagttttctttctcttttttcactatctactttgagatgtccagcaagaaagcaattcattttttaaaaacacgaaaagagataaagcagaacccaactacagaatgagtaaagaaaagcactttggaatggcaaatctgtgctggggactggaaacatttgagcctggggatggctgtgattccagtgaggcttcagtgatggctccctgctaccttctgtggctaccatggtccactgtgccgttgtcacgcctcagggaacctgcgtggtccagaccatcaccccacctacccgactatatattcctgtttagcaagttctagagttgtcagaaatgaatgatggtaacatagattgaacctcaaacatggcatctgaagtaagacagtttattagtacatcactcacgggtgtactctcttcatttctgttgcttcagagttcactttgccataaacgtcacaacttgatacctcccatatttcattgtaactgcctccttctgtgagccccatgtgttttgtttcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtaccctgggtttagcttgtcatctgttctagaaatggtggctcagaggctgggtgcggtggctcaagcctgtaatcccagcactttgggaggctgaggcgggcggatcacgaggtcaggagatcgagaccacggtgaaaccccgtctctactaaaaatacaaaatatcagccgggcgcggtggtgggtgcctgtagtcccatctactcgggaggctgaggcatgagaatggcgtgaacccgggaggcggagcttgcagtgagtcgcgatcactccactgcactccagcctgggcgagagagcaagactccatctcaaaaaaaaaaaaaaaaaaaaaaaaagaaatggtgtctcagaaaatgtacagcaaactgcttctcacttcatttttttagcaaaggtcagattttctggatcataaacctgggacttggttcttttttggggggtttcttgttttaaatttctgccagatcagctgcctcctttacttcccttcaaacaacaatgtgctgcttattacataagctagcagggtgtcaggaaattccactgatgtgttttctcccacccttatattagtaatttttatacaacatggagacattgaaatattttcatcagatggggtagcttttgatccaaatatattcaaagacattatcgctgaaatgccagcttcatacaaatcatcttccaggtgtcactacactgcatttctatggagcgtgagaactaatttgacaaaatagaggttttgagggaaaaaccagtatttattttttaatctcctaagagtgttattaggtaatttttcctttgcatgtttagcacactgagttaagtaaactgtcttttgagtgccactatgagcaaagtgtaaaaagtcaagtcagtgagaaggggaaacacgcttggtcagcaggtatgggattctgttgcaggtgtgtgcgcccttcccggccaccccgtggcttccaaccctgtcaggctcacctcggccaccttggaaaaggcctgatgaggaagccgccagattcctacccaccgaaggtgagtcttgagtagatgtgagtgctcagggcacacatgcagacatgaggttttcaatacgagactgaataagaatgggatcctagaggcgctgcctgtgaaatgctgagtcagcctcactaggtcagcaggctctgagggagggtctctgtgatctggggccagagggaggccccacggtgcccccatggaagcccacctagatcctgttggcgcactcagtgccccctgcatgatatggtgcagcatagtgtgagctgtgatcccttcagtcacccagaccagccacatttctggggccccactgggtctgcagcccgagctggctcctgacaccagcccccaatgccagccccaccatggtttccaaatgccaccacctggctttaggtgagctgctttagcccactgttactcttaaaatatttttcaaaagttacatggagctctcagaattgaccattttgctccagccctgagctgaggaagccctgtccaccctgtggtttcagagaactggatccttaacccagagtacctcacggctccctgctgtctcttaaccctcttgctaccctggtgaattacagctagagttcattctaatagttcttccccaccgagtttttctgatgtacccacaagaattcttgaatattgaacttagtcaacaagagtccaaattataacagtgaacaagattggtgtcaaaaaaaataagtgattgaaaaatcattgctgcatatgcagtaggcaataaactgttttaactcccttgatccaaaaaacgcaaagggtggggctccaaggaggaggctgccattcccaataagctttacccctgctcgtccccaaaggtggaaccataagcgagaacggctttgtgtggtagccaaaagcacatcttcattttcgtaaaaaagaaaaatgcagctctattaaaaaaaaaaaaaaaaaagcacagccttatttttgagagccccaaactagaaacaatccaaatatccatcaaccagtaaaaggataaacaatggtatatttgcacaatggaatgaaccattgatgtatacaacattgaggatgaatctctagataattattctgagtaaaagaagaaaagccagagtatatactctgtgatcccacttatatacaattctgacaaatgcaaactgatagtgacagaaagcagactgatgattggagggagagggaagggagaagcatgacaagaaaactctttggggtgatggatgcattcatttgtccacttgtttgttgtgagggtttcatgggtgtaaacacgtcaaaaaatgaccaagttgtatactttatgtcaactatacctcaattaagctgtttttagaaagagaggaaggaaggggtagaagcctgaggtataagggtccctgcagcacctgttctaagaacaagggttaccatatgggagaacgtctccaactccaagccccaacctcagccctggcttcctgaagccgcaactctcctttccccagtggttttctcagttctcattgagccttgaacacattaagctgtatcttattttcacatctcttttgtaacttccctaagatctcggtccgtgtctttctttatacttggtactttttcaagtgctttgcacctatttgttaaacagttttttaaaatctaaacaaaaatcgatccttctattccagatttggcggggtggaggcaggtgatgcttctgtttgaattttgaagtttaaataaatacaaaaataattcccctcttgtgtacatccttgatttctttcctttaccccaccttggccttcagctataacagatgagttagcactgctttttccttaaggagttactgatatttttgaaacccgctatagcatggctttttactttgactgtacaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggtatgctttcagtactaatatgataggatgtagttcaaatccagattctgctacttgttaatgtgtgagcttagataagttgcttaacttctcggtgcctctgtaaaatggagataattcagctactcagatggttaaatgagataatccacataaagcagttagtttggtgcctggagtataataataagagtgtcatatattttaatttactagttataattttttaagtatttgaatagttagaccactcatgcaactaaacgatgacactattgagaatagcagagggactagtaataattaggcctgtacagtaaaatagagacaggcaatctaagacagatggtcaccctaagaagcatcagttatactctctcatcattttatttcaaaattatttacaagaactataccacctatatacagagtgtctccgtaccaaacttagcactgtattgtttatgtatatcatctcatttttatgctgtttttggaagtaaccatttctgtttgctgcaataacgaatgatatttcacaatagaaaacttgaagggaggagaaaacaagcaaataagtaggagataatcactggtaatttttcactgctattaatattttttgtttataattgtgtattttaacataatttatttgtacacagttttatatgctgctttgttttgccttaaaaattagtcccatttacaatggcattaaaaatcctatttaataataacactatacttgaatataaatgtttaagtacttgcaaattattgggcatgtattgatgtatcattttttgctgttagaaagttctagagaggtaaatcttgggacctctttattcccctaggagagattcttaaaagtaaaatattgggttgaaagattgtatgaccattttaagcctcataatataaaaatattttttcagaactcatatacatttgcgttcccacattgttattgtctttctcaccatgactttgctaacactaaattttaacttttaccagtttgataaatacaacaaaatatctcaatttgttgctgtctagtagttctgtcagttaccaagaggagatgttggacttttccactataattgtgtctcctttgagttcatcagtttttgcttcatgtattttgaagctctgttgtttgcgatacacacaattaggattgttgtgtcatcttagtaaagtgacccttttatcattatgtcatgtctctgtttagctctggtaatctttgttctaaaatctactttatctgatattattatatccactccagttttattttgattagtattagtgttgtctttttgcaatcatgaatgatatttcacaataggaaacatcattcatgattgcagcaaacagaaatggttacttctaaaaacaggataaaaagcaaagtatgaatttttccatccttttaacatacctatggaattacatttgaaaagcgtttcttgtagacagcatatagattttttcatccatttagccagtcactatattttaataggtgtgtttagaacattcatatttaatgcaattgttgatatgtttggatttaagtctaccatgttaatattattctgtttgttctctctggtttttgtttcattgtgctttttctgtgttcctgtagattagtattccatattgatttatctgcatttatgtttttgagtatatatctttgtattttttttgtatgattacactagggcagtttctcaacctcagcattttgacatattgtactgaatactctgttatgtggggttttcctatgcattgtagaatgtttagcagcatccatggcctctatcaactagatggaagtaacatgtgtaattatgtttccaaacattgccaaaatgtcctctgaaaggcataacctcccttgattgaaaaccactgctctaaagattacagtatgtatgtacttactttatcacagtctactagtcaatatttcttcactttaagtagaatacagaaactatcaccttttaggtcgcttttcctcttccttttataatacagatgtcttaaatactacctttatgtgtactgagagtcactgcagatgttgtaattttgctttcagccaaacataatctttaaaacttaactttgcttattattttctgtctgaaaaactttctttagccattttttaaagcaaatctgtaggtgacaaattctcttcattttcctttatctgagaatgtatttattcctagaggatagttttgctggatatagaattctgcgttgactgttttctccattcagtactttaaaaatgttgttccccttccttctggactccatggtgatgagaaatccactaaaagttctacccatagtctctgttccagggaagggatgtggcatgttattgcaagaagtgatagaaagtagagatctgccagtctctaggctatgatgcctggtgaggagcaggagggaggcatggcttttttcaagtgttgagctggagtaaggtcaggtatggtcaaaacacttctgtgtttctggactgctctttctctagtcttttggctcgagatagcaggcttttccagttgtgggcctatccagagcccaggccaagatatataaaagaacacacacacacaaacacaccactgggtagttccttgagttctgagatccctagccagcatactttatgtccagacatttttgttgcacttagcaggagaaatagggtgaaatgtacttattccaccttgtccagacctcatttctccttgtatttttttgattactggtacacttgaactactttttatgtatccattagccaatggtatgctggcaaactggcccttttaaaaaaaaattctgatttacagctgatttctctggtataaaacttcccattgtggccagtttcaagctactagtgtgacattactgaatgaggagtagggaactggcagttatgagccagtaccagccagctcaagcataccactgctgttcactgtatttgttctgtgacttgtcttttcctatcctttgcctatttatttctgtttgagaggtagaggttttcttcttggtttataagtttcttttaaaaatattttaatgtaattttagttatgattttttggcataagaataattctggttttgaatattgaatttttcttttgtgaattttcccattcctttcatgcttgcaaagtccactcccatttcattattagtgaaagtccatatataatttcttctgtttattgacagttcttttacatttgtttttctaatttgttttagatttgcagtcatggaaggtggtgagcatgccctaaacttttctggtccgtggacttgagaatctgacaaaagctatgaactcataaaatgcaccaatattagcattttgtgtgcacatttcaggtagccaaagagcagagaagctcctttcccatgtacccctcatcctgaacttttttatttattttaagcaactcacctgtgtaccatgtcaaactggggctaacagaccatgttatcagaggaaggtattcctactgctggtgtttttttctccaccagcagggactcttgcaagatttcctttaaagcaggcccgaaaaagtccttcattctgttttatgaaactaaggaaatgttaccctttaaacatcagtcactgaaaaatccacatttctcactccaggctggtgtctgtctggaacttttctaagacatatgatatagattaagtgggtgatttctctcccatcacacatagggaacggaaattaattccatgcaggtgtggagaatatttggaggtgactcttgtttggcagcacaaattgaatccactgacattttgtactttggggttcctcatgccctgcccaggacaacgtgacacacagctaatcctgcttcatttgtcccaatgtactaagcattccagaagaaaacactaccacaaacaccatcttggtccacctcacatttaaactgtaagctaggtctttatagaaaccatttcattttctataaatgttctgtttgacttataaatgaaggagagctgaatgaatgtaccctcttgtccacaaacatacctttgcaatgtaccacttccttcatggtaaaaggacccttggaattcaagcttctcatcctaactccccagtcttgatcaaggaaacaaacttttttcatcccatcagctatattagaggaaaaataattcagtgtattcatctagctgttcactgcatcttaaagaaggctctatgcattttctgcagaggtggagatcttcagttcagtgatgctgtcaaaacacaacatttctcctaatcaacaacttttatctgtctgtattatatgcaacatataatattttataacacaagactcaccagtctggcacagtctcatctaagaaaaggctactttgtttaagttgccatgggaagacggtggcagctattacaaggaagtccaaattcctcttcctcctcaaacctttataaaaggtgatgaatgatgagctggggctgttactggtaaacagcagctactccttcaaatgcctggtcaggatgcagatgtgagcaaagccaattaatttaagccacgattgtagatcagtcaggtgctggccagttcagaggttaagtccaaactttcaaactgttcaacaaaatgaatttggctccgaatggataagggcatgtgcccttctggacctgtgtgggtgtctgatattgaaacctgcacttgcagagcctagaaatctggggattaggtccttgctcatcagaaatgccaatttgtaatgagaaaaagaagacccatttgttagtatgttctcctgaagaagatgaaatacaagaaaactgagttttatgagagcttctgttgctacacacaaagcacaggctaataactggtaaaggtgctggtgagtgtccttctgtgccctttccctgcattccagatctcaccctcccctaagacctctccacagtcctccctccaggacctctgatcacctgctgccgtagcctggagttaccagtatgccagctctgccctacttctgaaggcatagactgatcccaggcacagctaagtccagcccctcgaacataatagatgtgtaggaaatatgctgaattgatgtggacttaaaatagtaaaaaatcagttgtcacagtgtcattctccatggcgccatcacactcagttacggattaatgacaatgagtccattccccctgtaaatctaaaacacagctaccaaggtcttggactctccctgccacctacccaatacttccagaaactttagctgaactttctttggcatcatatactaattattcatcagacacaaacatcaaatgtctttaagggtatcagttatccacggaagcatgatctctccctgaagggaacttctcagaacatgttttcaagggaagttgttcacgtgattacagggttcaaaggggtatttgtttcccacttatttgttactataaacatgaaaattacataaaaagcagatgcctgatattttagcctttacatttgctaataggtaatataggcctataattaaaaatctcaacagtataaagggtcattcggaaaacagtctccttcacacctgtcaccagtctcccttcccagaagcaatcgtcactgttactaggcttttataaaacgcaatttgggatacaatgaaaagtctcagctctaccccccacccacctctctgctaggagagattatggaaattttcaaacactcaaaattggagagaagagtacagtgaaaccctatctacccatcactcaacttcagcaaccgtcaacttgctgtcactcatcttacatccttgttttgaattcaaatggcaacacattatgtactttcttctactttggttattccttattagttttatacatctgcttcattcttttcactggctacatcattatttgtgaagctataccatgacttctttaacctgtcccttccagattcccagatgggttgttttcaatcatttgctacgtcacacaggcataatcttgcccaagatggataaattcctgaaagcacaattgctgtgcaaaagtcatatgcatttagaaatttgatagactgagtgaagctgcctttaaaggagctgtttcagctattctattatccagctcctcaccaacacagtgtgttcggaggtttttcatctctttgccaatcgataggttaaaaacagtggtctccatgtttttcttcataggaaatacttcatagtgagatgaaataccttttcacaggtttaagattttctttttcatgaactgccttttcatctttgccatttttaaaatttaagatcggggtacatgtgcaggatgtgcaggtttgttacatcggtaaacatgtgccacagtggtttgcagcacagatctcatcacccaggtattaagctgggcatccattagctattcgtcctgatgctttcctcctccccctgccccattgtgtccatgtgttctcatcattcagctcccacttaataagtgaaaacatggggtatttggttttctgttcctgcattagtttgctgaggataatggcctccagctccatccatgtctctgcaaaagacatgatctcattcctttttatggctgcatagtattccatggtgtatatttaccacattttcttacccagtatatcactgatgggcacttaggttgattccatgtctttgctattgtgaatagtgctgcagtgaacatatgcatgcgtgtataatagaatgatttctattcctttgggtatatacccaataatgggattcctgggtcaaatggcatctctgctgctaggtctttgaggaatcatcacactgtcttccacaatggttgaactaatttacactcccaccaacagtgtaaaagcattccttttgctctgcaacctttctagcatctgttaactttttaataattgccattctgactggcatgagatggtagctcattgtggttttgatttgcatttctctaatgatcagtgatgttgagctttttttcatgtttgttggctccatgaatgtcttcttttgagaagtgtctgttcatgtcttttgcccactttttactgttttcttgtaattttaaattccttatagatgctagctattagacctttgtcagatggatagattgaaaaactttctcccattctgtaggttgttcattctgtgtttcttttgctgcagacactctttaattagatcccgtttgtcaatttttgctcttgatgttgtcatgaaatcttttcgcatgcctatgtcctcgatggtgttgcctagattttctcctaaggtttttatagttttgggttttatatgtaagtctttaatcgatcctgagtttatttttgtatatggtgtaaggaaggggtccagcttcaattttctgcatatggctatccagttcttccagactatttattaaatagggaatcctttccccattgctttttctcaggtttgttgaagatcagatggttgtaggcgtgcagtcttattcctgggttctctattttgttccattggtctatgtgtctgtatcagtgtcttcacccgggnnnnnnnnnnnnnnnnnnnnattggtctatgtgtctgtatcagtaccatgccattttggttactatagctttgtagtatagtttgaagtcaggtagcgtgatgcctccagctttgttctttttgcttaggattgtcttggctatttgggctcttttggggttccatatgaatttttagttttttctaatttggtgaagaatgtcaatagtagtttgatggggatagcattgattctatttgggcagtatggccattttcatattgcttctttctatccataagcatggaatgcttttccatttgtttatgtcctctgatttctttgagcagtggtgtagttctccttgaagaggtccttcatgtcccttgtagctgcattcctaggtattttattatttttgtggcaattctgaatgggagttcatgatttggctgttggcttgcctgttggtgtataggaatgctagcaatttttgcacattgattttatatactgagactttgttgaagttgctcaagaagcttttgggctaagacaatggggttttcaagatataggatcacgtcatctgcaaacaaagttagtttgacttcctctcttcctatttgaatacacttcctttctcttgcctgattgcccttcccagaacttccaatactatgttgactaggagtggtgagagagggcatcttgtgctggttttcaaggggaaagcttccagcttttactcattcaggatattagctgtgggtttgtcatagatggctattattttgaggtatgttcctttaatacctagtttattgggagttttttatattatggggtgaattttattgaagactttttctgcatctattgagataatcatatggtttttgtctctagttctgtttatgtgatgaatcacatttattgatttgcatatcccgaaccaaccttgcatcttgggacgaagcctacttgattgtggtggataagctttttgatgtgctgccagattctgtttgcctgtattttgttgaggatttttgcatcaatgttcatcaaggatattggcctgaggttttttttttatctctcccaggtgttggtaccaggatgctgttggcctcacagaatgagttagagaggagtctcttctttccaatttttttggaatagtttcagtagaaatggtaccagctctattttctacctcttgtagagttcagctgtgaatctgcctggtcctgggttttgtttggttggtaggctatttactactgcctcaatttcaggactcattattggcctattcagggattcaatttcttcctggttcagtctcagagactgtatgtgctctagattttctagtttatgtgcatagaggtgtttatagtattctctgatagttgtatttctgtgggatcaatggtgatatcccccttatcatttctgattgtgtctatttgattctttatagtctagctagtgatctattttagtaattttttcaaaaaaactagctcctggattcactgatttgttgaagagtttttcatgtctatctccttcagttccactctgatcttggttatttcttgtcttttgctagctttggggtttgctcttgtttctctagttcttttagctgtgatgttaggttgttaactttgttaactttatctttctagctttttgatgtgggcatttagtgttatacctttccctcttctgctttagctgcttctcagagattctggtatgttggctctttgttctcattagtttcaaagaactttttgatttctgccttaatttcattatttacccaagagtcattcaggagcaggttgttcaggttccatggagttgtgtggttttgagtgaatttcttaatcttaagctttaatttgattacgctgtggtttgacagactgttatgatttcagttcttttgcattagctgaggagtgttttacttctgattacgtgatcaattttagagtaagtgctgtgtagtaataagaatgtagattgttggttttgggtggacagttctgtagttgtataacagatccacttgctccagagctgagttcaagtcctgaatgtctttgttgattttctaatattgtcaggtgggtgttaaagtctgcaggtctctaagaatttgctctctgaatctgggtggtataagatgcacacatatttaggatagttagctcttcttattgaactctttaccattatgcaatgcccttttctttttttgatctttgttggtttaaagtctgttttgtcagaaactaggattgcaacccctacttttttctgttttccatttgcctggtaaattttcctccatccctttgttttgagcctgtgtgtgtctttgcacatgagtttcttgaagacagcacaccaatgggtctttcttcattatctagatgatattgggccagatatgaaattctgggttggaaaatctttaaagaatgttgaatattggtccccaagctcttctagcttattgggtttccactgggaggtctgctgttagtctgataggctttcctttgtaggggacctggtttttctctctggctgcccttagcattttttctttcattttgaccttggaaaatctgataattatgtgtcttggggttgatcttctcatggagtatcttaccttctctggatttcctgaatttgaatgttggcctgtcttgccaggtaggggaagttatcctggattatatcctgaagtatgttttccatctttgtgggcttatctacctttgatcttcgaggttgctgacacctttggatgagatttttgtgggtcgttttctgtttaacagtctggccactcttccgtaaggctgctgcaatttgctgggggggctctgttctgcccgcctcttttgggtaccccaatcacttgtagatttggtctctctacataatccggtatttctcaagacgacctgttcattccttttcattcttttttctctattcttgtctgcccatcttatttcagaaggatagtcttcaagctccgagattttttcctctgcttcatctattctgctgttaatacttgtgattgtgaagttcgtatagtgtgttttttagctctaacaggccagttatgttcctctctaaactattttggctgtcagctcctgtattgttttatcatgattcctagcttctttgaattgggttaccacatgctccttcagctcagcaaagttctttattacccaccttctcaagcctacttctgtcatgtcagccatctcagccccagcccagttctttgcacttgctggagaggtgttgccatgatttggagaaaaagtggcactctggctttttgagttttcagtgtttttgtgttgattctttctcatctttgtgggcttatctacctttgatctttaaggttgctgacctttggatggggttattgttgttttctgtttaacagtctggccactcttctgtaaggctgctgcaatttgctgggggtctgctccagaccccagtagcctcagtttttcttgtaccacttcccatggtgagggttcccttggctccgtgtcactcccaggtgggccattgcctcaccctgcttttttttttttgttctccatgtgtctatttgtttcctgaatcaatcccatttagtgtataatcaaattttatttttttctagatgaccacctagtaatccttaataccatttattttatttgtccttgattggcctatgttttattagatttgtctggtttctcattctcccctaccttcaaccagctcaaagtcttatatgatcttcctcttgctaccattagatcttggaaacatcactttaatgtcccctctacaaatgtgaaataatagtacttgcttttgggactttgtgacagttacatgaaaatattattaagaactttcctctaaacattgctttacaccttgctcactggttccaatttgtagtgtatattttttaaatagtctatatattctcttctgttttcctccttagcccaaagattgaagttattttttaaaatatttaaaatatagaaaagtaaaaactaaaatttactcacatttattctacatagaaataactagttttacatctttctagatgtacatgcctatttaagtttcagatatatatcctttttcaaaagaagtgaaacattaaagtcactacattagcctccctccagatacaagcactgtcataagtttgcttactgttttcaatatttttgtataaatatgtatccatgaatatagtgtttcgtgttttaaactttacgtaagtggtatcaaactgtacttaccttcatgcaatttgcactcatctatgttgtactttttttgcttctagaagttctctttggttctaattcaactatgctagcttgtcttgtacttctttaaacatagtaagaaaactttttccaataatacccaaatctgaagtctttggatatgttactgctgaagtttctatcacttctcactcctggttccttgtttccctgtatgctttttttttttttttccatgagttcacttttttaaattatagttcttcaaggcctaggatgcaggtgtgttcttccataaagggctattttgcctctgccaggtgcctggaggcagtaccagtttgagaccactttaaaatggcttggagcttattgaaatacccaggtgatgtgatttcagcttcaagtcctcaaggacaatttgtggtgacaggtttatttttctccctcggtctgtccagcaccagaagaatgctccttgtagtatcctggggatagattatagtatgtatttacttctagaagattcttaacctgaggtcttgtctgtagagcccaacttgaatggagaggagtcaggaagagaattctctctcattaaacttggacatttggtttctgcccatatgtcttgaccttggttggatttctctattcctcactgtgaaagagtatcaaaacccacatttaggtttccctaacttggcagatgcctccatcttcagttactactccctctccaagctgctgctttcacttagacttaaaacatttgctgtcttgtaactcttggtggtcatcagagaaggggtagggcacaacaacagagcctgccatgttactggaaatggaagacccgcctgtcaactttggcgagttccatgatacctacattagggtttacgacatttatattctgatctatagccataattcccacaattgtttttagctagaggtagaccgaatttgcacagtgaaacatattgatgccgccccagccctgcatgagctcgtcagggatctctggggcatctctggcattttcctgtgatgaattccagtcttcctgcagagatttctctggataagcagggcatgtttactctcgtttaccatgtgaagttgataacagctgagacttcatgatgctggtcaaggcaaagtggttatatctggatttaaaattgttttgaaacctctaaaaaatttgaaatatgtggctattgccagaacatgagcagaatatagaagaatggaacagccctatttaatagcatattaatagcatacctggatttttcttcaatatctggaagaagttaagagggcataaaaatgaggtttgaattcatttccttgtttaaaatgaaaatagatttaaagaaatgtttatcgtgtgtgagcaatctgcttagagtcatttctcagctcccttcagatgatgcttggtgatcacactggacttctctgggagaggttcaggtttaggttttgcaaaggcagaatgaaaagcaacacctagaagacagcatggcaatttcatcccttcctccagggtcaaaatgtgcagctggtgcttcttgcatcatgggttccacacctccatgcctaatgtctaaggagtgaaggcacatcttcttggactaacccccactgttccatggccattctgtcccagttaagccctggcaggaagccagcatcttacctaggcaacatctttgcttgcaacctgtctcatgcttccatccaaaccatgtcctggccatggctggaggaagcagatggtgcctgcgctgatccccaggttggaggtcagacccttcaatcagcgtctcagtcatttgggttttcatcactatggtgaccatataatttatcttctaaagtaggagacatgcctgagagagtgtgattaataattaaacaggacgataaacataaattgggaacgtcccaggcaaactagaatgaatggctaacctaactatctcctatgtttccatgataaatccaaatatattgtgatacatacctcactttttctccagcattgcaataaaaacctgacgttattctttattgccaagacagcttagtcatacttagcagcaaaactagtattgctaattatttcaatttgatgagtgcatacatccatttttacatgacacactaatgtcttgctcacagttttctgttatctataggaaggggagcttgatttgttaccttagttaattatccaaagtttgttggtagggttatggtgctttttggtggtaaattcactccattaataatagttgtaatccagcagcagctaacactcatgggttatattgcatgccaggccctgtgctaggagcctcaatatctcatttaaccctcacgtccacccgggaggaagggactatgatcatccctgctccaccagtgaggatactgtgtgtgtatgtggaactggttgaatatataaacaatccatgctcttgggcacattatatggcctttattcctagctagggaattttttctatttaatgtttcttttaatgaaaactaatgtagaaatatcacttctaagtctgtcccttgttcagggactttttcctagcccaatgtgtccgttgttccaactcagcttatcttccacacacctgtggacacttgtgatttacaaacttctgtggtagcttcctttgctttacaaagatatgttaaatggtgattatattgttgcattctttcagctgagccccaactgctaaataaatgtaattttcatatgataggcactgtgagagaaattcaactcaagtgtttgaaatcattgttgagtgttgctagatatatactgggtcctatgatggtgaattgaagcacttggttattaggggtgttctgtctccctggaggttctagcaccatttccaacagacattctgtgcattcatgagtgtttccgggcttcaaagacaagacatggcacccacattcacctggggccaagagcagagatgtgtccaacacttactgacttctggacacagctccaatgaacccctctctcatgggtatccacaggaggggccccacgaaaaaaaggggcatgtgttcttacattttttttttttttttttttttgagacagagtctcactctgtcacctaggctggagtgcagtggcacgatctcagctcactgcaacctctgcctcccgggttcaagcgattctcctgcctcagcctcctgcgtagcctgggattacaggcatgtgccaccatgctaggctaatttttggtatttttagtagagacggagtttcaccatgttggcctggctggtctcaaactcctgacctcaggtgatccgcccgcctcggcctcccaaagtgctggagttacaggcatgagctaccacgccccgccgtttttcttctatttctactaaacatttttaaattgcggcatgaaggaatgctgatattaataactattatctgtgtgctgggaacttcctatgcattattttctttaatcctcataacaatgctgagataggtctttttccccacattttccagagaaagaggtcaagtgacttgcacaagtcccaaagcatcatttttggctaaaacctagcgtggaacaaccccaccttccctggccagctccctcacactggcttctggtcaacacagccctgccccttagtgtgtttacaaagcttgacttgcccctcagaccactgcatcaattctctgagcttatgagaaagtatctagtggaagaacttcagtgcatttcgcggagccttcagagcaacatgtggaacagtgcctgcacgtggcagactgagcacaaccatcctcaccgtctcatccacccacagatgaacgagtcctgctatgtgatgttggcaaaactgaagaaacgaatgtgatgtttgaaaagattttcaccaacttcttattttagggtgaacagagaagccgcctaactaaaagcacaggaaagtgtgtatcctcagggtgacactgacagagaaaccccaacatcaacgctaccccagggcccaggggcagtccagaagccccatagttgagtgtttataactacgatccatggataagtcttaaatgttacagaaaattttggcaagaagattaacagaggtcagcctccacccaccttgtatggtgagaggatgatattcaggaagcagggcctgtgccaagcggcaggccctgcttctcaggggcctctgctggctcctggaaagtgaccctgcctaaccctatgtttattgcaggggacctgtaagccaaacccccctcagaagcctctgcctgcagatcctctggccagaacaactcggctcactcatgccttggccaggaccccaggacaatgggagactgggctccgcctggcacccctcaggtttgtgtgacatgccatgcccatctctttctctctcaaactcttgtgggaccaaccacgactaatccaagccaggacaggggtgcagtggtctaggccgtgcttcctgctccccctacaactgggaataccgtaaaatagacatgacaattaccaggaaggaagcagtccatgtgagcttataatcacaggcattggcacacagtgcctatcaacagccacagtggacctaagagagcaaatcaagatgtcataaaactacagtacctcagaaagccaggcctgtaagacacaaagaaaaagaggagctaccaagtagcatgacagtatgaagactggacacctgtgttagtctgttctcacattgctataaagaaatatcgaagactgggtaattcctaaagaaaagaggttcaattggctcacagttctgtaggttgtacaggaagtatggcagcatatgcttccggggaggcctcaggaaacttacaatcatggcggaagggggagccagcacttcacatggctggagcaggagaaagagaaaaaggggaggtgccacacacttttaaacaaccagatttaatgagaactcctatcacttagaaccaaggagatggtgctaaaccattcatgaaggatctagtcacctcccacaaggccccaccttcaactttggggattacaatttgatatgagactggggcaggaacacagattcagaccatctcaatgcccacctccacaactctcagcagaatctgcccagttcctgaggtcctgagacattagtcgggttggaggcatacggctggagcaagggacatatggggagtaagggaaagcagctgcctggcagcaggacactgggaaaacagggacaatgggcaaaaggaatcacctttcacagcttatcctgcttggtccactaggaaggcagagacctcaatcccaacttatgctgggaggctaaccccatggtgtaggggagccagcttaccctggttggtgagagataaccaatttccaggaattttgcaagctaggtgttaaacctagccaatattaaggattaaattatacaaatttatgatattttatattagaaacaaaggtaataagtgctcaaaactcacttcacatttttctccattttgctataattgtctgtgctcttgagattgcactcatccattatttctgtatggcagaaaacctaggtcatggtagctgcctgcatctcttccatgtttagtgatgtcaggtggtagcttgaaaccagccacaggaggagtatttacaccatggacattggcaaatactgcaaatcaggctttcctgcccccaaccccatgggctgttcaacatttaccagcacacagatgagttaaacccacagccaaagtactcttctgacacacatgccctcttggcaggaagcctgctttgtgagctcaaaagaaccaaaggtactgtgttggccaggccctgggttcagtaatcctgtatctctgaaggagaagacacactggagtgatttcattacagctcttgggaagaatgtttggcccgtgaaagaaagagctgcttaataaatgtcagagataaaggcggtcaaagggtcaggacaattgtttaattcccaacttcataaatagagaaaaattgcatagcatcctaattatttcattgtggtttgcatgttgatcttgaagttatttttcttgttctatttgaggaagaaacactactttacatgaaaacaatgaggggaagccctttttcttaaatgccctcaagctgtggccaatcttacctctggtcagttgctgattttggtcctgtcctgcacatttcattttttagggatactgggtgcccacctttgctccctgttctctggagctgtgctgtgggatgcagggactgctaggcatgttgcgcctggtaaaagtcttactgtattttgaagacttagtaccctaaaatgtcaactatccatttttttctattgatgatgacctgttgaaataatcctctaggtatactgagttaaatgtattactaaaattaattgcacctttctctttacttttttcatgtggctactagaaaatttaaaatttcttgtgtagctcacattttttctgtgggacagtgctggtctagagttgacttgtgggtgggaagtgcggctttggagacaggtttcccacccccgttatgaggggcagtggtatctgacacagaaaacccttcagactatcagaatacatctccaaccccagacctctctatcctcagaatcacttctcaaggtctctgatcatttttttttctcctctcttcattcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagggccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggggcatttttatgccttcttaactttatgagaattctcaggctgaactataggccattgttcccaggcaaatcaatacatcaatgcatcctcaaaaaaaaaaaaaaaaaaaaaaaaccggctaaaactgtgtcaaaatgttcttaaggagcctatggtctccacggtgctaaaaagagcctggtgctgggccgactggcagggctgagcatcctcctgccccctcgccactgatgtttactaagcactctgagccaatgagacccccagcagcagaaagggcacaaggtggcgccagggcagcagggccagatctttctcatgcacctcgacctcttgcagactttcttcgtgagatgtactactcatttcaaaactgctttgcagggctcccctatgtattcggggggcccacggcacactcaggctggagatccttcctcactgcgctcaagatggcctcagccagacaccagttacccagctgaaagtcacaatccctcccagaagtctcccaacactagtgctgaccagaggtggggctctcaggctaggagtttcacacacaatgacaggctgctgggggacattgcaggaccccttttcctctcctctccatgctagaagccagccctaggcagctgcagttactccctgtgactcagcagcaggctgattcaacacagctgcccacacaaagccagtggctaatacatctgtttacctttccctatcacccagacacaagcccctttcccaggtcaaaccacaggccgatgcatctccagtttgacagtcaaatcactacttccattgctactttagatcagccaaagtggtgactgctgcagtgtgtggctatccctacaaggcccacccaagggatgcccaaagcccaaccttctccagggctgcagcccagagcaaccccaccagcctaagtccagcagaggacctcccacccaatgtcttgttctaattagaaggggaagttagccacagaaaatcaacttatctataattacaaaattctcttgactcaccttaaagttcctattgacatctactgcttttaaacctatttgaaaactctgatactaaaacaaatgacactctaagaaagtttgggagccccatgctgagaaccatttctgtgca

SEQ ID NO: 16653 - DNA, 28932 bp, Human
atcgtgtgcaggcctgttcagccaaagtaaggatttatgatctttttattcattaaggattatgtaaaaggttctgatacaataagcgtccaattagttaagcagaccacaaccaagtagaagttactttttcttaagctctataacaaagtgtacaaatctgaagtgaacagctctatgaacttaattttcatgtgtatcattttaccaggtagtacatgtgaagatttataaccttcaaagagtttttctttcatgtttagagctttagaatgccttacttttaatgatgtgtactttcctggattttaataagtttggaactcttacatgcctcttgagttgtgtttttatttgtaaatacataaattgtacttgcatggcatttaccagtttacaaaacagtttcacatatgacctcaaaattctgtgtaagtaatgtagggaattatctccattttacagataagaaaacaggcttggagatattctctctgtctgtctccccccaaccctgtctctgtctgtctcattaggtggcttttggaagaagcacacctgtgcacacacagggtgtggaccactgtgtagccagcactggggagttttacattaccactgtgattctggaagaagctgttttgctctttcaggattttgttcattgagaataccataattgtggttgatagcccctatgttaattgcctctgtagtataaatattgtaatctgttgctttattgcagtttccacaaacttgaaaataaatcatctattgaaacaaaggatgtggaggtaaacaataaggtatggtatactttgtctttaaattttgaataactcctctttattgaattaagatgtaagataaatattttaggcttatttctgtattttatcaatatttaaaggcaagtttcctattatataaatatgtacaccatagtgatacaatcaggggtttttgagaattacttcatctttttttcaaaaaggatgtggcagtatctcagtgtaaaatcatgtggattaatcatgcctctgaaggcacaggttttagctttatgtgctgtactctaatagggcctagttatctatctaaggaggattttttttctgatagtagttccccatttaggcaacaacatgggctgaattatttgtaatccgaaaaacatccgtcgtgtccaactcgtatttatgaataatttttagctttctttaactgcttctagcctctacttaaaaaaatgtgacttcaggtattcattcttacagaaaacattaacaagtgcagatttaaaataatacctccaccaccaccattttcattttttttgaaataaagtcaaccttctcttcacccacgtggccttattcttgggttattcccagtgctgtgcccactgcctgtggacagtgggttttagtgactcttggaggccttccctatttctgtgttcttttgttcaagcctaagagttaggatattgtgactgcagttccgacgtgtagtggccatagaatcattgaaacatgtgcttttaagtaactcacttctgtggtatttttcaaaccagagtgactgtccacttggagttactaaggaaatagccatttgggctgagagaataatgttttctgatttgagaagtctacaactcaagaaaaccatggaaataaaggtatttgtttttcttcaatctccatagacacagatccagagaactgtatttattctcgtttcctatttttgagttcatgcggtagctacaaaacataaacattgcaaaaactgcctacaatgctgtttgtgtcttagttacaaagctttaagaaatttacatttccttgtgtgccttatgaattattcctcttttttttatctttgaaagggtacggttaccgaattcaaacacccaggggacttctacgtgcagttatattcttcagaagttttagaatacatgaaccaactctctgccagcttaaaagaaacatatgcaaatgtgcatgaaaaagactatattcctgttaagggggaagtttgtattgccaagtacactgttgatcaggtaacctgtaatgaaatgaattatttaaaacgtttgagctaactttggtcgtatgaactgaacaccagagcttttaatgatgcatgacaaggcttaaagccagcctctgatcacgcttctattcctcttcagtatcccgtgctctgttcaccttgcttcctccctgtcttactcctctccaactctgtttacgggttcctgaattgctagttgtagcctgatggctagtcttagagcttgtgttttatttaggtattagtgtgtgatagtctcatgggatagaagtagctttggaatagttgtgcatattattaataacatgtcctaactagacaattttagggatttcttagcaagattcttaaaaaattaagttggcttattaattgagtgcctcagaacaggagcctttcctttgcacgttctatagattgattgagggttttttaatctaagattgtgaaatgctgttatgaagcagagtactattatatttcactttcagacctggaacagagcaatcatacaaaacgttgatgtgcagcaaaagaaggcacatgtcttatatattgattatggaaatgaagaaataattccattaaacagaatttaccacctcaacaggaacattgacttgtttcctccttgtgtgagtctcttttactttctagatttttaatagtgtcccaaaggagctgttgtcaatgttttgatgggcacagtgtttgcttgttctattctgctgtgttactgtacctgtactatgtaaataaacactcatgggctatcttgaccttatttagttaactactgcccagggtgagaaactaacatttttaggcacatgttttcaatttgctcttcaaaataatcatttctatattatagtatctaaaattggtcttaatttatgtataattgaaggataattattctttcataaatttctccagcttcaagtaccaaaagtaagcgttatgaatacagtactaacagaggctaataataattatacagaaaattgtctatctgattagtacttgaagatttgtgataagttttcagcatgaaatacattcttttatatacaaataattagaaaaaatcatttttaaatggtaatttttgtaagtaacctgcgtaaaatttttcaggccataaagtgctttgtagccaatgttatcccagcagaagggaattggagcagtgattgtatcaaagctactaaaccactgttaatggagcagtactgctccataaagattgtcgacatcttggaagaggaagtggttacctttgctgtagaagttgagctgccaaattcaggtaagatctgtctttttaaattgagtacttaataggatatgtagtttccacctgttactcagaagaaacggaaacatcaagtgaggccaggtaaactgccctctggagtcattcagattgtgactgaacccattcttgaaattggcagtttgtcaaagacatgacacaaattcatagaattaggtggctggctagatttagacttcatgtgggtgtaactacgatccctttaatagagccattataatatctactcctgaatattggcccctttattgagaaaattcttgaagttctctgaattagtttgtccttatatcagtgctttttcttggagtaaccttcacggaactgcatttggctagtacatagtagctaagctgtggaaatggaaatgctttagaattctcttcttcccttctggcctttcacctgtttgataaatgacttctcacagtgtgatgggtgcctcccagtttccagggtatcacccctctgctttcagagatctggcatcatggctgatttggtagaaaatcggctaatctcttgtgaagttaagtaaaaatctgttgtttgctatgtttcatgttacaatctcagcttttgcatattatttcagggaacttgaagtttgggtccatgctgaccattctttcagccatacttatgtcttaaattaatttcccacaaacagtagtcattctaagcatatttgtgaggtggtaaacaaatctttcgtgttcttcaggatttcaaagtgagatctttttgttaaaatttctgtcaaatagagggtagaatggttaccagaggccgggaagggtagtcaggggctgggagtaggtggggatggttaatgggtacaaaacaaaaaatagttaaaaagactgaataagacctactattcgatagcacaatagggtgactgtagtcaataataattgtacattttaaagtaacttagactgtaattggatgatttgtaactcaaaggatgcttgaggggatggttacctcctctgtggtgtgtttatttcacatggcatgcctgtttcaaaacatctcatgtaacctataaatatgtacacctactatgtactcacaaaaattttaaaaattgtatttcagagaaaaaattctgtcaagtgactacagtaattttgcctcagtgttttaagctgggcactaccatagcttacccataggaactgaattggcaaaacatataccaacctattaatagctatgaacgtgtgttgtatgattgacttgtttcttctttacgcttttcccataattctttgtatagtttctcaatggaggcatattttcttaatcactttttaggaaaacttttagaccatgtgcttatagaaatgggatatggcttgaaacccagtggacaagattctaagaaggaaaatgcagatcaaagtgagtatagattgatattgaacggtatagcgacttcagttattgaagaccatctacctactaaacaaaggcacaactttagcactgttaagacttgttaacgataaacatcctatgagcaatttaaatacgctgttttatatttagtagtatatcatttctaatctcaatctttcctgcctgttctcctcctctgtccattttccacatgaatccttaacatggtaatcatcagagattatgaagtattaaatatcataacactttagagttagggtttgtttttttttttttttttttgagatggagtttcactcttgttgtccaagctggagtgcaatggcatggtctcggctccctgtaacctctgcctccctggttcaagtgattctcctacctcagcctccggaggagctgggattacaggctcccgctagcacgcccagctaattttttgtatttttagtagagacagggtttcaccatgttggccaggctggtctcaaactcctgacctgagagtgattcgcccgcctcagcctcccaaagtgctgggattacaggcgtgagccactacgccctgccaagttagggctttttagctcacattttcttagtttgtttttcttccttcttgggtattccaccagtaattaatagggctgtaaaattctgttccagtaggacagtgtttctgatgactgtttactcctgtaaaagcttgtgtgtgtggtttatttagattaacaagagaaccaagaaattttgctttcagcattttacttcctcattgcctaatcacctgtgtttgtattatctttttgatcctttactttgctcctgtactgattgctttaggagtagatataattcattgtctcttactcattcatccagaggtgattgctagagtaacagtgccatggttggacacatcctatcacataagcacactggaatcatccttaaatctaccttcttacctcccatcctttgccctaattggttgccaagtctttattgattcttcttcccaagtatcccttgtatatgtcttttttctttctttccctactaccattttcttagctcaggaatcctcatcattcatggacaattgaaacaattttccaatgtcatagtttatctccctatctgcattcttagagtacttgcctatgtgatatgcctaagaacacacatcttggtgggacagctctgatgaaaagctttcagttctttgtcatttagagaaggaaaccaaacagaggtctagtggtagtcatggttgaaaccgtaggttctggtgcaatagagtgaggaagaatgaggaagatgaagctggggcctgcaacatggagtgaggagctataatgggaaaggtgggaacagaatgggaaaaaccttgccagagcaacagagggtacatgcttccaggagggggagtcatcagtaatatcagatgctatgaaggtatccagtggaaggaacaagaaaaccactgagcaatatcttcttcgctaaggcactgtgaaggtgccttcatgaaggctaaggccagtacagacaagcagaagaaattatgtgggatagagaaattaggtgtgatagagaagtgcagggtgcaacggaagcaggtgggagggtacctaagacttgcaataaagccatctggaagtgatgccacacggagcaggaaataaccaggtgctgccagtggggagtatgttgcaagaaaacgaacatgtgttaaggcctagagatagggaaaaagcatgagcaggcctgagaaactgaaaaataagtagggctagatttgactgctggtgaagaggtataggatggggaagtattggtcaggaggtaagctagagcggatcattaaaggtcgcaggagctgtgttaaggggtttggacatgattctgaagccaacatagagaatggagccttgagatacctctggattcagtttgttggattcaagtaatgttggtgggtatggaagaatcagatttggaagtcagaaaagatgagatatggtatattaagagttccctttaaaccaccttcttaaaaatttagctgtgcctctgtcacacaattaaatcagtcctcctgtcctgccccttcttgacctagcctggctgaaagcctttacaacttggtctctaatgtcagcataccgagctagcgacatcaccatgcttttgtcccctctcctcctactgtgttcctaagcccagctgcactcagcctggcattatgattgtgcaccctcttgtgctatttatgacactgtagctcctgattgaacatcttctgtctcctacaagatttagaatatctagaggcaaagactgtggccttttacttaactacttcttagtagttacttaactacttgcttagtatggcatctgacatacattagatgtttaagatacaatttttttttttttttgagacagagtctcgctctgtcaccaggctagagtgcagtgctgtgatctcagctccctgcaacctccgcctcctaggttcaagtgattctcctgcttcagcctcccaagtggctgggactagtaggtgggagctgcacgccaccatgcccagctgatttttttgtatttttagtagagacagtgtttcaccatgttggccaggatggtctccatctcctgacctcgtgaactgcccgcctcggcctcccaaagtgctctgattacaagcgtgagccacacctggccagatataatttttaaaagctggcacagctactcaggaggctgaggtgggaggagggcttggagaccaggagtttgaggccccagtatgccatgattgtacctgttaatagccaccacactccagcatgggcaacatagcaagacctcttaaaaaaacaataactcatggaggatcttatgatggactcatgcagctgaatggaactatccagatctcccactccacctatgtacacgtgaagaagcagaagctgactggtccagtgggttaccttaagcctggagatagagaaccagaatctcagcccccttactccagtttagtgctctttccaccattatgcatcctgtgctgtgaaacaacaggacaacagttcattttccttgctattaagtttttctcttgccttctcccttatgttgtgatttcttttggaaacattttaagaaatggtttttaatttgagcctatctcttaacttttacacttgagatcattaaatttactttggctactgttttgagccaattatccatttcaatgggatttctaacataacttcaacaatcgattgtaacacattctgagaggtcattcctagatatgaaattccctccactttttgtggtctatcccagcctcccctttgtcttcagagtcaacctataggttcatggtgagaaccatttcctttaataagtctataatctagataattattttcttatatttctgtgtttaaaacaatgaagtcagccttagttttatgtgaatgatatcttatcctttaattccttaaaacagtagtagtttttgttttccaggattctgataagttgccataatgtctctaagtcttgatgctaaaaatatattccttgcatagttggaattttataaaccatgtacttttttcatttctgtgagttttctcttctgagatacttttcactgtgcttttgaagcctttccttcttaaactcttaggttagccctaattatttttctcttgacttgtgactttatgttgcttgtatcttttttgaactgttgaatgcattttaaatttctaattattttatcctaataaattgttccctatggggtttatcattttcactttagagtgagtaggtcctaatctaatctgatgtgtttctacttgagtataatgagacgatatctattccaaattacattttcttgaactcttttagggactataaagagtgtattatagagtgttttaattagatctgaacttgtctaagtcgctgattttctttcttggaccagtctagcttttggtgacatcgaaaactgagcttattataaacatttattactgggaagaagaaacaccatgacctctcagactgccatcttccaggaaccttgcagtcatagtcatattcgttttaaaatgattaaagcgtgcataattttttttttactttggatgaaaacaaaatggcttatttttctgttttcttctgataaggtgatcctgaagatgttggaaaaatgacaactgaaaacaacattgtcgtagacaaaagtgacctaatcccaaaagtgttaactttgaatgtaggtgatgagttttgtggtgtggttgcccacattcaaacaccagaagacttcttttgtcaacaactgcaaagtggccgtaagtcagctttcttgatttgctctatgaagctaaaatacttcaagagacttgacatgtagaaataatgtatagatacgtatttctttaagatgtgatctttatctgcaggaaagcttgctgaacttcaggcatcccttagcaagtactgtgatcagttgcctccacgctctgatttttatccagccattggtgatatatgttgtgctcagttctcaggtaaggacagagtattactgatttttaaaatttatttttatttattttttacttagaattgagtaaaaaccattgaaacagagtctttggtttgcactgatggctggatttaaagcttgaatattagagtgaaccaatcatgtttttaaatagatcaaattaaactggttgaaaggagtgtggtctgacctgggtaagggcagagcgtctgtgtgtcaaggaggtggagatataaaggaggtatttttggttattttgtcagccttttggttttggggactggtaaagataatttggtttaagctaatagggggatgtggaacctccccaggttcatatcttcaccggttttattgaaatagcaagagggcctggaagtgtggagctgtcatggtgcagcttttggacggcacaagtcctgccttgcgataaccaggttctgttactctctgccgaagagaggcccggtggcctcatggaaggggagacgcagtaatccttcagtaaattcatcacttggttagtggagtctggttgactcatgcttgccaggtgttttaaaactagtcttgctattgaatgcttcatgtattgattgagaccttgtgattcacatgatcaggatatgttctctgtactaatgagctaactctactggagagacaaggcatgtaaactaatgattacagcgtaagacataattactatagtaagctattaatattacattttaggagttgaaggcttctgataagcaaaattagtaaacattgttctataagcttgatatctattaaagaaaaatctataaatgaccatctctaagttgaggaagaaaggtttttatttacatctacagtggaaaaatcatttgagattgagtctctccctttttcagaggatgatcagtggtaccgtgcctctgttttggcttacgcttctgaagaatctgtactggtcggatatgtagattatggaaactttgaaatccttagtttgatgagactttgtcccataatcccaaagttgttggaattgccaatgcaagctataaagtgtgtactagcaggtatgaaatttttatagcctccatattctttaaaaattctacagatgaagaaacatgaaaagatacacgaaatagggaaaagctgcttctcaaaacaacatcatgatcagatgcttaaaagttactataaatgtcatttatcccaaagaaatcagagatttctttccatgtcaattagttggcttcattcaaacgtaccataatttagaaagaatatcctatctcagagggcattacatttgcagcatatccaagatcttttcctcaggctgtgttgcaagatatagttatatcccaaaatacttccttaggctacattcccacaggtggaacaggtcagtaagtctccttcttttcatgtttgtgatacatattgtacattttcttccagaaagggttgacctagtttacatgcccaacgaaaaagtatgagagagtccattctcatacacattggtgcatcaaagggttgcttctatattatttcatcctggccaattttgataagctaaaggtgaaatttcaattcgcctcattactagtgaggctaaacattgttttgtaagttacttggcccttgcatttcgtaaactgactgaagcataactgttggattgctgatttgtaagtgccctttcagtgttgagttgtaagtgccaccaatgtttcatatgttaatataagggaccagtacttcttcagagattgttttatacttttgtttatggctttcttaattttattgggctataattttcctacctaccataatgttcactttaggtgttaactatacaattcagtaattctcagtaaacttactgagttgtacaaacatcaccgtaatctgatttagaacatttccatcaccctggtatggtctctcgtgcctattaatggttagtccttgctccccaggtaataactaatctactttctggctctgtagatttgtgtttctggacattgtgtatcaatggaattacgtggtttttgttttacatattatagaagctttttacaagcttttgctttttcttttttttcttggtagagatgtgagtctggccatgttgcccagtctggtctcaaatcggcctcggcctcccggcgtgctggaatgaaccattgcccaccagcaggctttttctttgttaattatgcattcatttttatgttcttcttaagtgacacgtttccgttccagtgtttgccataggtttcttaagtttaccttgggggaaattaggagctaaatttctaaatgctttcagaataattgtaacattcattcaaaattctttgttaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaaaccagtggtaagtcaaatgtttactggataatgcctgttctggagttcagatggttctataaataaatagtttcttgtacttataaaaagaatttatgttgaatgcctttcatctttttaaatcaagcattcatctaaatacttgtaagaatgtttgaaaaataaaattttatggggagttttataggttgccagcagctgatgatcagaaatgtaaatttgaaatttacttagataataatttattgtaagactgactttacggttaatattcctataaaggcacttaaaaagtcagtggaaattcagttcttcaaaagcgggttcctcagccaccccaacctcgctacatccctcctccactatgtccatttaatgtttaattattttcacagttcccttgggtgtggaaggaaaagtaaatccattggagtggacatgggttgaacttggtgttgaccaaacagtagatgttgtggtctgtgtgatatatagtcctggagaattttattgccatgtgcttaaagaggatggtaagttgattcttgtcatttgtttctttttacaaatacattggcatagataataacttcacatgagtttgttactaagtgataaaagtacctctttccaagaagagccaagtggtatttgtatttccaagaaagatttggttatacttagttagcttttattctcttttaagccattatttctattttcaacaatacctctttatatttaaactagtttacatttcatagagtatctcctaaattcatttacagaaattaattcggcctggtatagtggctcactcctataatcctaacactttgggaggctgaggcaagaggatgacgaggccaagaactcaagggtgcggtgaggcttgatcataccagtgtactccagcctgggcagcagagctagaccgtgtctctggaaaacaaacaaacaaacaaaaaacaaatttaacttgtgttgaagtattagtgtaacgtatagatacatgtgtatataggagtacaacataatgaattatcacaaactccacacacttgtataactagcctctaagtcaagcaataaaacattaccagtatcccagaagtttccctcctatcccctcccatcattacctcttctttctttcttttttttttttttcattgagatggagtctcgctctgttgcccaggcctgagtgcagtggcacagtgtaggctcactgcaacctctgcctcccaggttcaagcgattctcctgtctcagcctcctgagtagctgggactataggcatgtgccaccacgcccagttaattttttttttgtatttttaataaaggtggggtttcaccgtgttagccaggatggtctcgatctcctgaccttgtgaatccacctgcctcggcctcccaaagtgctgggattacaggtgtgagccactgtgcccaagctgccacctctctctttcaaaagtaaacatcttgctttctaatagcatagataagttcttcctggttttgaactttctagaaatggaattacacactatgcgagcttctgagccttgctgctgccccctgcactgtgagattgttacatgtctgtaccttgtttttccttgctgcatagtgttccattgtatgttacatgtatctgtatcttatttttccttgctgcatagtgttctgtgaattgtattgcagtttctttctaccattggacacttggcctgttttgcttgggctgtaaattagtgttgctgtgaacattacagcatatctggtgcacatgtgcaggcattttcatggagtccaaacctaggaatgaaattattaggtcataaagggtatgtaaatttgcagcttccccatctacaaaggccagtttctgaagtgattcagaaacatctagttgctccacatcctcacaaacattgtgtgttttctttttcatttgagccgttctgatgagcatcattgatcttaagttttccaaatattggtttttctttgtcaaataaggacattaaagtagataactaaggccctgtctgaccccatagttgtgagatttgtcatttcttcattcagaatcatctggttggtaggccaccattccatataggataaaatttacagttttgaagttcctttttatttttaaaggtgattatacaaacataatataaaaattctaaagatgaagaaggaaacatgaaaacatgtttcaaaagtgtatatagtgcaaagtaagtttcctggttcctcttctcaattttccaaatattttttcagagatactctatacatatgcttgtatgagtatatataatccttttctatatctatcaacagtataaaatggtaagtaatttttgcattttttcttccactacattttggatatcagttcacatactgttttctccagtctctttttaaataacagtttttattttggaataattttaggtatacagaaagtcacaaagatggtacatagagttcctgtatacacctcacccagcttctcctgtagttagcatgtgatcgtggcacatttgtcgcaacaaagagaccaacagtggtatattaccattaaatgaaccccaaactttatttggtttttgctagatttttcactagtgtcctttttctgttcaggagccactctgtgacaccacattgctgtttagtctctattctttttcatggctacatggtattccactgtgtgggtttatcctaatttaattaacctaagttaacatctagttgctccacatcctcacaaacattgtgttttttcttttttgtttgagccattctgatgagcatcattgatcttaacttttccaaatcttggtttttctttgttaaataaggacattaaactagataactaaggtcctatctgaccccatggttgtgagatttaacctaagtgtggatacacactactaagtgtggataaatacaggattagtggtttccaagcttttattactaaaacaaatccttgtactgtgatttttactttaggagtagatctctgggacaagttgctaaaattgtaatgagagtattaggtcaaaggaatatgtgtatttgtgcttttgagagctagtgttcttcagaggccagccaaacaatcccccagcagcagagtgtatcattgtctattgtgtgtccttaaactttatttagcctaatctgaaaggtgaaacatctgaaacattagaatttattttccattttagtaaatgagcctttgtcacattcttaaaaggcatttgcttttcttttactactactaagtggtttagatcccttctgcattcagaagctctccatggtctgcattttgcagggacagctccaatgtctctctccagtggccacttctccacttctgcgcttcgctagcctgctgcccacttttggttgcctaatttcataattctgtcctttgtctgagagccatgtcttccttctggaaataccctctccttcaaatgtgatgtactttgtatttctgtatgaaacctccagcacgcagagctcatgagctctgacttcttatacattacctgtgccatccatttagtgattatagtcactttcaggacagcttttatgtagcttctgtatgggcttgtatgctgttttcttatctccctgcaaagttcatgctttagtgtactgataatcatgctgtaattgtttctttttgcccagtaaatcgttggtgttgggtttattgaaagtattaactaaataacaacttatttgcccagtagttttttaataaggaaaagcattgggtagacttaatagtagtttagggaggtacctgtcttgatcataaaaatcacgttttctgactttaaaggaaaatctgtgttgtttattttttaatatgttcttaattttttaatcctatgtgtattttcagctttaaagaaactcaatgatttgaacaagtcattagcagaacactgccagcagaagttacctaatggtttcaaggcagagataggacaaccttgttgtgctttttttgcaggtaagttgcaattgatgcaatcttgacttttagaaccttatatttcttaacttaaccttatttttagtgcacattttcttaatgcttaagcaaacatttttcatggccaagaatgaatgaatgcttacaatgtcatgtgtttttccttctctttgtaacaaggaacttacaagtgatactttcttgccttaactttattaaacattattttaatgcttttctttccagaatttctgttaatattaaaataacttagctcatggaagcgctgttcacagcaggttcattgtttcttctggttactataagtatttacagtattttgaaaatgtaattgagacatcttcattacaataatttttttactatttactacttaaattattttaccacataacaagtaaaataatctgagccattagtaccaagagtattatacatctccaaaactgacaagtatattcaagtcttatcttcaccttcacattctgtttattggataggttatgaatgaaatctttaattcatatcaaatgtaaaagtatggcactatacattttggagatagtctaaaaatagattttgagaattctttcattctagagatttttgaattttgaaaaatgaaaggcgtgatttgggaaagtaagcaaatttattacctacttttagacaaagggtggcttttttcaagataagtatttcaagtgtcgatagaaaggaaatgttccatgtcacaaactgtgtgttaaacctaggtgatggtagttggtatcgtgctttagtcaaggaaatcttaccaaatggacatgttaaagtacattttgtggattatggaaacatcgaagaagttactgcagatgaactccgaatgatatcatcaacatttttaaaccttccctttcagggaatacggtgccagttagcaggtatggtatacaataagaaactttctcaactttctaatacttggggcatataatccaagtgttaatatctacaatgttaacattttgtgtgagttagaggatcctgcttcatattataaaacttagaaattttacttacaatattgaccaaaaacgtccagtgttgtcagagtagggaagcggctcctttactgaccacaggaataaaaactgcacgatcctctggaaggcattggcaggattccttaagaacctccagcgttcataccttctgacttagtaattttgctcctagtaatttatcccagagaaatccaggaattgcacagaataggttacaaaaataattattacaccactgataataatggcaaaataacataaatagtcaataatagcagattgggtaaatgatccataaaatggataatgatagtacttattttgtagggttgttgggaggattaaatgaaggtttaggacagggtctggcactcaaagttctacatgtttagctgtctattgcacagtcattaagatgatgttaaatatgtgttattgatatgaagaattgttcatgatttaagtgaagaaaacaggttataaaagagtgttgtgataaagacaatagacgtcagagccaactgctgcttgctgtctatgagacgtttaggcaaattatttaaactttctgtgcttctgtttcctcatctggaaattattcctaccttcctcaaagagttgttaagagaaaaatataaagcacttaacagtgcttggcattatacctatagtagcggttattataaaaactttataatagaatatataagagaatgtgtgtatatgtgtgtattttggacatctgcacataaaagttgtggctggttggattccaaaattcaacagtggtaaagtcaggcagcatagatggatttatttcttctgctaatctgtttctgtttattttataatatatttcagattattgttctttttttaatttttttttttttttttgagatggggtttcactgttgttgcccaggctggagtgcaatggcacaatctcggctcactgcaacctctgcctcccagattcaagcgattctcctacctcatcagcctcctgagtagctgggattacaggcatgtgccaccacgcccaactaattttttgtatttttagtagagacggggtttctccatgttggtcaggctggtcttgaaatcctgacctcaggtgatccacctgcctccacctcccaaagtgctgggattacaggcatgagccactgtgcccggcccagattattgttcttaattaccatattttattccagtgctgcttaaattatggcccccaaaccagcaacatcaacatgggaacttgttaataactgcagattttcagcccccacccaagacccagacctaccaaaattagaaactctgggtagggccccacagtctgtgttttaacaaggcctctaggtgattgagatacatgttcaagtttgaaaatcgctgctaagaaaacaagggtgtaagccaaaattatccaagaaaaataatttttgcttacataatgaaaaacattttgaagttattagaaaactctccacaaaggtggcagtatatcagctgacatcttctaccagcataatggttaactcatacataacagaacatgatggtgaattctaaaacagtactcctttttctattggaaaatgcccggtaaagatatgttagcagagaacgtaaggaaagatcctgagcctcctaaaaccctagagtgtattagcaagtgcattatctcttaagtcaggcatgcaggatgtaggtgtataattgaatattgaagatactgagaattgctgacctgaaagtaaacttggcaaagacctggtgctgggtactactaaagcaaaaatgaaacttgttcataggattctttttactgctgtccttattttctagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaaggtaacattttaaaaccatttatttgtttaaatttgttattctttgctctcagagactatgaaaaattttccatcataaatgacagttttcctgtagagatatgctttacggacatagattagtaggttaatattgtattattattaaattattgaacaaacattcatttcaatgtaattgtcagataaacatatacagagatatctcacttagaagcttgagtaagttgtaagaattatattaaatatttgacagagatggaaatatacagaaataaactacaggagtgtaatagttcaaggatttcattgtagactgaactttttcgtactgcccacaaaatccctcaaatagaatagattgttttgtgaaaaaatacagatttttattttggggatttggaaatgttgataatcatttcatgaacaaatgattgaattaaatatgttactgaggaaaacaacagtacattttttttattccgtgtgagacctgtgttttgtatgtttccagctacctcttcagctgagcaatggaagacgatagaattgccagtggataaaactatacaagcaaatgtattagaaatcataagcccaaacttgttttatgctctaccaaaagggatgccaggtaagaaaccaaaatttgagacatatttatgctcatcttttaaactgtaaaacgaaagtgctggtcttgaattcctttgggaatgaaggggagaaagaggctcactgttttaaggaagaactgatcataacacttaaggcaaatttagttacgaaacactagcgggaacatgaagggaagccctactacagtcagcacctacctgcccagtagcctggtctacagctttttataacagaagtgtccttaattactgtataatttcttgtttaaaaaacacattatctatattgaatcatatttactgctttagatatatcgaaagactttgtaatccattcataatcatagctttactataccttagagacgtagagaaatgtttcacactagaacgaatcttgaagaaaagtagcatataaaaatttatttttaattttccttttgttgtttcatggaagttgcaattaaggaatctcttaaatgtatatgactttatccttgtagtatctgaagatgagttagtgcaagctgagtgctgtctttttagaataatttgcaggcacttttaaagctgaaaaaatgaaacttttgtttcaaattttcaaagttagaactgtggtaatgccaataactgctcttaaatttatctctaatactacaaaaggatctttattctgtgtactaaaaagcaggagcttagggttatttgatcctgacaacatgttgtatgatgaattggaaatgctattgaggataattttattaagtataacacttactgaaaagtacactaaacaattgtaaaaatacagcttaataagttttcacagagtgaacaaaccagtataaccaccttgatcaagtagttgatccaccggaggcttcctccctgcccactcccggtattgattgcatcccttttgcaaatggcaaccaatagtgggtatattttcaagtatcatgtatattttatatacatgtatatattttaaatatattttaatacacaaagggtttttggattgattagacttgccattcttttgtatagtgttaatagtagcactggaaattttcttcacaaaagattgcttttatatattttagaaaatcaggaaaagctgtgcatgttgacagctgaattattagaatactgcaatgctccgaaaagtcgaccaccctatagaccaagaattggagacgcatgctgtgccaaatacacaagtaaggttcttttagggaaaatatttgagggaaggtatttagtctgttttgttctacatgatactatgtagattttggtattttagctgcatatttcatttggtttagggagagaaattaaggaaggcagtgttgtggatttaattcatatgttggtcattcagcttttcgattctatatagattatttttaggcaaggatataggtagatttctacaaatctgtcagtacttacagataaccagctcgagataaccacactattctagtggatcagtcacattacatttctttatggaggggttgcaaagaattcatagggttccatatgtgaatgtactaaaagaaggatggaatgcctcagggagtcaggctcattgatgagggtatactttgatccttctccgttttaatgtctcattttaacaaatttcgtatgctaatataaataacacttggatttgcttctgggatcaaggttaagtgggagtggagccaggttacagtgctgcttcatggtccacagtcaggtccaattggcaggcaagcatggctcctgccagtccctgggcagaggtggctagtggcaggatggcagccacgtggggctagagctgagttcacctggggacagggctgctttcagtcaatagctgggaacaaggtcttgaaagtctgccactggggcacaggcctgccttctcaaagagccttcctcaatcttgggctccagtggcgtttcaaaaccccccatctggatcccaaacctctcacaaaggcatttttgtgattagatgggcaccaaattgtttttgttggggagcacaagttggggaccttcaaacttcatggtcttgcagatattgcacactagttttgtttttcttttgtatgagaactggatctatacttgccctttctttccaggataaatcacaatttttggttctataagtattctgccttacttcattaggactgcataagcactgttcacagctgagctgtgtagtgtattacaattaccttctcttttgccacttttgtcgttgttagtgttctatagactgtcactaattatttccagtgctctgcattagtgcaaattccctcaaagaacacaacatgtactttctcaacattaccatattggaggcatcttcagccttcagtctgctcctgtacaggctgcttgtcccccagacctgagctgttatcctgggtttttcctcaccatgctgagatcgtttcagccctgaccctgttgtttcctggacggcacttctgccccccacactgtgttagctagatttcttcttccttcgtcccaccttgttttttggatccccaacttcccttttgatttactccagtatttgggtggatcctgtcctccagaagctgagaaaaggtgcatgtaagacaaattttctgttatctcccatgtttgaaaaagccttcagcctaatagttaattgataggttgcctggatgcagaattctagattggaaatggtttttcacttaaaattttgaggcactgcttttattgtgttttagctattggtgtttctggtcaaaagattaatgttattccggattccacaaactttgtatgttttttccgcctttctggaactgttagtattctcacctgttttgaaatttatgatgtgaccttagtatggtgtttctttttctaccgttttgctgggcactcagtgggtgggccccttacatctagaaattcatgagcttcagtttgagaaactttcctgaattaatgcttttagttgcttttgttttctgttctgttaggagcttcaagtcttctaatgctgaatttgaactctgctaaatgtcctcttctctctttcatcttttttgttcttaaagagatttcctcaatttcaccttccaactttttaaatttaggttttcatttctatcacatttttaatttcaatagctttttttgttttgtttttcatgtttatgtgttttaatactaccctgttctttcaagagtggaatgtcatttctccaaggatattactgtcagtcttctaatgttcattgtcatattcctccttggttttctgccttggtttccctaaggtcctgttttgttttggtctcctctgtgatgttagaggctttctgcaaatctctggtgatcctatgctgttcctgtatttaagatggggcactgagaagttactgggaagttgctttgagagtgggcaggggcttttccactgatggccttcactgtgggtgatctggctctgccatctcactgcagactcccagtgtcgccatcttgatgggctgtcacatggactggtggcctcctgcctggagtgcacagcttgcctgccagtgttaaactctcccttgtctactctgcctcacgttctccagtccatgccctctgtggttcattctctcaggagaggaaacctccagtcttctgccctcaagtagcagcattattaaaacatgggaacacaaagctcaccattctctttagcaactttaaaaataggtgttatatgcaaatgagtgtatgaaccaaagcctattcagatgtctttgcaagtaactctgcttccttggccaatcttcatttccaactccatcttaactcctgcttttgaatgagcagcaccaatcgttgagacttcaggggttggggatttgtgatgcaagctgggatgcttcttggcttccccactgccaactttggttgagctaccatggctctactaaatcattttcattcaggcatctgctttccagcttccaatattctgttgtcttttctcttgttctctactctattctacgcatttaaaaaaaaaaaaaaaatctggccgggtacagtggctcacgcctgtaatcccatcactttcggaggctgaggcagtaggatagcttgaattcaggagttcaagaccagccttggcagcatggcaagactatctctaccaagaataaaaagttagctgggcatggtggtgtatacctgtattcccagctactcaagaagctgaggtgagaggatcacttgagtctgggaggtggaggttgcagcgagccaagattgtgccactgcactccagcctgggctgcagagccagaccctgtctcaaaaaaaaaaaaaaaaattctattacatttttcataggaatgtagaggtaaatgcttgtatttaatttgaactgtaaccagaaattttggcatggatttttaagtgatgtaaatataactatgaatagccatcttaaagtaggaggaatcactgactgtaagttcttacctgagatttcattctgttttcaggtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaaggtagacagctaagtcactttccaatttaggtttctgggtattttttttttcctctttatgtttcatagctctaagtcggaatcaaatgggtatttccagtaactgccttaatgtttttaaatattaagagttttcaaataagtttcatattctttattctttatcgaattctcacaaaaactgtgttcagtcagtctttgttttgtagattagtttcagagggccagggttcagagattcggttttgcccctggttgctaagctagtaagtggcaaggccaggatgtgaaacagggtgtctggtgtctgtgaaccagggtgtctgacctctcatttggggtctttctgcttcgtcacatctctctttagggactaaaggcattcacatgacaccatttttggctaccttatgaaagataaatctgcatatattcaactccttagttggaatttgaacaaagtgaacaaaaatacttaaagtagctttttactgtcgctcctgatgtccttatgcagaggacttgcagataataccataccgattgcttcatggtcctcttaggttttgactcagagttggaaaattatctttgtttctcctgttggaatatatgaaggacagatgtgtctgtttcgtgccctctagtccaagattagtgcttgatgccttgttaggtgatcaatcaatatgtattgaataaatttgtcttttgtaatgcaacagcagtagtacatcagaacacacctaaatccagctgaagtccagtaagccttttgcttattattcttagataatttatctaaattctgtctttttaaaagggactaaaagactataatatctattttttccaggattaatggaattgaatggaagctcttctcaattaataataatgctattaaaaaatttcatgttgaatcagaatgtaatgctttctgtgaaaggaattacaaagaatgtccatacagtgtcagttgagaaatgttctgagaatgggactgtcgatgtagctgataagctagtgacatttggtctggcaaaaaacatcacacctcaaaggcagagtgctttaaatacaggtattcttttcaagtgttattaataacagatgttaagtgtgaggaataacagataatcaatttagttgacttgaccttttctcacttcccatgccatactctctcctcctcctccacaaatccagtggcagggttctgattcctgtggctgcctgggagggccgccttgatggaggcagtcctccgagtccagatagtccttagatcagacttgtcagcactgctgtgggaattgacaccaagagctttgaaaatgccaggcattctgcgtgcttcttatttccaatttactttctatcctgatcaaactgagaagtcatatttttgagattccatcttcctggtacttcataagatgtatatttgacagacctggcctcaatcaaaaagagagatgattgacaaccaaaaccttggagacatgggttgttaatgtggtcaaatccagaccatggtagtagataatctcaaagcccaaatggatccatccaggtctttgtagtcggaacccatgcgcaagggggagagctatctgtatatgtttacactcccaagtttttcttctttacattatgtgttatctaatggcttatttttcttgtgcttttagaaaagatgtataggatgaattgctgctgcacagagttacagaaacaagtaggtaaaatttcctttaagtgaaattatactcctaacgtttttagaaattaaatcatatggtttctttttcacccacaggttgaaaaacatgaacatattcttctcttcctcttaaacaattcaaccaatcaaaataaatttattgaaatgaaaaaactgttaaaaagttaagtaagttaaatcgtatgttttcgcctcttctgtgatcaccaataggacatcttcaggcatattggcaggatagagctaatggagtgaaacctattgtaaggctgtactttcgtgatttaatgacctgaggtttggtcataatgcttctgctgtttttgtaggtttatctgatcgttttcctttgctactgctaatggaactgaacccccaggggtattccagttgtaatagcctttccttactgttgtttggttctgtgaatgcctatgttattgatatgtggagggacttgtaaaacttgttgtgacataaagcttagcctcagattttttgtctagatctgaaattaactcagagctcacttatgcacattgctgtaaatatgtttagcactttttgcgaggggtatctaaagggccaagaacggaaagtggatctaaagggccaagaacggaaagtgggctgcactgagggtatttttcatttaaaaacaaaacatactccctgcttttggctgtggtgattctagtgtctaaagaacatactggtgagttttaaaccagtgttcctccccaccccacccccatattttaaatgtctgggatcctttgttgtaagatggttctcagaaataaatttttgattaagagccaattagaacttctgatcagggctgggggtggtggctcacgcctgtaatcccagcactttgggaggctgaggcgggcagatcacctgagcccaggcgttcgaagtcagcctggccaagatggcgaaacactgcctctacttaaaatacaaaattagctgggcatggtggtgcacacctgttaacccagctacttgggaggctgagacaggagaatcgcttgaatccaggaggcggcggttgcagtgagccaagactgctattatactccagcctgggtgacagagtgagagtttgtctcaaaaacaaaacaaaacaaaacaaaaaaaaaacaacctctaatctcagaataaagttgtctctcctcaccactttgagttgttacagttccagccaaaagcaaaggaactttgatttacttaatatgtgcacttttgttggttaacaaatttatattaaactgtttggaaatagttcaagaggtggctataatactcttcatgaatcttttatgggtgtagtaactctcaagtaggaaccaactgccaactgtgttaaaacatatctttcatgtggtaatagaccgtttctttgcgttttaagaaaggtcaattgaattataagctaaatgtaattaatgcaagatcaactatcttgactctcatgtttccttttacaaattttgggttattacaactttcagtcctttctaatacattgtcttaatactgactgttttgtatgtttaagcttaaaatcttttaatcttttttttttttttttttggagacggagtcttgctctgtcacccaggctggagtgcaatggcgtgatctcggctcactgcaagctccacctcccaggttcacgcaattctcccacatcagcctcccaagtagctgggactacaggcgcacactgccacacccggctaatcttaaacttaatggtgattttaatttcatagatcaaggaacatgcaatgacatggatttctggaatttagtcctagtatcaagtcactatatatatatatattttttttttattttttatttttatttttttttgagacagtctcgctctgttgtccaggctggagtgcagtggcgctatctcagctcactacaacctccgcctcccgggttcatgccattctcctgcctcagcttcccaagtagctgggactataggtgcccgccaccacacccagctaatctttttgtatttttagtagagacagggtttcaccgtgttagccaggatggtctcgatctcctgacctcgtgatctgccctcctcggcctcccaaagtgctgggattacaggcgtgagccactgcgcccggccaccaagtcattacatttttaaccaagttggttggcctgtatgttcttcttatctgtgtaacaggcatttttcctaaggatattgagtgtgcttacacataaaacttaaagtgaaatttcattgtttcttgatagatttaagacagggcttagtagctttcaaaagaaaacttgatttaaagcatagtagttgaactggatttttcctgactgtgggaataaatagatattttatttacatttgaatacagtgcaataccttgtgtttgggtagtacgtatttacaaagcattt

SEQ ID NO: 16654 - DNA, 64593 bp, Human
  misc_feature (1)...(64593): n = A,T,C or G
ctatagagaaaattcctgtgggtatttagactgggtgttgcattaataggttcatttttgataaatcagcatctttacaatatttagtttctccatctagaaatatcatacatttttatttaggtcttttatgttcatcagttaagttccataatttgctttgtgtagatcttgcattggagggtttattagttgttattacaaatgggatcccattttcccattacatttacttaatttttattgctagtgaataggaaataatggtttttatatgttaattttttatctagccatatgacttaatttttgtattcgtgatctttatacttatttttcttgacatcacattggccaggaggaaaatgatgtagaatgatattggtaaaagtgtacacctttgtcttgttcctgtctttaatgagaatgcctcgaacgtttcaccactaaatatgataaatacacttgatcagcttgaagacatttctttctatttgtagcttaccaggaggtatgcttttcactgcagacgacaccatggtcttgccaaggggcctttattttttcacttaacattttccttaagagtccagagattgcccggactaacttgggcctcccagcactggcatcctagctgagcgaacctggtttagaactgagcacttaggactgagtaatgtcttctttcttcctcctttctgctcacatttgacttcagatgtcctacaggcaggagctactttgtgttgatatttcccgccttctctcgccactctcctccagccctacccttccttctgcagaaaagtaaaaaattttacaaataaataaaaagtagcatgtggacgaggacaagagcaccacttctggaattttctggcaggcaccactgaaaagatttttattcctaacttctaatttaaataacttcaatttttttttccacctgattatcttaaagggctaaccaccacctcacgtgctggttgctaagtggatcttgtagtttttacaggaaagtatgagaaaggaattaccacgtgacatctgatttcctgttgcagtttcatgcaggttctgatgcaggatacagtcatttttaactctttctcggccactgccttgtacatggttaatgcagaataaatgttttgatggtggattgatggaaatgatttaatcagagtccatctgagagttcttaggtggtgatgattttttgctaggctgtgaacgaaaggatttgttcttgtcaagcatgtatgtggagcatgactctaatgtgatttggcacctgtctagaaaattgtccctgtatccagtgacactttgctttggggaagtcaacacctgctgtgatggcatctgtcatatttaggaatgtgaaatgcacatgaataatgcacagccaccttagtaaaatgccttctccagaaaactcttcatgtaagccactggcaaaagattgttgcaagctgcatagaggagacttagggccccccttgagataaaaacagtggatgatgtattttactatagcttttctcaccttgatgccattggggtagattttattattttcagattgtttagccaagaaagcaagaacctgctaaatataagggtcatttatttttggttggtttgttagaaacagcattagctcccaacaaggtggggttttggggagatggagtgactcatctcaggcatatggtgtgttagtggcagccatccaggtcaagagggagacatagaagccagaaacaccgagaggcaaggcagccccaccaggcagccacgagtagctggccttggagcccctcccgatttcagtgaagttggctttagcttccggggctgttggtgtaggaagtttggtcaattagacaattatttttcctttttcagcatcctctcttttcttctaaatcatcaagtccagaaaagattctggaatccatgacaaggagcagactcaacgttccctaccttttctcttgcaggcaggtgacaaacattaccaccccagctgtgcacgatgcagcagatgcaaccagatgttcacagaaggagaggaaatgtatcttcaaggtgaggtggactcaagaacactagaagttttccttgctgggggaaaggaaatcttgctatgtttgtttgattgtttttagagaaggaggcatgttattagctgtgaggctacccaaatccaagaagattatggccaaaagttacctcatcagttagtattaatcagccaagcagttgacatgctggcagtgagcccctcaggctgttcacgaatgaacttgtgatgctgccttaatcaaatgaatggaactcgacatttgatggctcggatgtgagggaagagtgaaaatcagcaatatctcctctccaactctccccaggaatatgcttaggaaacaaaagattaaaataatttctagaaatttctagaaatgttacttatttgatggctactttttttctccttttactctcctgtgagaagggctttttgaggcctcccaggctgctgttctctgggttttcaaaaagaaaatctcatatttgatgaattacgtcacagacttgtttcaccccattaagttgattagctcttatattgagagagagagagacagagagagaataggagataacaagagagaacccactctctgaaagagaaatttctggtgtcaaagaggtactttttaccagggagccattggaatcccagcactttgggaagctgagttgggaagactgcttgaaccgaggagttcaagaccatcctgggcaacatagggaatcctcaactctattttatatatatatataaaatagaccatatatatatatacacacacacacacacacacacacacacacacacacacatatatatgccgggcgtggtggctcacacctgtaatcccagctctcagggaggcagaggcgggaggatagcttgagctgaggaattcaagacgtgcctgggcaatatagcgagaccccgttctccacaaaaaggaagaaaaaaaacaaaaaagacaaaaaaaataagcatacatatatatataaaggaccatatatatatgatcatagtttttatgaaactgattatatatatatatatatgatcagtttttatgttctctgaaattctggaacttctcagagaggctttgagagaggattctcttctagtcaaacagcaccatctgtgtaagcattttactgtttttagctggaaaagagttattaatcaaacaagggtttattaataaaattagcaaaacccataagagctattgctcgttccgttgtggtaattactgggtctcaactacctgtgcatgtcatttcttgatttctctttgcacatggcactatgtgtacctgtaatgagttgttcactttgctctctcaattttgtttttaggcaacttaggaaagtctacagaaaggattcttgagtattaaagcaaagcctggctactctccccttaaaaaaggctagctacatgagaaattgacaacccaaacttctttttggctttagaatgatcactctgaaaaactgtgattaaaaacatcacggaattttgaaaggccttatgaaggcaagtgacaagcacccgcatctgtggcctcatgcgggatttatatgacacgttttcccaaggacaacaggccttacatctgcagtggcaataggcaggtgtcactttgcatttctcagcacaaagcagatttattctttatttggtctgtgggcttagattttagcatgtcaattctagcactcaaaagcaaagacacaggagtgccaatcaaccctgtctctgctagaaacagactcagaggctccgggtgcagctctgcaattcagagtggttctggaggctggagagagaaggtttcaagcagtgcacaaatgcagcacattcgggctacaaataaatggctatctgttgaggctgcatttggaattccagggattgctctaaaccttctggagttgtgcttccgtagcctttgtgtgccctctcggcacatctttgaagaaagagcagtttcatcttcttcagcatctgatgttctgtccgagtcacattccttgtgtgcctgacctctggagaacaatagtgccattgtgcgcagacccggtgtcctggccagtgactcctgctcagcagaaccttcacggcgaatgcttctcctgagcctgcacctgacccctgggccctctgcattcagaggatttcctgtgctttgtagttagcctttgagccagagttagtgctgaagggacctatacgtctgtctgctttttgtttgatttttttgtttgtttattttggccctgggttaagaagatggaaaaaatgattgttaaataaggattaaagtattatgctgatataaaatgtattttttcttgccattaatttgatattagttaagctcagtggtgtgaaataactcatgagttattttaatttggttacttttcaagtatgcacaggttgttgcttaaaagagataaagattttggccaggtgtggtggctcacgcctgtaatctcaacactttggtaggccgaggtgggtggatcgcttgaggtcaggagttccaaagagcctggccaatatggcgaaaacctgtctttactaaaagtacaaaaatcacccaggcatggtggtgcatgcctgtaaccccagctacttgggaggctgaggcaggagaatcgcttgaacctgagaggcagaggttgcagcaagctgagattgtgccacttgcactccagcctgggagacagagcaagactctgtctcaaaagaaaaaaaaatgaggtaaagatttaagtcatgaaatgtggaaactctgatattcatactgtgaattttatttatgtaatttatgctttcaacatagtaactttattttcttaagtcttcttaagtgctcatttaagttctgtccatccccacacttgaatgtgtccttacatggacatatcagccttactcataatcatataaatgacatatttgatatgtatctagtcatacaaaatcatatgagcaggcattggattcttataagagcttctattggagataagtgttttgtttaattctgtgatgctggtaccacgcattaaagtgcttcataatatgagaaagtgagactgttgactcaggaacagaaaataacacctaaatagttacttcactagtttaaaagcaaagactttttagaaaattacttaaaagattgaaggccaaaggcaatttttggatttataatttaactttcaccctttctactagttggtttctcatttctctgtaggtgactatgtataattgaatcaatgaaaaattcagtaagtcttgcttctggacatagactatctggttgactttattcccgtcaactaaactgcttggttgttttgatgttatataaacaatagctattattttttaaattaaatgcagcttgtagtaagcactcaggcattccttttaaaggatgataataaggtttaaaaataacaagacacgattaagaactaaatatctcttgcatcaaaagactcatgcccagttggtggtctctgtggtctagaattatgacctttatcaaacaagcttgggctagatcaggaaaactcacttaggctttggacatgtctgatttttgtgttatgattcacttggacataaagcaataacaccttcctatgatggggaaagagggataggagccattctcagaagtgctgtctcagaggactttgtatctttccattttcctggctccttagtagtgcattctgtcttctcaggctccaccgtttggcatcccgactgtaagcaatctacgaagaccgaggaaaagctgcgggtaaggacacaattaaaacatgatgccagctgcatttgtaggccatacgctcgtggtcactaattcttggggctagggtttaggtgaaattactttttactgactttttcccttatagcaaactaagttcaaaggccatttggctagggaaagggttcccctcttaccttaaacgtactgtggtttttattccaaatgcttgtgttagacaaagtaagccttggccttactagtcagcttcttagaaaagcattcaagagaaaagtcaaatcatgcagatgggaaaacaacgactcatcaggttccaggtgcagcatctgctgacctcaccagactgttttggtgcttagtctataatgcactactctgaccccagctctacattggcacattttactggtctctcatttactggatccaaattcaccagaatagactctaaaagctgatggcttgtcagataaaacctttggggaaaataataaccaaccaagacaggtaaattagtcaattctcggaacacctccagatggcagtattttatgtttcagaagcaaagcgctgtacacagttgtaaaactgtgatcataattctctgtcctgttcagatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacaggcgtagtcacctggttgtgggctctagactctgggatttttgagaaactatggatgctttggaaatgagttacctttataaaatatgagaacataaatgatcatccttattgtgacttttatcgtaagaatgtaaagttcacagcatagcttgaggatgctgcccagaaaccaccccagtagctatagtagtttgtactctctctccagtgttgcttttaggttttctaataatcattttaacttcatctctgatgaagtcgtttgggagatgaagagaggaatgctaatgaggccagactgagtggaatgtgggtcttttctgtatcaggattgcttgagtttgcaaatcatgtgactaaaatgatttttaaaaaccaacaacactctgataacatcttgatggaaaactctctggataagcttatgaaaacaactagtgaaatacttccacccattctggccaagaggagctattgttttcttcctttagtaagacttccagagaattctaaagctcttctcctaaacccagcattcactacgtgggaggtcaggacagtgctctgggtcactgtctttggaaagctcagaagtgaggaagaggctcccacgtacccagagccggggttcacactgatgttggtagggtttaaagggaatacgttttgaacagagaaatacatcttgtgctctcttgagggtgtgtctacacatcacaaatcttgagccaagatttccaggcctttcactgcatgtcacattagtgcagtttccatagcaaaatgaaaatgttttaagaatctttcagcaacccactgggtagtccacattttttatatttaagaactcatggggcatttgtaacaacagattctcaaggatggctctcagttggcttcactggctttcttaccctttatatattgtaagaatgtctaagccaaaataaatggagaggaattgaaggaggttggagcttagataaatttactgtaacttgaagaccagttaatatgcttttaaacatgggcccaaaaatccacatgtacatcaatgaaagaatcccacttgatgtttactctcaagttagttttacctaaggtggttgttgttttgttttattttttaaaataattcttctgatttgaggctatttctgtgttcgttcttcccttttctcatgtttcatggcagctgccaaacattcggcgttcttcatccgatttcttttattccaaaagtctgattcgacgcacaggacggtctccgtctctgcaggttggcattgtgtctaggctggggctcgaagccactgtcctgggcccaggcttctgttgcttttcccctgggctgcttttctcacataacttcttcggctcctgcagaaagcagatgcttttctcacaccacaagcgcctctcacactgactctggctgttgtcttcttggatggatgttttcattcagagcagcagctaaagctttgtgtctgttcaagcaagcacatcagaagctatcttttggtcccgtgttgccacgtttgttcactgcacaagtatctgctcagcacccaggtatagagctgggctggatgtggcagatccagcctcataggcaagaaaagatgataaataattataagagtggtacagaaacccatcccaggctatggctcatgtaggccatgctccttggaatgtcagatgaggaaaaggtttccagggtcgcttcctgggagaagtggtcttggagttgatttttggaggctggctgagatttgcccatgaggggatgaggagaaagtggtggacctgatgaggagatgtgaagtgtgcagccgggaaaggcagtgcttgggtagggagtggtttcactcaagaaaggaagagtgagaccaggcacagtggctcacgcctgtaatcccagcactttgggagaccgaggcaggcagatcacttgagatcaggagttcaagaccaccctggccaacatggtgaaaccccgtctccactaaaaatataaaaattagccaggcatggttgtgggcgcctgtaatcccagctacttaggaggctgaggcaggagaattgtttgaaccctggagacagaggttgcagtgagccaagattgcgccactgcactccagccgggatgacagagcaagactctgtctcaagaaaaaaaacaaaagaacagtgaagtgggaaaggaagaaactgagaacaggcacctactctatggagactgggggatttacgtataatctcatttcctctccctaagaattcctgcgaggtagctaatcttattcccattttacagatggggagactgagacccatcatagttaggtaacttctccagagttactctactggtaagtggaagagctaggattgaaaaccatgtttccgtgagcccttcactcatattcatcctgctatactgcaaggggacagtgagagaaaaacccgaaagaagcagaagaaggagaacattaaatactggctaaggctgttgtcagggggccactgatggagtgtaaggaagagagacgcaccacctgcccggggcatcctgcaggggaagggagaggactcaaccagcccggcagaggaacagccaggctggagattatgctgcatgcacagtgtacctgaccgtctttaggggtctctgagaatcagtggaaaccttggcctgttaaactagaagcgactttctacaatctcatctcagcccagatgaaacctgttctgtagctctgctaacaattcagggttgcactgcagcactttggctgggctgtgtgcctgtacattctgtgcctgtcagaactgcgctaaggataagaagagtttgagtttctatttttgttaaaccttcaccttctttctttgcacgatggaaaagacagaagtatagaagcttagagtagaagagaaccttttagaggtcaaccccctgagtttcctcattgatagaatgaagtcggatgggctggacatggtggctcatgcctgtaatcccagcacgtcgggaggccaatgtgggcagatcactagagcccaggagtttgagaccagcctgggcaatatggcaaaaccccatatgtacccttccaaaaatacaaaaattagtgagggatggtggtgcgtgcctgtattcttagccactcaggaggcttagatgggaagatcacctgagcctggggaggttgaggctgcagtgagccaagatcatgccactgcactccagcctgggcaacagagtgagaccctgtctcaaaaaaaaaccaaaaatggacagatacagcagcatgtctgagactgcacaggctgtcataaacagcaagccaactgcacacttcagttcttgaccccaggcctcagtgccttgcgttgtcccgtgatactgggttcctatgatatgatgtatttttcatacaatcttcattctgtgttaaagtttcagctccagtggcagagtttccacacacggtgaagtcaaagtcacatgaatccagaggaacagccaaagattgtccccactttaaatgagtgttgctcagaattaagtgcttccacttggcaagaagccactttttcaatagtttttttttcttattttttccagtagtatactgttaaatagtattacattttgttagcctgtgtctacaatcaagtaatacattttcatgacttgaagaaaaatgccatcatcaagtgtgaaattttttagtttgccccagacctttaagcttaagagatttggagcatcttgagagacagagagggagcgagagaggtctgttttcaataacttctctcctcctatcttgttgttcaaaagggacatctgattcctattatccagctgtaactatcaatgaagtcaactttagctccatcacagaaagttgtaaacagctggggacctggcagagaaaatgggctgtgtggcaaggtctcccttcacccgttggcgattgaagaatggctcaccagtacctttaagattccagaaaactccaaagcaatgcagttctcaagtcacagatatgttatcttttaagtacttttggctacacagcagctcattttccaccacttaaaattcagtacccttagttattagataaactgtcttccttgcagggacattcagtactctgtgctgcagaaataaatcctggttttgttgtagaggaaagtaaaatctatagcaggaaagtcatttttgttatctatattgagaatgagctccatcttttccttttgcctgaattacaggtaaaagaaaatgatgaaaatagaattacctaagaaaaacgtattctggttccactcacttggaagttttctatgaatagcaaattttgtctacaggtaaaactcagtactgagcatgtgtaattcattatacacaaagcacatggtattcccaggaccaagtctgtaataatctggggggtgtcacttgctttcattctaaaagggagtttttctcagccatgcctttggaggttaaagcatgaattgactgacctacaaaatgggtgtgacttttttctttgaaactaatattcaccaattataacatatgcacttgtcaatctataatataccgaacaaataccatgtgtatatttttaaaggagctaatttgaggctttatgtctgtcaagaacaagcaagtaatgttagtggtgtttgatttttgttttgttcatgtcactacaatacatactgttttactcccagctttcacttcgtccaagtatttcatccttttgagtgtgtctttacagttcatcagacagctgaatgtagaggtgtaaagatttatactggaaagatttcatgtaataacggctgatggcatttgtgaaactgtccccagagaagtggtgtgtgcgcacagcaccctcctgcctcctctccaaacacaaaattcttttttccaaaggagttgatttcactctttctttgcttagcagtgggcattcagtatgtgcaggttttaaaatattcctttttctgcagctgttatccccaccttgtctagtgaacttcaacaaaaacccaaggcaggtactgtccacatcaacaggacttagtataaggtgtcagtcaccttatatcagtagttgtcccatcagtgttcataagatcattctgatctagttgccagatgcctgtagtttctctccttagagcatggctttggataaatgcaaattagatgaatatagttgttgcatccctgctcctgctgaatggggggagggcaggggctacaaagtgcttcccagcactgtccttctaggcgacccatgtgcatggtggatcataatggaaagtaaatggaaaatgtcatttatctacttactcaaccggcagagctctggtaagtgtttttaatggttagtatttgaagaataataagacctgtaatggaaacggaagaggatgtcttcaattaatttttgttctgtgactgtgccttctgaatggtaggacagatggacaaaatcaaggcataggggaaaaatagctgaaaggtatttagagggcttttcaaagagatttcatgaagaaaacaaaaagatgtgctttttaaagcatttggctacttatttgtaattaaatgccatgttttatctctcctgttgaactgctagtcttctaatgaggcatctctttgttatttgtgtgtgtgtgtgtggaaagtaaaaatcgttgttgaaatcaaacgtaaagacatgaaagtgtgctggggagataactatagagtaaatggaccccttcatcatgacagactgaatgagaacagccatatcaacaagaaggttcttaccgaaggctcctttcttccttttgccaaaataaggtttcacctacttgcctcatcttactggcaaaatactctgagcgatcactaccatatataattctgtatctatctaccttgcctgctttcttcatctcacctcaccccacctccatgccaaagatggcatcagaagatgccaaagatagcatcaaaaggaagaactgaatttctccaactgcactttcgagttggtttttctgcaaggaaaaggtgcttaaatgaaagtaaataaattgtacctgcttttagtatgttagccataagtccttgctgtttcctttattctgtagaagtgagcttacctttggtgataaatatttgaaattgtatgcatttataacatagaccagagagtaatttttttttactgtaactctcataaagaattccagaaacaaggcttctgacccattgggttattgagttcagttcataattattgggtcactgttgttaccctggacatctgaatgggtggaaatggtaatttagattaaataactacaggtaaggatcatcagttacatgtcacgatcacctgtaaaattctgtgatgaccaaagaggtgatgatagggttgggttaatggtaaagaagaaactgtcagtgggatttgaaagtgggacagcatgtcagtaagttaagtgctttcaagattgagatggtttctgtctgagtggatatatgttaatgtgttggagaacagctctgagccttttgaagatatcttagccataacagcaaattatggattcattaggaaaagaaaaataacagctggaagaataaaaatggttcttttaataaacaagatgttaatttgaaattcaacatgtttggaattctagatgtttcaaattgaaatgtaaaattctaagtatctaggattaaaagtccaaaaataatcattcaatttttaaaaagtaattttatgaccttcataagggagagacctctaacctcccgcagttgagcaaatacactctgagagacattagggactgtggcaaaaagcaggcaatccatgtgtgtcacttaagccttgagcacagttcagtaggcaacaaaccaggaactgtcctggcagataagacagactgtgcaaggtcatcgtcatcggcatgggaagggcattaattaccaaagtggagacacagtcactgtctccaagagcatttggaatcacttcacagagttctcaaggaggggaaggctatctgtcagctcctggcgggactgctgccccatatactgtgatgaattgcttcacatatctgagttctgatgggaaggagtccaagtgcggtagctgtagagaacgctggggaagcccagttctgtgtagctcacgtatgaaaggaatattcatgaagagcaaaacagaggcattatttgagattaactgcctgagaaacctagtctaatcccaagtgtctagaaaatgttgactacttgccatgtgcccagtaaggtgcttggagctttatatgcatcctctcatttaaccctgtgacatagttatgctggtacaccttgctgcgttctgtacatgaagaagttgaagctcaaggaagttaaaagaaaaagagaatggaaaagaaaaaagaaaaactcatgtaacatcaaacaactagtagagcccaggtttgaactgttatttggcaccaaagccagccttttaagtccactgtattacactgtcttacataaaatacatagatgtgttttatcccattatttcaatatagacaggtaaacagaattgggccattgtaagaaaataagcaagcaagaatgcaactcaacctgcaaacaagatgcccatggaagtaaattttaccataaacttaggaggtcagaatgaagcaaaaacaaacagtggtaaattcagtgaaagaaaaagcagtttccgaatctccaagtgtattagtccattttcacgctgctataaagaactgcccaagacggggtaatttataaagaaaagaggtttaattgacccacagttctgcatggctgggaaggcctcaggaatcttaacaatcatggcagaaggcaaaggggaagcaaagaccttcttcacatggtgtcaggaaagagagagcatgtgaatgcagtaaaaactaccatttataaaaccaccaggtctcgtgagacttctctcactatcatgagaacagcatggggaaaaccacccccacaatccaatcacctctctccctggacacatggatattacaaatcaagatgagatttgggtgggggcacagagccaaaccatatctccaagatacatcagggcatttctcaacactaaagtttgaagatgcgagtagcagagggatggctctaagacaagccagaacatcagcaaatttgatgaccagttcacctgactttgaaaactgcctattaaaacctaaaatatttatttctgaatcagagaacttgggggtaagtgtattcaaattggaggtaatttggatctgaaaacttttaaaaaccaaatgggtcttgaaaaaattcaaattgttgaataacttttaaaatctttagctcaacagtattaatagtgtaaataaaaaaagataaatgtttccaagaaagcctgcataactcacaggatcccctaatccagtcaagaaggaagggagaggccaggcgttatggctcacgtctgtaatcccagcactttgggaggccgaggcaggcaaatcatgaggtcaggagttcaagaccatcctggccaatggggtgaaaccccatctctactaaaaatacaaaaattagctgggtgggtggcaagtccccgtagtcccagctacttgggaggctgaggcagtagaatcgcttgaacctgggaggcagaggttgcagtgaagccaagatcatgccactgcactccaggctgggcgacagagtgagactctgtctcagagaaggaagggagagagaaactgaagtgaaataggctagttctgccaagagaactgcctttactgcccacgaagctcttcatccctggaaggtgctgttaaagacccttccctacatgtgcgtgcgttgttcttcagctctgtttctaccagtacatgcagtacaagagcaaataaaaccattcagagccatccccaggtgcatcattacagcaaaggctgaaagtatccttgccccacacttggcaaaaataaggatgagtaacatacgagtgaccccaaagccccagtgtacactttggctgttcacacaatgtcctggatgcttgttaatgaaaacaggcctttgtcatagcaaccccagtaaccgaagacatctgatgctcctgccgcacaccctctccccaccccaacccagtgagctattgcagtgttcttacagagctagcgcaacaaaaatattttcagttagcaagcattcttttctgctacttgatctcaatatttctcttttagtttcaccccatttgtcccatagttatgttgataggaaataaatgatcacatttgccctgcaatacagcaaaattttagtgcagggcttaaatgcttgggctgtggacctagagtgtctgagttcaaatcctgactcttcatccctttcctacctgtgtggcttggagcactgatactttttccttatctgtaaaataggaataataatggaagctacctcctagggttaccgagaagattacatgagattaagcctgggaagtgcttggcacagggcttccacgtagtaagtgggcagtagacattcgttgccatcgatattcttgggttgctacttaagaggtttcattttgacattaagtttggaaaatgtgagatcctggccacttgaaactgaaggactacctgtggttaataattatctcacagagatggatacaggttcagctttttcagggggtagcatctccttgtaaaggaggaatacattttgattgtgccacttctatattttgattaggaaatggatctagaaattgcactttattattattattattattattattattattttttgaggcagagtttcactcttgttgcccaggctggagtgcagtggcacaatctcggttcactgcaccctccgcctcccaagttcaagcgattctcctacctcagcctcccaagtagctgggattacaggtgcctgccaccacacccagttaattttattgtatttttagtagagatggggtttcaccatgttggccaggctggtctcaaactcctgacctcaggtgatccacccgcctcggcctcccaaagtgctgggattacaggtgtgagccactgcgcccagcctgcacatttcttgaatagtgttatgtgagtctttcctttttcaacatactcagaggtagaattttctcatattgagatatgcctgtgattggtataactctagcaggaaagcgcttgtgcacggcaggtcctggggaggaggcccagaagtgatgcacctggtgcacctccacctgggtgtggtgtgatttctcccagccacttccaccctagcatctcaaagataccaggggcattggctgaaaaagactgatcacagtcttccagcaatgagtcaaatcactgcctgacctgaattggccagatatgtttgccttcattgcttcaactgtgaacagcatagtgagacaacacccttgtctgaaggagtttctttggctcagtggtgcccacattcaaggtattaaacaccaatagaaactactgagaaggcaaggtcttattcctattgtagaactataagttactctctttaggaaatggctgcaacagaggggaggaagtgttccaaaatgaggccttgagttttctctgcagagctttccagaatatgttaaacagaagcaggaggcagctgatcctagttcataagtttccttcctgctcacataaccacctctcactctccacgttcttcaggtatatactatgaagtccagtttctttcatccttcccaaaggccgacccaccagccttacctcagtgactctctatatagttaggctcaaatcgtgtaattaacataagtcaagtgtctgcaaactaagtatttgtttacaagtaataaattctagctcattccctcaactaggatttgtgccttctgtgtacctgtggaaagcattgggtatagacagtggttaaaaaataaactctatgagggcagagagcatgactaaagttaatgagggagacagacacgatgcaaggaaaacaataaatatataattatacattttactcatgaaggaaaaaagaatgacactatgagagaaaacaacatggggaaccaactctggattgaatcagggaggtcctctctgaggaggtgatatttaagccaagactgaaggaagagaatcatccaagtaaaattgggagctagggcatttcaggcagagggagcagtaagcgaggatgagaactccgaggcagctttgtgcgctgtgttctgtgagtgatgacaggtgagagacgaggtaggaggggaaggcagggatagaatcctgaggccctggttgttgtgattttattctgaatggatgcttctgttaggtctgttctcatgccgctagtagacatatacccaagactgggtaatttataaaggaaagtggcttaatggactccagttccacatggctggggaggcctcacaatcatggcagaaggcaaataagaaacaaagtcatgtcttacgtggtggcaggcaagagagcttgtgcagggaaactcccatttataaaatcatcagtctcgtgagacttattcactatcacaagaatagtatgggggaaactgccccatgattcaattatctccacctggacctatccttgacacgtggggattattacaattcaaggtgaaacgtgggtggagacacagccaaactatatcaatgctggagacaaaagcagagtagtgaccatccaaattatgttcttgaaaggtctctcggctgagtgcggtggctcacgcctgtaatcccagcacttggggaggtggaggcgggcagatcacgaggtcaggagatcaagaccatcctggctaacacggtgaaaccctgtctctactaaaaatacaaaaaattagccgggcatggtggcaggtgcctgtagttctagctactcgggaggctgaggcaggagaaaagtgtgaacctgggaggcggagcttgcagtgagccaagatcgcaccactgcactccagcctgggcgacagagtgagactccgtctcaaaaaaaaaaaaaaaaaaggtctctctatccattgcctgccaggtggatttgatttgaagaagggaggggagaaggcagaaaactcacagggaggccattgcaataatctggatgaatggaggtggtgactggggctgggactacggcagtagagagggagagaaatgggaagctttgaggtgtgctcaaaggtaaaccagaaattctcgtaggggacaaggagcaggaagggccagagaaaggcctccccatgccttttcaaaactggatcgtacaactagtttgcatttacctttccttctaggttgtattttaccttattcaaaaaggtgataagtgtttctttttttcactagctgagtttttagtaaagcttaagggcccaggacagtctagattctgaagccagggtccgaagtcttacaagtcactgtttattttacagcctaccaggacatcctcggaaagtatttattctaggccaggctccagtattcctggctcaccaggtcatactatctatgtaagtatctacttctggaagtgacatttctgggacaggtaaattagtggattgtaatagcagaatgggtaatccaaaacaaaaactgattcaaagtgatttctatttttgttatgagacctgattttcatttttgtagaacagtctcctcaatcacttttacctttaggtaattacatttatgtgaccatcaacagagtgatcagacgacctgtaaaatgtagtaatatgttgcgggacttaaaaaattcttgcacctaagactccgtctcaaaaaaaaaattcttgcacctaaattgcatatagatatttggggattaaatatatattttatgaagctgatactgagtgttcctaaattctaccacaaagatatttaaatatttagtttattaattatgcggttcttgtttttagccatctgagaggattattggaccatctgtttgagctttttcctttactatcataaattcaggaaattatccttaaggtttgcacatttatctatttcatgaattctacacagattttttcctaagcgttcagtgacttttttaaaaaaacatgattaatatatggtataaagggcaacttctgaagagtataactgtgttaggcaagatgttttggtttttgtttattttaaggccttcactttttaaacaacaggaaatgcgccaactacagtttcctaaagcagtcagactacaaggtaattgttctttctggttaactttgccaggcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagaggtaatacattcctactggttgtgagttgtacaacaatttaccttcccttttgtcacatttgtaataactaccatttggagttcaggtaaatcaggtggtcttttgtctgcctagtatttgcagatttctagaccaggtgctttgaggtattcagaagcccatcatgagaagtgggagaacagaacaatggcacatcaaacaacagtgaagaccagctaaacattagcatgctgggatggaagctgtcgggaggtggggagggggtggggattgtgtgagctgggcagagcaaataagggagtgagggtctcctgggggtcttagtctagtgataagctttaagtatattcatggcatcatgaggagagagaacacaccccctaaattttggtaattacagttttcagcaacttaagaaagttagcatgtgaaagaaaaaataaagtagagcgcatggggcaacagtctagcacaggagtgtgagccagcattctggaatcaaattacctggtctcaacccagggatcaccacatgccgattgtttgactttgaccatgtgacagccattctgctgctagtttcctggaccaggtacagtgctcatacctgtaatcccaacattttgggaggctgagggccggaggattgcttcaggccaggagttgaagaccaccctggacaacatagttgagacctcatctatatatattaaaaaaataagaaaaatggtcctagtttcttcatctgtaaaacagatagggtgatgatagaatctacctcatagggtgttagtgaggattaagcaagctaatctatgtaaagcaattatcagaggccagacttgggggaaatactgagcatgtggcaatttctaccattgttgctacctgtcctcttggggctcgttaatactcggcctgcagacccatctgctgcgggaccagagcctctcagccccttggggtcctcccctccccggtcccatctcagggttgaaggttctctgtggtcgcttcctacccaagtccgtttcccctggccaatcggctcactctcatttttttctcttttattttttgaattagaatcatctgtagactgattttagtccacaaagatgttaacaaatagctgacaaatcagctattcaacaaaggttaaaacagaatataaacaatctagcatctcacagtgctttgaggtcttggagaagaaaaggcatgaaaatgtgattctgtttaattgttctcaattccagatgtataatattatttgataattatatttatgtttattttttattttatatatattgttccttttatttatttactttctaatctgggttttattccagagcatagctctgcgtggaaaaggtccctgtggcaggaagtgatatccattttcatgtagtgccacctagtggtcacttagctgtagctgcacttgcggccgctctcaagcgcaggtgcattggcccgggttgtcagttgccattgaaccccacagagtttcgtagggcataagaggcgaggggaagttcctgaacaaagtgcatagagattggccttggaccctgtggatgagaatttactaatgtttaacccatacaagcaaggggatgtgagtttttttaatggtgttaaggatttggggttcatggtgtgcagtgtacgtgtctgtgtgcgtttcccagcagctccatcaaggcagtaaaacattaagcactcaagagtttgggctttgaggtgaaaatctctgcatttaaaaccagactctgccagacatggtgactcatgtccgtaataccagcactttaggaggccaaggccaaggtgggtggattgcttgagaccaagagtttgagaccagcctggacaacataccaaaattccatctctacagaaaaaaaatacaaaaattagccaggaatgatggcacacgcctgtagtcccagcaacttgggaggctgagatgggaggatcacttgagcccaggaggttgaggctgcattgagccatgatcatgccattgtactccggcctgggtgatagagtgacaccctgtctcaaaaacaaaacaaagcaaacaaaacaaaaaccaccaccacaaaaaaagaaaaaaagaaaaaccagaccgatgctgactaaccacataactttggggaaattatatacctcaatctccttatctgcaaactcaagatagagaacaagaatacctatgctagaagttttctgtaaagagtaagtgagctatttacattagaacagtactgggcacataataagtgcttaagaaaaatgctggctactctcgtaatcagcatacttactgtcataacctggaattatgtcccatggttttctctatgcatagagggtgcccctgggatcagaaatcagatatattagtgaactctttcccaatacttgcatcttgcaactgagagaaatttacaagctgttctattatttattccattaaagtttaacacacttcttttatagacctcatatacatattgcctttttttttttttttttttgaggtggagtctcactctgtcacccagctggagtgtagtggtgcaatcttggctcactgcaacctctgcctcccaggttcaagcagttctgctgcctcagcttcccaagtagctgagactacgggcatgtgccaccatgctgggctaatttttgtattttcagtagagttggggtttctccatgttggccaggctggtcgtgaactcctgacctcaagtgatccacccgccttggcctcacaaggtgctgggattacagatgtgagccaccgcacctggcctttatacatattgccatttaagaaacactgcaagagtcagattagttctgtgcagccattggtgcctccagggccttgctgtcagtgcaggtgcagacctgggccctgaccttgagaccagccttcacccagctgagaccccctagagacaggctgtagctgcagaggagaccctggagcttgtgaaggcttagaatacagacagtccgcccacttactatagaatgtggggaaaagggcaaattctaaaactgagaagtccacccctggctgtgttctccatagctctgtttgaatttcatttctatttgaaagctttttgcattttaattgtaaacattttattcatctggaaaatacttgagcaactactgtgtcccaggagctgctgtcatcactgggaatatgtagttgtaaacaaacagtccttgccctcatggagcttgtggcatcacgtgggagacagacagtaaagaaacagatatgtaatataattttacagagtggtagggctctgaggagaaatgaagcagagtaaagagaaagcgtaccaggggctgggttgctcctctggacagaatggtcacggagatgctgtgtgacagtgggtttgagcagagacatcagcgctgacagggaatgagccctgcaggtgtctgggtgaaaagcactggcagcagaagagacagcaagtgcaaaggccctgaggtgacagaaagcttggcctgttgatggccccaaggaagcctgtgtgcctaggaggatggaagccagaggtgaatgatagtgagattggcgaggtgaatgatagtgagattggcgatgcagccaaggcaggatgccccatgcctggtcaccaaagtcctattttagttatcaaactattttatggtgattgctgtggttgtaatttagtcaacaaccatgtgaacaagatcctatgtttcagtagatgctgtaactcatcatagtaaaatgagcgtagtttgaatatataagggaaatggttccaacttgtctagcttaatcacctaagtatgtatcacaatcatatctagtcatggttcttttttttttttttttttttttgagacagagtctcgctctgtctcccaggctggagtgcagtggcgtgatctcggctcactgcaagcttcgccttccgggttcacgccattctcctgcctcagcctcccaagtagctgggactacaggcgcccgccaccgcgcctggctaattttttgtagtttttagtagagacggggtttcaccatgttagccaggatggtctcgatctcctgaccttgtggtccgccagcctcagcctcccaaagtgctgggattacagacgtgagccaccgcacccggcctattcatggttcttaggcagagatgtgcaccagaatctccccggaactttgtcagagtctacctgtctgagccccatggcagatgcatttgtacctgatcagaagacagggagatgtggagggatgctggcaggtacatgttggctaatatttacagctgactctgataaacaactctaattaaaactggcaaagaggccaggcgcggtggctcacgcctgtaatcccaaaactttgggaggctaaggggggcggatcatgaggtcagaagatagagaccatcctgactaacgcagtgaaaccccatctctactaaaaatacaaaaaaagtagctgggggtggtggcatacgcctgtagtcccagctacttgggaggctgaggcaggagaatcgcttgaacctgggaggcggagattgcagtaaaccgagattgcgccactgcactccagcctgggcgacagagcgagactccatctcaaacaaacaaacaaacaaacaaaacggcaaagagttaacaaacattgtgactttaaattctcttttatttttctagtctccgaggactttgtctcctactccatcagcagaagtaagtaccatttctttttatcattttaatgggtggaatttgagaattgcttggcccttccctagactgggatttttgaaaaagaacataacatacaaaagaacagaaaaactgcatgtggggttatggtggctttggggattacctccgtgaaagaggagactctaagacacagcaatatatttctcttaaattggagaccagggagtaaaaatggcctcactttaatctgtgtctgtgcctgtaagtggaagcaaagtgtctgcaggaacataagtcacttgtcccaatgtggggctctttgtccgcatctataattaatttttctgaaccctaatatactgaaatggccaacagccatcatggcgtattctataagcagagccatcttgatgggaggttactctgtttagtctgaaatcaatcatctgatcctaaaaccaagcaactttctggatattatgaaactggactacttttagggaatctctgtaattcaaagtagtaaaaataccataatattttcatggtttatgactgctatgaattattaatttctacctatattctaataatttgcattgaatttatgaagaattaatttctattgaccaactgtgcaagcttgaagcacataatctggggactttttgttttgttgttgttttatttaatttattgttatagacaactagtatcaagccaaagtttccccttgccatttgctctcaaattccacaaagctatggttactgaggtgttcatttagtcgttattaatgcattctttcaaactttttacttttattgtgctagtagaaatttcataggacaacagattcctaaaatgtaaaatattctttgtactctttcaactctttagacagttttatattgtgtgtgtgcatgtggttttttgtacttattacctaatatatccttttctagatttggagataggtgacattttagtggtgctatgatattccattgaattcgcatgtcataatttcctttttttttgagacagagtctcactctgttgcccaggctggggtgtagtggcacaatcttggctcactgcaacctctgcctcctgggttctagtgattctcctgtctcagcctcccaagtagctgggattacaggtgcacaccaccatgctcagctaatttatgtatgtttagtagagacagggtttcaccatgttgggcaggctggtcgcaaactcctgacctcaggtgatccacccaccttggcctcccagagtgctgaaattacaggcatgagccactgtgcctggcccgtatgtcataatttcttaattgtgccccaatttgttgaacatgtaacgcaaatttttgcctttatgaatagtagtactatgaaagtatttgaataaattattcctccttttaaagggcattttaaattattttcttgggatatgtttcccaaagtgagaagtaaaataccggctttatggcaaccatcaacttgttattcaggagaatttatttaaaatgccaccagatcaatgtcgtagacagtacagtttggttggtggtcagaacgaaggaagagattagagtcaggagtctggttccgaagcaggctctgcccataccaactacatgcctacacacagggctcttaccagcttggaaccatgtttctacattagtgggggagggaggtgatagtatgtgacctaccttttcttgttatgcagatctggtaggtatgtgaacatacttatgaaacggaaaagtacaatgtcagcatggtcattggaattattatctcttgtcccatagccctatctctattaaggtttatatgttttcatccttaaaattttttttttttaaagaaacagtgtctcactctgtcgtccaggctggagtgcactggcacaatcatagtttactgcagcctcgaactcctgagtagctgggactgcaggcatgtgccatcatccctggctaattttttacagttttttgtaaagacaaggtctcgttgtgttgcccaggctgttctcgaactcctggcttcaagccatcctcccaccttggccccccaaagtgctgagatcacaggtgtgagccaccacacctggctcttaaaattttgtaataagcccaagtactgcagactttgaacaaaatatattagccacagaatgcttatttgcatataaaatacctgcaaaatttgcacataaaaataagtgcatatattaatcaaatatatataaacaagtagacatgatggttccttggcagtgtttgtgaagcgtggttcctactgaggcatggtgatagcctgaatgtgttgaactttgtttccaggggtaccaggatgttcgggatcggatgatccatcggtccacgagccagggctccatcaactcccctgtgtacagccgccacagctacactccaaccacgtcccgctctccccagcatttccacagacctggtaagggtgactgttcctggattcactctatataacaaactatgtttctgtgattttttcccctactattgatagcacattgaaaaatcaacgactaaacatttccatccctctcccagagcaaaatgaaaactggtatccaactatattttatgctctatcttttcttgaaacatcagtcatcctaagcctgtgttcattttgatttattaaataattatattttgacagcgagctactggaagcaaggggtttttttaaaaatttttttacgattaacaaaaatctcttcactttgagacttaaaatggagatctcccaaagaaaatattttgatgtgctttttaggcataccaacatcatctaaaattcagtattagccatttttaacagctggattatgtttcccttatctaggtgttagtaagcatgcttggttaagcactttctagaaagaggactcagggctgttcttgatcacttttaagatcgttccaaccctaagattttcagtcattcttaggaaacataaaatcatttccaaccctaagattttccctcagacttggaaaacaaaatcatttccaaccctaagattttcaatcagacttggaaaacatacaattattaggcatcactacagtagagaatgccacaaagtagcagattttagtggaccttcatctgcagagaatttagtctctgtagctactagtgggtgtctcctgtgtgtagtgggagaagaatggagatcccagtacagatccaagattccctgagaaatggattcacaaggaagattctggcctctaataaaacttaatggtgacagtgcgcgtctgtgaagacttcatgttaagcttcttgcttctggacgcatagatgagagcaaacccatatgctacctttttaaaaataaattgtacaagaaatgaaaccaaaagaattaacaggatgataaaaagctgcaatcttctaagaccctagatttaatgatcgtagagaattcaaactatttgatcctttgataatgtataattttctctacactgataaatgtttgtgctatttattgaattacattaaatgaaagttctcaggaattttttttcctttatttcatgggctattatattcattttattcatgcccaggacgtgagtcccgatttaagcctttgtccatttgggtaataagaaatcctttatgctgggccaggcgtggtggctcatgcctgtaatcccagcactttaggaggctgaggcaggtggatcacctgaggtcaagagttcaagaccagcctgaccaatatggtgaaaccctgtctctactaaaaatacaaaaattagctgggcatggtggcatgcgcctgtagtcccagctacttgggaggctgagacaggagaattgctggaacctgggaggcaaaggttgcagtgagccaagatcgcgccattgcactccaacctggatgacagagcaagactccatctcaaaaaaaaaaaaaaaaaaatcctttatgctgccaccctgctcatgtacatatgctgaggtcactgagaccccagccatggagttgccggagcggcgtggggttataggggcattgttgttccaaagacccctgaacagtgaggggagtggtcagtcaacactccttcccccaaaagctcatgtccttactgagaaagtttccatctgttccaattatggttctgatgccaatagactttagaatcttctccttctctcctttcacaatatattacatgtatgcctgatgccacttgttaggctttaaagttattattttgaaggctgcccttccaaagtgaagctggagggattctgatagcatacttgtgatccatatagaacaccccaaagtgtccactccacaagttctagatgccagatgatgatttaaaaccccctcggtctgggttgaatttgaatggtccattcttcctgagataactgagtttccagcctccagtcctcctgctgaagttctcgggatcatatagacctctttgccacacagggaacacaaacatgttttccttctatgtaggcaaaatcaaattaaatttacagtgggatgtttgcttaagaaaaaaaaaacctgacccttacatataaatacaatgattgtcattttttttaataagcatttcagagggttctgttgtgtcaggtgctttttaaaaacagctgttgttgagtctaaatgacgtgcctgctactggctgaacagagaccatccgggtgaccatttctcctcaccaaagccatttattctcagagagtgactctgtacccacctgaacctctttgcaaactctcccctactttgcctcagccttagcaggtgcactcttaaccctttctccttcctcccttttcagcctcctgattaacgttctttattttgttttcccttggaacgatggcactttccctgctcctgtgttaatttctgttcttcttttctgtttccaccgtgccctgcccctgactccttgctgcacagagcttttgtctcctggtgtgcagaggttgtcgtacctgcgcaccagcagcctcagccccacccacagcgactcccgccccaacccccctttccgacaccacttcattccccatatcaaaggtaaggaggcaggtttctccaggcagcaccctgcatagtggagatttattagcaccctgggaaggctaataaggtgtatctccaagagttagtgccgagcttttgagctctcagcatgcctgcgtgtgtcatgactatacccaacagttgtcttagaacgggcatagcatctctcattgggagaaatatgtcacttctaagggctctagatgaagaagcaggaagtatgtttaagaccataagatttattatccactactttgaaaaaagaaaatatatatatatatattattattttgtttttggatgcatcgaaacaaaatataatatatataattggaatattttcctgggttcaatacgcaacgtgtctcagcaaaacacgacagtgtttagtaacagatatccaaaagttgtcttaccggtgataaaccatgaccatattaacatgtttgggcagcattaaaagatctatggcaacatcaatgtttctctttgagccgactctcagagcagtcatcttttgatttgtcctaactcccacatgatgcagaagagaggctttgccttctgttttctgttcctgcctcacatttctgccccatcccttctttttcatcattgtcggcaatgcttctgcagccgtcctcagttgggactctccacactgggggagccgagaaccctgaagaggctacaaaggggtcataatttaaaattaagtaggagttcccagaatggtgcgaacttgatttgaaccaaataaaccaataataatagctgaaggaggaaggaggaggcaagcacagatgttatcacaggtcttaaaacagtcctaaaggactcttaaccatgtgctgctccatgtgtcatggccctgatgcttccattgaggagcttgttctggtttactgaattttcgttgtcagtctaccgaagctttttctttgtgctcacttggttgttgagcggctgaatcctaaaaggtacatgtactgtacttatcagtatgcagtgattttataaatttgctaatttcagcattctctatgttttgaaaataatattgcttattgaagcaatcatgcttatcaaagacacacatacctggagttaaggtacacgtgccatttgccattagcaaattttttgataggtgcaacactctctaaaactcttgacagattattttactttattttatttttttattttttatttgttttgacacagagtctcactctgtcacccaggctggagtacaatggtgcaaacttggctcactgcaacctccacttcccaggctcaagcgattcttatgcctcagcctcctgagtagctgggattacaggtgtgcaccaccacacccagctaatttttgtgtttctggtagagactgggtttcactatgttggccaggctggtctcaaactcctggcttcaagtgatccacccgccttgacctcctaacgtgctgggattacaggcgtgagctatcatgctcagccgacagattattttaaattataagtgctaattagtattttgggggaaaatttttatttataaannnnnnnnnnnnnnnnnnnnggttcaagcaattctcctgccatagcctcctgagtagctgggattacagatgcctgccaccaacacctggctaatttctgtatttttagaagagacagggtttcaccatgttggccaggctggtctcaaactcctgacctcaaataattcacccgcctcagcctcccaaagtgctgggatttcaggcataagccatcatgctcagccgacagattattttaaattataagtgctaattagtattttgggggaaaatttttatttataaaatgtcaagattatactttagagaatgtttataaaatcataaagaaattatgctgtttttttttcttaaaaaaaaaaaaaaacccttcagttgtgtattttaaagagactttaatataacagccattagccaaattaagattttggttatttctgctgaggtgggcagattgcttgagcccaggagttcaagaccagcttgggcaacatggcgaaaccccatctctaccaaaaatacaaaaaaaaattagccgggcatggtggtgcgtgcctgaagtcccagctactcagaggctgaagcaggaggattgcttgagcccaggaggtggaggttgcagtgagctgagatcgagccactgcactccagcctaggtgacagagcaaaaccctgtctcaaaaaaaaaacaaaagaaagaaaacaaagattttggttatttctgatatttaagaaaaaatgcattattgattcattaaaatgtaaacttcctcacttggctattatatgttttaacttgtagagagatactttttgtagaaagaaaagtgtcacaggccctataaagttacacagtttgtccaaataacacagcacaaagtgtccataaatggtcaatgactaatactgcttcatgtccatgagtggccatgtggagagttgaaaagcccatgggcattggaatctgggttcagatatgatctccgtcacttgctagctgtatcaccttgggttgcttatttatcctgttgagtgtcacttgactcctctataaatcaagaacaatgagactcctacatcacgaggtgaagtgtcttggtgtggggcacacccaccttggtcagcatggtgctcttaaattgcttttttttgtttttttggagacagagtctcactgtgttgcccaggctggcatgcagtggcacaatctcagctcactgcagcctccgcctcccagcttcaagcgattcttctgcctcggcctcctgagtagctgggattacaggcgtgcgccaccacgcctagctaattttcgtatttttagtagagacggggtttcaccatgttgaccaggctggtctcgaactcttgacctcaaatgatctggccgcctggggctcccaaagtgctgggattacaggcgtgagccaccgcgcccgaccttaaatcatttttgatgccatcattctgttcacttttcacagcattcttgggaaatgggctcagtgaggagaccaagtacagaggccctggctaagtaactgtccaggggctcaccactaggacatggcagtgctggactagacccaggccccctcctccccaggaacgctccttcatatgagggccatgcgtttcagtataaatatgtgtgaagataatttttaaagcacacttttatttttcatcccttttagccagaaaattgcattcttattgactcttagaccaagaatgatcctcagtcatttagatcacaaaattaagaaatatttacttttccatagaaatattaaatggttataaaaattataacacccctatgttcctaaatggtgctttattaaaaatgtagatatacattcttttctgttttcagtctgcatttgaagtgtttgacaccgtcaggtgttctggatttaaatgataaaaagcattatccaaaaggaattagtgaccctgaacttaaaaacatctaatagtctctctccctttttctttttactagacgtgtgcctatagtttgttcatatgaaatagtctttatgcttcagatgcaaagtgtaatgtacataacagtatatacttagtttttcaatcatatgagctttttgccaaccttaaagataaatcattggctgctttgggcacactgcctattgggcagtcctgctccacagggagcagtgtaaaaaaaaaaaaagatatgtggtggagattttgtacattaaagatattgctttaaaagcctagtgtatttggctaaatgtggattctccaaggaattacgtcttagttattttgaaaaacatgcatccatttacatggaagacctctccagcacttagaaatttctgaatggggggagcctatggccattgataacacatccaagatatctttgagataagtcaatgtcttccagggttttttgtggcccttcattgacttttatcttggagcttgtcttggaacttgagggagtttttgtttgtttgtttgtttgttttgttttgtttttaatggatgtgagctgggagcttgacctaaggtaggatgtccatctcagaggcagggggcgccctttgccactctggcagccagaagcccagccttccattgcccaagtccacttcctgttccttgtttttgcagcatgtgacccaggcctggggcctcactgagctgaggacgcctgcatggttgtaaagctgagatgcacggcacagactgtttctctccttcactggcttccccattcattttccataacatccattgttggttgggtgtatttttatttctgtcctccaaacttccttgtagcctcattctatcttagtatatctttgggccatttggacaaccttatgcctagagatttggaaaaaccattttcgctttgtttcgggcttcgtttgtaaagtgtctgctaagtttctcttgcttcccctttgaaatactgctagacatgacattctgtgtccatgaagtataaattggatttctgagcaggagggttacatatattaagtttctttgaaaggaatctttcctcttttgctataaatatgagttgccatgatgtaaatatatatttgacacttgctgaaggaaaccgtaactcttattgacgctttagacaagaaccggcaatcttaaaactgtcacaaaattctggatgctgccaacttatcttaaggttccctcaagatgttcatttatatttggggatgtaagcactctgagtccagaaagctaggcagtgctccaacaggtccccacagcagaatcgcacacccccatctctattcgcttgtcttagaattagtcactcgggctctcatggtgccaaaaagaagaatgaaagtggagatgggcatttaaatgtgttaagtacagtgagagtcctgtgagtgaatgctcccctgaggtctaaaaaattagcttactaggctaacaggaaaggaggtaaaaatgaaggccaagaaatagaaatagaaacataaatagaaatatagtagcttgtcactacaatagatgagaacactaacaacttagggtagcccaatctgaggacttaaaggaacaaaatagctatgagtgtgatatatatatatatatgtactattgtattatgtgcgcacacacacacacacacacacagagtagttttgttttttgttttgaggcagaatctcactttgttgccccagctggagtgcagtggtgcaatttcggctcactgcaatctccacctcccgggttcaagcaattctcctgccatagcctcctgagtagctgggattacagatgcctgccaccaacacctggctaatttctgtatttttagaagagacagggtttcaccatgttggccaggctggtctcaaactcctgacctcaaataattcacccgcctcagcctcccaaagtgctgggatttcaggcataagccatcatgctcagccgacagattattttaaattataagtgctaattagtattttgggggaaaatttttatttataaaatgtcannnnnnnnnnnnnnnnnnnnggttgatagagatgacaacgatgatgatgaaaataatgatatcttccaaatatgatatttcatctggtgtgtcacacattactttgtttaagtaaggaactatgcacagatggcctcttagggcccccataagttatttcctgccagggttgggttcaaagttatatcatttaaatagggtattggccaggtgcagtatctcacgcctgtaatcccagcattttgggaggccaaggcgccacagatcacttgaggtcaggagtttgagatcagcctggccaacatgatgaaaccccgtctctactaaaaacacaaaaactagctggatgtggtggcgcatgtctgtaatcccagctacttgggaggctgaggcaggagaatcgcttgaacctgggaggcggaggttacaatgagccgagactgcaccactgcactacagcctgggcaacagagcaagactctgtctcaaaaaaaaataaaaataaaaataaatacagataaggtgtttaatttagaaaagggaaagaggcctcttcctgagaattttcctttttcttttaaaaatgcccaaaatttgtcatgcctttggtatttcaagggctaagaatttggtacctagcaacattatgtattccaagaacttattccccgatgagcggttgtgatatgtgaaaagcacattctgcagaattgctgagatgggtgtgttattgggtctctctttacctgatttttaaaaatgctttgtgggaagttttaaatgattatagttacatctgcttacaaaatttgaacaaagtagtgttttttttttttttttaaaaaaaaaacaactagagaggtgaatgtttgctgaagacatccagcctaatatagaaccacacccaactggtgacagcattcagccagaatccagtccttgggaattcagacagctactccataacctttgagaggctttgaccatattcaagaagtgaggggcttctacaggcactggccaacacagggtcttgttgatagaaatattttaatccctggacaaatgtctaattctaataaccttaaagtttgtgtcctgcatatgcagatatttttgtgtgtgcgtgacactggctaataatgataaaaactgatttaatgggggttcatttgattgtgtattataaccaaaacctacgagaactttcctggaaacatctgattttctgcaaggacagtggaggtctatgtgaaagaacaaaagcatggggcaggggggttcagaagcagtagtaaaagttgagacccattataccttctttcgagaaaagaccgtaagaatgattctgtttttcagttatggattactcttgttaatttctaatgttcataggattaaatcatttttcttcagtgaaacatttatattggagttgtcaaagattagctgtaatgggaaacttataaaaggggtgttgttgtgagcccagtgctgtacacaggtctttacttatcatcatcatttacttggaaactgtgacttaagtgaattgaaatattaaaaaaactagtttttcccctcatcagtgttctaggttgaaataaacgacgttcttcaaggacctgctatatgttgttttgcttaaagttgcagtttccagccgggtgcggtggctcacgcctgtaatcctagcactttgggaggccgaggcgggtggatcacgaggtcaggagattgagaccatcctggctaacatggtgaaaccccgtctctactaaaaaaattcaaaaaattagccgggcgcggtggcgggcgcctgtagtcccagctactcaggagggtgaggcgggagaatggcgtgaacccaggaggcggagcttgcagtgagccaagatcgcgccactgcactccagcctgggcgacagagcgagactccgtctcaaaaaaaaaaaaaaaaaagttgcagtttcctgtaacctgttgatattaagtgaggacttattgcactagcatctggcttcctttaatttagagaaaattgatggtgaatcttgccatggtgcttgctaaattaggccaataaatagctgtggaggtaattaattggcctccttcaatcattcattcacagacatttattaagcacttactcctggccaggcgataccctgagcactgatgatgacaaatgagaccaagttttaattcagcaacaggtttaaaacactatttccttctaaatgcaaattataatcttccttcccctgttttcctctgtgttttttatactcattttttcccgataggaactagttacttctctttaggagagggataaatgagataacatttttataaattagctttttaatagatcaatagtttgggatgatatttcataatttttaggaactaatatatgacttaaataataaagtcaacattataacatatttgggtctggatgctaaaccagctcttgagaagaaaagacaaaagtttcagaacaccaataaccaaaagccagaaatctaaatttgactcagtaatagacacagatcccatatttggaatatcttactgcccatttagtgtagatctgtactctggttacttaaaaatgtacatgctgagacattaaaattctcttaaatgtatattcaaacggtaacaattgacatctttcacacttgactggatagatttagaaaaatttgacctgaagcaactggccagacctctattttctgatgatctatgatttatttaaaattattagtgttaatagataaataaattggactttatcaaaaattttaaacttttgtgcttcaaagaattccaccaaaaaagtgaaaagacaacctacagactgggagaaaatatttgcaagttcatattatttctgacaagagacttgtatccagaatatataaagagctcttacaactcagcagtaaaagtcattacccctactaatttattgagctttaatagtcctgcatcttctggtgtcttcttgagacaagatgtttgcccagacatagggtaggaggacaatttaggccagttacaaatctctttctaattttgcacaagctgaattagtttatcttggccattctcctggtcagaagggagtgatggtggctatggtggcacttaaagcttttgcagccacccctttgctctcttttctgccctggtccctcttctctcctccaagagcaccatgccttccagacaaggtggccagtcctgttgctcctccagtctgcacccttccacaccctcctttctcatgacattccagctgtctggaatatgggcttcccaccctcccattcacctaccctctcacctggtgagcttactctttgatgcccagctcaaacctagcttgaagaattggtgtcaccttcatctgagtctcatagcatttttcttatacctcagagtaaacaattgcatgtcattatatggcatttaagtttgtctccttagatagcctctaagtcccttgagggcagggactatatctcattcatctatttgtcctcagtagtactcagtgcccagccatagtaggtgttcaataaatatttcaatgattgaatcattggcctgggttgagcctcatctttgaagtgaaagatggggagaggtataaatggtcgtgaaatacctggctgacacgcgtctgactctattttatatatttcaaagtgaggaaaacagaaacatatgcaaacacgctgcaattgaaggcactttgtattcctaaggggaaggacttggtgaccacacgggttcccagacttaaccttcagatcggagaaacctctgctaattgccagctgctgccatcatgcttgagagtgatttgtatttgggtttgcctagcccgctcctttacacgcttgggatttaaccacctgacaactgatcctgaatcatgagcaagcagctttccatcgctcccaatctcccctccatctaatcagtttgctgcgagctcacagctttcaatgcatgccattggaatgacgcacctgaccgctagctgcttctaacccagctccacctgagttcaaatctctgcaacggaaaactaaacctgatatcacctttgcaagtcaagttgataaattgagtttgtttcttttgtttctcctttttgatgaacctccttccagtctgttgttttgaatttttattacacttgctttgttttctttgtttctctctcccttctctcattttgttttttccattcttctcattggaggcaatgagccgtccagcggccggaactcccctctcccttaccggccagacagccgccctctaactccaacttacgctcaggcccctaaacatttccatgttccaggtaggagctgacacagtctgtgtcttggtgtcctgtcacagtgtagaatgtagccttgtaacctcgtcttgtctcatctctcatgctcttttaattgggatgcacagttaacaaaccctaaattgcaggatctgacctagggggcctttcaaaagttttatgtgttaaatgccaggattatgttgaaggtttatgttttctaaaataatttttgaagagtgtgggtgatgggtaaaagcagttgggttgttttgttttgttttttactaaaattttaattgtacctttttatcattgccttctgagatatctttctgtggtttgctgtcattgactaattatggcaatggcaatctagttatcttctcatcctaaagactgaaccacagtatcacctgagagaatacttttatatttcctgtttttctctaatgtggagactttctccaaggacttttcagagagatgtagaattgggtgaattggttggtctttctgcagcgcataacagactagccatctccatagcccgtgaagatatcttgcaatttaggcttggtgctgcaagctttgctctagtagtcacaagcatttgctgtcataatgcaaatagtaatttgacatcagaaactgaaataatcagagcccattaatataatatcttaatgtttagaatcagctcactttgtaaggacaggattagccatcagaggtaataatactatatttctaccagcagtatattgttttttgctttgtttagctactgaaagtagtttaataaattacccactatattaatgtaagtgtacatatttagaatctataatcatttttttcttttgcttctaaacttacctaataaaacagaggaaagttcactgagatttatatcacttagttgggactgtcctttctaaaaaagtttaattgaatcttgaaaattaatgttctatatctgggatttttcacataaaaatgccccaccaagatacagtgcccacggttctggggaaacagaaaccttttgaaatttcctgagtatttatagttaaagcaaaatggttccataatccaagggggtcttgtataaatatatacatagtgtttagcatctcttttctttttcattcattctttttttaaaaaatttggcctgtataaattaggatttgttgaacatcccatcagcacaccaggctagccttgcacataaaaagtttctgttttttttaaaaaaacttttgatttttctacattgctttccactgttccactcattagttgaaaagtaaattgagccactggtatctactgggggctcaatttctagacaatagcaatttgggcattttccccaagctggttatgtctttctcaccataagagtacctccactgcttgcgtttcttcctgttttaatcccactttcaatgaagtgtgtatttgaaataaatggctcatgagttaatcacatctttatatatcctaagatgtattacaaaggcttccataacacttgtctatagtaagccactcatttctataatttttctttcaataaactcaatctttgtaatacagaaattaaccttctgggttgtttttgttcaagatcttcagtttgatttgccccttggttgatctgtttttcccatcgctgaactggttcccataatcacacacctttgcttttcatttccacagatcaaggaatcaacatttaccgaaagccacccatctacaaacagcatggtaaaacccgctttcctccgcgtagcttttaaatagcaaagtcagctgaacttctccttgctgtcctctgaaaggcttttcctgctgctgcttttgagagtaaaactggggcatccagcatattatgcctttctggtctactaagatgtaaatattgtaaaattgattctcctggatggagagacttagcttgattagaaagcttctaacctgttgctgagcccatcaaaccatgtatcattctgttcctagagaaggggaagtactggtcacacagcaactcacaaacatcctagcaagtcttttttctttttgccatcaaatatagtcaccctttaaaataattttgatgagactaatttaaactggtgaaaaaccagccacctagaaaaactaatttgactgagcctacatcaacttggctgtccaggtctccagtttcttattgggcatgaagatgtgtgcacagtggagtggacaggatacaggctaacacagaggtcaaggctctgctcccactttctccctaaatggctctgtgacgtcatttctctgtgcttcagttttctcttctgtaaaaaccagttagttagatcagtttgtctctgaacttcctgcaaactaagaatcactaacgtggatgtataattctgttttcctttttttaactcaggaactcacatgactttatgtaaatcacattttcctccaccattattaagtctctgtagatatatcgaccataaatctttgtgaaaagatatctaaagctggtcttcaggcgttttcagaaaattctacacagattgtgcctggaaatttgaaggctgcctttagaattcagctgacattcatgagtccttaagaattaggataacatgaggccaggtgcagtggctcacacctgtaatcccagcactgtgggaggccgaggcaggtggatcatttgaggtcaggagttcaagaccagcccaaccaatgtagcgaaaccctgtctcctctattaaaaataccaaaaaagttagctgggcgtggtggcgcacacctgtaatctcagccacatgggaggctgaggcaggagaatcacttgaattcaggaggcagagattgcagtgagctgagatcacaccactgcactccagcttgggcgacagaatgagactctgtcgccaaaaaaaaaaaaaaaaagaaagaaagaaagaagaattaggacgatgtgaaaatcaaaatcaaataacattgaaaatgcgtaaggaaaaaaattttagaccaaaatcaggaagacaaagagaaatgtatgtatcgtaatggttctagagctatgattttttttctcatcttttttttttgaggttttaaaccatacgcttgctttttaagtttgttaacattgtttttgtttttgtttttttttatggtttattgtctttccacacactcattaacatgtgaatgtttaactactgacttcaccaattctaatgcgtaagtactgtttgaagtcatccttttgttgttaatttaagaataaaattctcagcatttgatttgtcaacttacaggctttaaaaaatactatctttaggtcctcctctctgaacaaaaataatcaaataattaaaatttaaggagattggataatgttagattatttgtttggaaggaattagttgacttcttttcataatatttactttgactgaagtctttcaggcctttgttataattaattaaaaatagcccagccagagcagcgctttccaaaggatgtttttgcaaaacagccattccatgccaaagaaatagttgttatgcccaaaactggtgtctgtgccctgatgcgtttgagaaaggctagatttaaatcaagtcacatttgttcttcataatgcagaacttctgagaacttcttatatgctaacatgttttgtccatctttaagaaggggatttcctatgtagtgttttccaagctgaaatggttttctcatgaggttagagattcagaggaacactgtttcatgcctggccaagactttacctcctaaactgggcacagtggcccacacccatagtctcagctacttgggaggctgaaatgagagacctgcttgagtgcaggagttagaatccagcctgcacaacatagcaagaccctatctccaaggaagggaaaaaagactacccctttgtattgggtgaccttggttgagttatttaagcaaattgagacccagaaggttacccgaaaaatggaggacttagagctgaagattcaaaaggttatttccagattttaaaatatgtaagcccagaagaaaaaagttatttaaggcattataaatacattttgaaatatttagtgacatccctggccgatttgcaaaattagccagaatcagggactgtccatttaacctggtttgttttgctccatctctgtaggttagatctggggctctaagctgtgactcctcctctaagcatagccaataagaactttgtgaactaatattgctgctagtttggcttttgttgttttaaagttggataactcacttgtgtgcacagacctttgaacaaaacaatgagtggaaacggcaaacataagtttcaatgccaaattcctgcaagctgaaagtggattttccaatttccatttctcctaggactcaaggacacatgtatttagtatataaggattagaatgaagtggaccagacagggtgtggtggcccatgcctgtaatcccagcactttgggaggccatggtgggcgaatcacctgaggtcaggagttcgagaccaacctggccaggagaaaccctgtctctactaaaaatgcaaaaatcagctgggcatggtggtgcatgcctttaatcccacctacttgggaggctgaggcaggagaatcccttgaacctgggagacagaggttgcagtgagccaagattgtaccactgcactccagcctgggcgacagagtgagactctgtctcaaataataataataataataataataaaagaatgatctggaccaacatatttgtggcttcttgcccaaagatgcaaagcccgccaaccctctaatgattaacaactacagtcaagtgatagcgtcatgctttcaacttagctctttaattttagattactaattactctaggagagtgttgtccactggaactttctataaggatggaaatgttctatatctgcactggccaggacagtaggcactaatcacatgtgactactgagcagttgaaatatggctagtgaaactgaggagcagaattttaattgtattaattttttttgtttaaatagcctcatctagctagtgctgggcagcactctagaatagggtttttcagatgtagaacacatgtagaatgaagctttgcttctgacgtaaagtaaggaaaatgagttgacttgtcaataggtacctctgagtgactgggccatggataatggtaataaacagaactttctggaactgaaacttttgccagagaacaagaaaactatgtaagtggggttgtaccgccattgtcttacagaccaatagctaagcaacccctgattcccatctagatgcagctgccttggcagcccagagcaagtcctcagaagatatcatcaagttttccaagttcccagcagcccaggcaccagaccccagcgagacaccaaagattgagacggaccactggcctggtcccccctcatttgctgtcgtaggtatgcaactgtcacggctaagtcaaagggacaaactgctaggagagctcaagatgacatgcttaaaaacatgaaagaaaatgtatcctattatgaagattttaaagaaaagtatgaccaagaggtagcatagtgaaaagaactaacgtggtattaacttgttgtacaaaacgcttaaaagttacaaaaacacatccaccagagtcttgttctaaccaaacccactgggatccagaactggtctaaaaccaatggtttgcatggactctcagagttaatactgcagaatcagtaactctgttgaacatagttgagtgaaagccttatggcaagaacattgttctatataattagagtctagtgggtgaatttaccgaatgtttgtagaagcatgacttctttcagttaaatttgttttagactatttctgggttgtagttataattcttaacaaccaatcttaacactgaagcactttcatttttcttgtaagatcatgttgtccatcatgcaaaagggctattgcagagtagtaggtgttctgaaatattacttctgtgaagttatgtgattttacatctaccattttcatgaattctgtgctaaaatgtcatatttcagctgtttcattctttgctccatgctttccaattatgtctgtgtctttactatattatcagtagtgaacctactcggcctaaaaagaagtattagcaaactcagaagctaatactgaaaatttagcgagtcagctttacaaagacacgatcttatcacatttctgttaacaacctaaaaggccttcaattttccaaaatgtcctaatcttcattgtgctatttttaataagttatttttggaatatctttcacaagcaatacaagtggattttaaatcaattgatacttatagaaagagtttaaggaaaaatctacctcctaagttcattattcacaagtgttgtgtacattatattaatgaaatttatctagtccttgcaaacttgtgcctattgattttcattagtgtaaactaaagagagaaacttcacactgacatttataattgtaagaactaagaaccaaccatcagcttttctatgccaatccatgcccttcaggaagttcttgaggccttgaggttgctagtttagtaaattgcttactgggacattaaagcagctacattttggaaagagggagaattaagtttttgttgttgaatttattatcactaagtagtttaaagctcttttagattccaaaaggaggaaaaatttcaggtccattaatcaaaatgctgaaaactaagactattagttaaagtttattttgattagattagcaaactttcctgtttcctcccacagccagattaatccaagcaatttaggaaaacaataattatcttaacctctcaaccattcagacagattcctcctttcctttccctgtctcccctttccagaaagctaaaaaattgaacacaatttactatattgttccaaagtaaaattgtacctgtattaatgcttttgatttacctattagtataaaactcttttgtgaccatttttcaaaggatgagaaaaagaaaaccttagagacccatttctcgaaagaaatagtaaaagtatgctttttattgaatttactaagagtagaagacagagtgatagtattatgaaattctaaatattcagaaaaagagaaaactacaaggtttaaacgcatgtcacaaaacaatgactatcttacctatctgttggtatgtagataaatttgcatttctttctatttgaaaattgaggctgggcgtggtggctcacgcctgtaatcccagcatttttggaggccaaggcaggaggattagttgagccctggagtttgagatcagcctgggcaatatagtgagaccatgtctctataaaaaatatttaaaaatcagtagggtatggtggcatacacctgtggtcgcagctacccaggtgggtgaggtgggaggattgcttgagcctggaggtcgaggctgcactgagccatgattgcatcactgtactccagcctgggcaacagagtgaaaccttgtctcaaaaaagaaaggaaaaaggaaattcacttcaaagacatcaaaataacaactggagatgcccttccatttactaaagtgatctctgaccagtgaacttagactaagttgcaaacccagttctaatggagcagggaggcctaaattcaggccttccttgcattgcacgttgacctggcttgtcacacagggccattttcttgagaaaccagccagtagtgctgagttggtggcaggcatttttgttttctcttgtattgtttacttaaaagtgttaaagaccgttgctgaccttgccagcctaacaaactgaacacagatggactagcccgttaagattcccttgtcttggggctgatgtgagaagttgtctttgctgtggaattaggacctgacatgaaacgcagatctagtggcagagaggaagatgatgaggaacttctgagacgtcggcagcttcaagaagagcaattaatgaaggtttgtccttaaactaccttgctgctgtcttcaatgctagttacataagatctatattttttgaatgactactatgtataaaccatctagataggcaagaggtggtcccagtcttcaaggggcttgaaatctggcaggcaaggcaagacaggtgtctgttaatagtaactagaatatggcagaatacctgctgggctctagaggagatggcattggtgctggaggtcagaggggtgtggaaggtttgggttgttgtgggaaggaaagagagaccacatgggggcatgtgtgcagtgcatgtgttgaaaggctgctggagggccaggcagagcaaggtggtatccacccaggtagtgccacaccttccttccctcatgcagttctgctgaaggaatgactgtgggattgaacatttctccaagtcttttcccaggatgtgggccaggagaaaaggaatgaaaggaacggccaccatgaaggggtcctcttcataccctccttcctgtagcaagggcctgcagcagcccagaaggacagtctgttatcagtcaagaggctgctgaatcctttcaaatgatgttttctaagcatataggaaatgcacgtgatattagtcaaaggatacaaagttgcatttatagtatgatctcagttttatatgtgtgtatacaaaaatactagatagatataaatcaaaagatagtgttatttctgagtgacatattatgggttactcttcttttcttctagattttccaaaatctgtaaaattagcatgtattacctttatttcttgtttttaaacaaatcaaggcaatttctttttaaaggataccagccccagtcttcccttcccacatcaaaaatccacacacactcacacatgccttctgaggtctcctggctctttagggaaagcagaggaaggaaaacgttcttctaacacagagcctgacttagggaaatggagctttgaaactgaaagggctaagagggtttagggtcccaaacttgacctacctcttcaggaactaccaggctctggggccacatgcattcaggccctccagcaagagaaacttcttgtgggatctgctacaaagaaactgcagctccatgaaagtaattgcaagctttgctttcttttttttttttttttccttttttctgtgaatagcttaactcaggcctgggacagttgatcttgaaagaagagatggagaaagagagccgggaaaggtcatctctgttagccagtcgctacgattctcccatcaactcaggtaagcagcaaacccccaaccttccctgattcgagagccagccacctgcttgtaaggcacctgccttgactgttcacttgtggtggaacctacagagtattccacgggaaaggaagtgtgggaaacccactccatgtcaaatgagctcataagcatgtcatgggtcttccataaatgtgtgtttcctttcttctggaaatgggtgaacccttggaggttctcaaaatccatgaaggccaatccccatatactaggtttgtcttctagaacactcatctccaagggaagcagcaaaaggaaatcctctaaaaaacatgatgctttttttcttcttctttttttttttttttttttttagataacatgaataagacattttctaagcattatgattttacattaatatcttcaatagaggccgggtgcggtggctcatgcctgtaatcccagcactttgggaggccaaggcaggcggatcacctgaggtcaggagtttgagaccagcctggtcaacgtggcgaaaccccatctatactaaaaatacagacattagccaggcgtggtggtgggctcctgtaatcccagctactcgggaggctgaggcaggagaatcacttgaacctgggaggtggaggttgcagtgagctgagatcacaccattgcactccagcctgggcgacaagagtgaaactccatctcaaaaaaaaaaagaaaaaaaatcttcaatacaagaactgaggatgaacagtgtttttgatacttttgaagaagatgacttatacactgggctgaaatagcctatcagtgtattttcccctgtatctatttgtcataagccaattctctcttaaaccacaagatttcttctctcatattctgagctagagcataattttctcctctaagagttcctttaaaaatgcatttagtggggagaccaaggcgggcagatcacaaggtcaggagatcgagaccatcctggctaacacagtgaaaccccgtctctactaaaaaatacaaaaatcagccaggtgtggtggcgggctcctgcagtcccggctactcgggaggctgaggcaggagaatggcgtgaacccagaaagctgagcttacattgagccaagattgcgccactgcactccagcctgggtgagagtgagactctgtctcaaaaaaaaaaaatgcatttaatgttcactccatgcaagcatttttgctaaacattttatttaatgttcacaacatgccagtgaagtagatgtggttgttattagcaactgcagcattttcatctctattttagaaatcaggaggctggtatagaaattgagttaacatacccagcgtgatacgccaataactagcaagactaggatttagaagtccacatattataaccccggagcccacacccttacctggaattcccgctacccttcatagatgcctcactggcattgatcttggattcggtggtttacaaatctttagagttccttggaattctgagattctgctctataagaatgtataacattgtacctgcatagatgaagaaatgaggacttcagaaagattaaacaccatgtccggagatacagaggtattaagttgcagaaccagaattcaagcccagggctgctccctctcaagcccagcagcttatcaggcttccatatcattgacagataccctgtatcaggcctcccaggaggccagctgtagatggctggtagatcttgataacatacagggttggcttccagttcagttactgctgccttatcaactggggcatgggctaatgtattcagatatccctgatttacatccttgctcagctgtttagaagcttagtaactgttggcaggatatttttcttagcccctatttctccttctgtaatatggaactaataatcatagtgttattagggttatattgaagattcaaagaaataaagcatgctgaacacttagctccatgccagagctataggaagcacagccagcttcagcccccactcaaccgcgtggacttgactttcccttccctcctcagtcatatcactgtccacccactccttgcaaatatgatggcatatttttgaacatttgagcccaatatgatttgaatttttttggtatttctatcctgtgaggtagaagatactgccaatttcattaaaggattggaccttctgatttcctaacaattggttttttacttttttcttactcagcttcacatattccatcatctaaaactgcatctctccctggctatggaagaaatgggcttcaccgggtaagatttctccccgattcattgtttctgcctttactcccacctcggccctggttgaagtattgacacattgcctgaatacgtctgactcttgatctcagtgttggaacataatgaaaattttaacctccctggttgcctagtaaattaatttgagttacaggcaaaataaaatgtttctattgagagaagaagaaattaactttagataaaagaatggcttgtgtatgattatgggaaaactaaattgcaaaactgtatggcaaatattttttacaatgaaacaaaaagtaattacttgaaccattatctttgctgtaaaaagatataagaatgtgtgttataaccatcctcctcacaaaagatggaacaaatacaattatgtaactatgtaggacaatgcatttttatttatcagcaagagatccctgcttaccaagagcctgctgagtggtggcattagtacactaaaaaagacaaagagatggcatagcagtagaagaatcatagggaaaaaaaaaatgaaggtctgacatttagcttgggaagaattcctaggattttgtaaactctttcttccttttcacctgactccaaaacgatcactatggagatttcctaataattgtttttcctcatttcagcctgtttctaccgacttcgctcagtataacagctatggggatgtcagcgggggagtgcgaggtgaggctcccatggccaggctgagcatggccacgtcttccctcgaggctgaggttcatgagagtcaagtatactggctgtgttcatgctgtattgtatccttagagtaggatcacatctgtcttctgtgagctaatagggcaattatttacaaaatttcaaagaatatctaatgaaatcaaactgtaagaagtgagtttgtgagaatttattcattgctcatactatgtgctgagcactctatcagatacctagaggccaggcatggtggctcatgcctgcaatcccaacactttgggaggctgaggcggaaggattacttgaagccaggagttctagactaggttgggcaacaaagtgggcctgtctctaccaacaacaacaaaaacaacaacaacaaattataataattagctggtggcacatgcctgtagtcccagctacttgggaggctgaggcaggagaattgcttaagcccaggagttcaaggctgcagtgagctatgttcatgccactgcactccagcctgggtgacggagcaagactgtctcttaaaaaaaaaaaaagtaactggaggtacaacaataagtgagacatggcccctgccctcaaaatgcatatggcagaaagaaggtctgtgtgatgaacattgggatcagagatgcagagaaggaagcagtaagtacctttaggttgtcagcgaaagcttccaggggaaaatgttttaactgttaactaacactggaccaggcatttcttggcttcagggaggctgatgggataacatgtgcagagtctgggagcagaaaaagaacatggtttatagggcgaatatgttgggaatttcaatataatatagtctgtgaatggttccttgcttttccatggtctttcccttatgatattttcttttcctttccttttcagattaccaggtatggaacactttgtctttcttgaattggccacaccgatagaacagccatgttccaacccagactgctggctccaaggcaacagtttctgttgagaagatgcttgttgtggttgatctctctagtcattactctatagccgtgaagagcagacatgcctggtgcctgggtcaagctgtccctgcaggccttggggacactgcatgaaccaggccaggtgtagggggtctctcttgctttggccttggagagtcctctctggggtggaagtggaccagcatcaagggtctgctcatatacagtttttcttcttttaattataatctctcagtactttaggccacccttttcctgcgcgttctcaaatgaaaagacactgatgtcttagccaataggagagagcagtttgccctcatgacattcctttctcactagaacctcaatcttgttaaaaaaagaaagaaagaaatgtgatggagaataagaaaagaagaaaaatgcatagaaaatcatgattaaagataagaaactaacaataatagacttgggcatcttttaaatgtactatatgctttcattcatggagcctaattcaggaatttgtccataaccatcaagccaagatctctccccaacttgattgcaaaagagctgtattcctgttcctatacagcaaggatctcattttgaaaaatacatggtcatttagatgacacaaataaaatagtggttaggattggagacccaacagggaattgggagcccaagagtactcccttcagtttcctagactatttcatgcctcacctggaactggcatttctgttgcagacactcccagatggccacatgcctgcaatgagaatggaccgaggagtgtctatgcccaacatgttggaaccaaaggcaagtgcagctgttctttttcctctcatatgggaatggcgtaaccctaaacagatttgatgttctatcttttcatcattctcaaagtgttgtaggctggtgtgttcaggtgagccatgtcatgaatatgcaccttgccattctgctgttttgcccacatcaggtcagcaggttaaacccttactgggcatgatgctgtgtgtttacagtgaggtgccagtccctctctgcctatgaccaaggtattcccttggcctctgccatgtgcattacagagcatatccggtgctgagtggagtggctgcagactcaccatgtaggtgaggcaaccctgtttcaccattgaaagccctgcatttcaagaacctcagtcctgggtacactggggtgactggccaccctagctccagagcaccctgtaccttcagagttgtccaagggctcatgctccctggtgaccataaccagggcttatttcaatatggcagttgccagagcactgcttctgggcctgcctggccccatagattcatgagctagtcatgggacaagattgttaaccccagcacaaatgcaccctgccctataacagcatcctataaaaggtaacacattggctgggcacagtggcttacgcctgtaatccaagcactttggaaggccaaggcgggtagatggcttgagttcaggaatttaagaccagcctgagcaacatggcaaaatcccatctctactaaaacttaaaaaaaattgcttggcatgacgacatgtgcctatagtcccagctactcgggagggtaagataggagggtcacctgggcctgataggttgaggctacagtgagctgtgatcacaccactgcatccagcctgggcaacagagcaagccctgtctacaaacaaaaaaagaaaaacaaaaacaaaaaacacgtgcctgtaatttccattatcttctaatgtttaccttcatcccaatacatagtaagttagtgttctgccactcaacaaagcccccctaaggctcagtgctacctgagacactggtggaaagttgagaatgtctaagattctgtccctgtcccctggaaactggagcttccactggccttgcagaaggaagacccatcactcgaattctgtcatgacagtctcttggaagctctatcttgggagtactagcgtttaggtggattctgcttgttaataaaatggactgtggtgttctagaagaggtgttttctttcttctcagatatttccatatgaaatgctcatggtgaccaacagagggcgaaacaaaatcctcagagaggtggacagaaccaggctggaggtaaaacaaaaccgaaaaatccagtcccaactgcagatccctatgcactcccccaactctcccctaagcaatgttttatttcttcagtgaaaacaaaaaaaaattataaagatcaccctcatgtcataggtagaactaagaaataactttggagaaaaaaaatatccaggttttcacttagatcagcataaaaatgcctggtaatatccagaagaatgacccaggaggtgggcatggtggctcacgcccataatcccaacactttaggaggccgaggtaggcagatcacttgaggtcaggagttcaagaccagcctggccaacacggtgaaaccctgtctctactaaaaatacaaaaattcacggggcatggtggcaggtgcctgtagtcccagctacttgggaggctgaggcaggagaatcgcttgaatccaggaggtggaggttgcaatgagccaagatcacaccactgtactccagcttgggcaacagagcctgactccgtctaaaaaaaaaaaaaaaagaaagaaagaaaaagaaaaaaagaatgacccaggagacacagaatgatttcagtcattttctttgaaacttgatgttgccataattatggctggtaattcagaatgggagtcgctatttctcttgagatagtctcagatccttatcttcccctgagctggggttgagttcatgggaggctgtgggagcggcaaaggctctcaggagagacatttatactgatttatactggacaagtttctttcttggctgtttccacattccttgttgaagggttatctgggtacatgtacccaagatctccttagacatggaagactaatttttgtattatagttttccatcccaatgattttaattaagaaaaaccctggctgccagtctccgaaagaatgcttactttttcctgacaaaaggcagtaccttggcgtagaggtacagagaataaaggctgcaggatcttgggggaacttttctaggggggaatgactgatgggaagtcttctcagtagaacagacatccaccttaccccctattcctcagccaggaggaagccctggggctccccagggaccacgctggaggtcattttctttggctttctattgcgatagtccattttccctgcatcttctcaacgttccaaggacctgggatggagttgtctccaatgtaataaatcacctctctgtgtcccatcaccagtcagtgttattattataatccccattaatactctgccagctcttttatctgatgggaagggctcctcacctggcccaaccaggtaagggatactgatgtcacaagcattaaagatgggctcctctcccgtcctcctgccttgttcttcagaatgactctgtataaactatagagcaacgctcaaggccatttgtgtggccatcaggactgacagcagctcttttttttttttcttcttcccagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtagatgcctccatacctgtgtttcatttctcgttccctggctccctttgaaggtctatctcattttaaaaagcaccaacgcaacttccaataatcaaaacaaaatcagaatgaacccaaggctgtgggaatgcatttttatcatgcaggtggaaaaatgcagcaaataacagcaggatattccaggactatgtgtccaataacccagaccatattgaccaagctgtccaaaggaaagaaatgtttagtagagccattacactgtgctgtgtcatgggtgtttgatttggtttgtgacacagcagggatagtcccatcatttcgacaaagctggggatttgaggaggtttgaagcttctgagccactatgagtgtgggccactttttagtaagaagctagaatgcagtaggagaaaagcatccttccaattttgggcatcccctgcatgatcaaactttacatgaagaaattgtagatgttaacttccttgttatcatcactgccaagattttaggcttgccagaaagtacaaggatctatgtccaagatggcccactccaacgatagccttccttctgctctgtgtctgctgagactacccaagacccagtcacactggcattcacatgaccctcccctggaagcgggatgcaggttgttttcaagacagttggcatctttagttcaccaccatggaaaacaggccgggagacctcagctcaaggtctgtgttctgctcatctctgcctccacccgtgggaaagcatccctgctgtggtccataattaccatagctaggggtcatctccagtccttatgaactctctgtgggatttggctctggtggccacctctccaatggaagttgacccgtgcctcacttcagttgctagactttagtcagcgaatctcacactgcctttgctgggagtggaaggatctcgcctcacccactgctcagctgcctctcccccagtaccctgccttcagatcttgccaaaccactgcaagttcccaggacataccatgcttgctccctcccaggcagctttatcaaaggtatttcttctttacgatgctcaactcttcaaggaggtggtggagcagagaggacctggccccagggaaaggaagtaatgatcaatgttgactctttaaaaacagctacccatcagctctttggagttacccatgtgaatttcccatgggctccatttgttccaaattaaagacaagtccaagttcacaccctctctatgagcctgtcttaatgggcccagcccaatctgcatgtaattctttgcatgcctctagttgaacctcaaggtcggtacttagcaagtgttgcctcgaactgctagctgcgtgggtttctgctcttcagttgaactgtagtgagatctctgtgctgagcgccaggcaccctagcttggcataactatattgctcgtgagagcctttcaaagtagacaattgtagctccactatacaggtaggaaaccaaagctcagagtctaatcaaacatgcccaatcactcagccagtgagcagcagagctagaattctccaggtctgcccttttcagatcccatgctgttatcctccacatcccattccctgtgactttcttagggcaaggactgtgtcccacattctgaatctcccagggcacactgcacagagtgggttcttagtgtgagactggccagcgcccttcagtgtggccatgagccccaacactaccaccaaggcgcatttatgaacagtttgggggttactcactgtctgtgtgtcttggagcctgtttagcctctcttcagcctcaatttgttcatctgcagaatggacaagataataatatccatcaaaagactgttgccaaattatagcacgtgagcacttaggtggttgaataaggactagtattattttaaataatcatttgagaatgaattagttttcactctgggctttttacccctccctctagtcattttgttt

SEQ ID NO: 16655 - DNA, 64593 bp, Human; identical to SEQ ID NO: 16654
  misc_feature (1)...(64593): n = A,T,C or G

SEQ ID NO: 16656 - DNA, 64593 bp, Human; identical to SEQ ID NO: 16654
  misc_feature (1)...(64593): n = A,T,C or G

SEQ ID NO: 16657 - DNA, 30847 bp, Human
  misc_feature (1)...(30847): n = A,T,C or G
aagtacagagttcccatatgcccccttcctcccctgtgagcagtttctcctattattaacttcctgcatttgtgtgtttcaactgctgcaattgatgaaccaacactgctctgttgttactagcagaagtccacacgtcagggtttgtgtgttgcgcattctgtgggttttgacgaatgcacagtatcatgtacccaccatccggtatcatgcctcccgtgtattttcagtgctggggccaaaaaaagcttttgcgggtagaaaaagagaaggctctagaattttaccacagatgtcaggcttagattaggtcaagaaggtcagtattaagatagccctgatgaagaatcaggaactacaggcggcgtaggtgctggtggctggggatgaggccaagaaccacctatcacccttgccacagtgccgccagacaggtccctccacataggccaccctcttgcctctgctttgggaccaacaaaccccatggcctggaagggcctcaacctgtggccatggggtttggtggccccaaagcagaggaaagagggcggcctacggtgccccaccatgagctccagctggtcagatctgagtctgcaattggagaagcttcctgccctcaggagaggaagactcgggacacctgtgggtggcaggtcaggctgtgctctgcattgtgagcaagcccaggcctgcacggcttggatccaaagctacgcagtgaggcctgctctgctctcctgggtagttgcagcgggacccctcacattctcctacatttgaagaagtgaacatcctcctggtagtctgggtgccgctccaggctcctgccccttgcttgctgggtgaccctggacaaatctataacacctcgctttggctttcagtttcctcacccataaaacggggaccatcctagtatcacctaatgataggtgagttgcaaaggctggggcagatgacccagctccttccaccgtacctggcgcactgagacactcagtgcatattcatgcatgttactggaatcccagtggccccgggtccagccgctggtcgggtgtaatgtcaaaggacaggactcagggcttcaagaggctcttcacactgtgcattgtggggagctcacctgagcagcgagcagacgcaggagacagctggagatgaccaggaatcagagatggcggctgcaggcggcagaaagaactagaatgcaggccaccagagttcacgctcggttatgctgctcagaggggataggggccccgcggcattccttgcacacctgacttccctgactgggacaaaggagttggttagcgtggtgcttcccaaagacgtatgcactgaagccctggggatcatggtaatgttcgtgctgattctgtgggtctggggtgtggacagagcatctgcatttctaacaagcaccctcccgggagtgcccaagccactggtccacagagcacacctggagtcttaagcaagatcaggactgtatctaaggctgtttcccgccccttgcctcccaggaccgctctattcatccttcagccccaaagtcacagcatcccgctgtaaaccctccgcatgcctgtcctcgctcccccatctcccggttcacagttctgtcgtagtcagttcttaccaaatcataggcacctgctctaggccagggtccatgggccctgagataccatggaaatgcaaaggcaagtctccgccttcatgcagcataggatctggctgatgagatcatcactttggccacaccactgttcaccccacatgaaagagcaccctggggaaagccagggtctgtgtctccttcattctctgccccatgcctggtgcaaggtctgaggcagagacggactatggacagcaggtagtttgctccacgtgttttcattaattcctgtgctcagtagggaaactgacatgagcatggtgcttgaatccatcacatttcatactaacgctacattttcttccagtcattgccatctggacacatacaaggaacttttgaactggcaaataaagaagaaaacagagaaaaaaacagatatcccaacatccttcccagtaagattttattttatgttttgcatgatcaatggtgtttgcactaaactcagctttgccttgcagctccccgtgactgcaggccattcctggtgctcagaggccccaaatcagtctaactgctcagcatttgcacctaggactccagaacgttcctctttaggtgcccatctccctgcacaggccctgggtaccttggttgctcgtgggtctggctgccaagcctgtgcttactgttgggacctgggctgcctggggcccagcgggtaagggtgctgcttcgtggccatgggtgccagctggcagggcccctcctgtggaactcaggcctggcacccagtctaggcctgccagtggccctgggcagctcccttccctcagactcagtgcttgtgaccacaagctgcaaatccctagagttgtctggggtcctggaccaatgacaaaaataatagaatacgaaatttgtaggtgggcagcagctttgtaggaaggctctgaatcgacctgatttaaccccagcagtacaagtgggcatgggctggggagcgtgggtgccaggaggtggcagggccagagagcagacggatgtgtgcgggggtgcgtctcggtgacctgctccagctggatgggtcgtgacctgggggcagctttcacagcctgtcttggtgccaagacaaaccctgtaggttctgaaccgcctttgtaagacctggcccgggccgggtgctgtggctcatgtctgtaatcccagcactctgggaggccgaggcaggtggatcacctgaagtcaggagttcaagaccagcctggccaagatggtgaaaccccgtctctactaaaaatacaaaatattagccgggcatggtggtggacgcctgtaattccagctacgtgggagactgaggcaggagaatctcttgaacctgggagacagaggttgccatgagccgagatcgcgccattgcactccagcctggggaacaagagcgaaactccatctcaaaaaaaaaaaaagatctggcccagcagcaggggggcggggcgtgcagttggggatccttcacctgggcccctcccatcatctgctttgcccatcaggctaacaaaatggcatcctcaaagggctccactaagttcaggtttaaatcccgaacctgcagcctccgcctggtccacaaagggagtccatcccaccctgccagggccttggtgggatggaggaaggcagcccatgtgggccccggaatgctgctccctgctgcatttttaggactagaattgagttcatctgctctgtatgtcagagcagctatgatctgtccgatctgtggtctgtccaaactgtgcactttttagaaataattctgtcccattttacatgcgtgggattgatatgtggttttcacaaaacccactgtgaacccatgatccaatgaaaactgggagaaattcatcaaatagtctttcattcaacacatatgtgtaggggtggccaaggcaacaccaggaagatgggtcaggaggtcatgtggtggccacacagctgagccttgacagtggctcagacatggctagatgctgcacactttggagaggatttgttgccaatgggtagaagatatcacagaaagaggggaggcaacttacatggcttgagcagctcaaaggaaaggaaggccgtggcaggaggaggtctgagatctttggaataatgtgtgtcaaatttgggatatttagaaattagtttcactgcttaatttattaccttaattgagtggttttaagttgtgccttgatttgccaaccatatgtgttaagaaaccgctcagtgctaagcacattcctgaattcctcatttctctcaatcactaaaccttcatcccttaaaggtaacatcacattgttaattaagactatttagctgggacctctgtggaagcagaatcatggccaagtgtgggcattacctacacccagtccccttctcaaagtgtgatggcccagggcagagcagtggcctcacctgggagtcccccacctggaagaggccgggcccacccactgcaagtcttctctgagccacgttctcaagtcttctctgagccgcgttctccaggttgtgctgctggagtcagttggcatttcctccaagcctgaaagtgtagtcagattcagaatgggcttttctagattcccctgtaagatctttcccctgctcctggcaggagcaccacaccatgggaaccccagggcccacgcagctgcccgggactgggggaccaggacatggcacttctcacatgggtggaaagatgggtttacagaatggtggcatggagacgctgtggcctggcaaggatcaatggggtggcatctggcattagccatcaggaagacttaaggctgaagggacattgggcagggagctctcagggctgctccacccgcccccagggtgacagcccatagtatcacttagggtgggactgagagtcacctgggggagaggagagaaggggcccaacttccccagcccctagtatcacttagggtgggactgagagtcacctgggggagaggagagaagggacccaacttccccagcccctggcaccttccctgcctttcccagtcttttaccagagtcataagatggtccttggctctgggcaggcatgtggccctggggagctctggggtcagaggtcaaggtgctttgcatgtcaggcaggcttgacttttgcctgtagaaagactatagaaagatggcaagctaggcctcttttctggaaaagtgccaacagctgataattttaggaaataatgttttgaatgtgaagtgtgactttttagaataaaaagacaggaagctcttagaaactgcaagattctaaatctaagcagaaggctatattttaccctgtgcttttctatagctgtcctcaaagcgtaaaccattccaaattattttcaactagtgttatatgtgttcagcagagctatttctgcctgggcattgccagtccctgagcaggagggtctcacagtgaggtctgcaggactgtaagtttggggtctgactccctggccaccctgtgtgggctgtgactgtctctcagagctatacccgccctttctctgctggcagcccgacagagctggctcaaccatcggaggtcgcaggccaccagcccgtggcccacctggcagccttccaggtgaaggtgagacaaacaaggcatgacctgggggccgcccggctccccatcacaaacgccacaaacaccacaaacacaacccaccctgatcagagactaagcagagaaagcagggagaggacctagagttactcagtaatgactcaggaaggagaccctaagcttctaccacatgccagactctgtgcccagtgcagcataaacgtcctcagaaccagcctggtcccagcctggccgagccggacgttcctgggaaaggttacaggaggagcagggccaggcccacagcacttttagaagcccatgaaaatgtcttcatttctcttcaaatcacaaacaaaacgtgcaaaacccattctggagtgcatcttttcactggcgaccaacccagtcctaagataaccttcttaatagttctatggaggaagctgcaaaggcagaagtgactacaacccacaaaagtcatgatggagccctgacgtgtgtgtacacacacactacatgcacacacacacacacaacacacacactacacacccaccgcacataacacacacacatacacactccacacacacaccacacactccacacaaacatatcacacacataccacacacatacacaccacacacataccacacactacacacacacacacacactacacatacacaccaaacccacatgcacacattcacacagcatacacactacacacatgcacaccacacatacaccacacacactacacacatgcaccatacacaccacacacacaccacacattacacacatacacaaccacacacaccacacacacaatacacacacaccacactcactacacacacaccccacacacagagcactccacggtcagccttctaccccggaaaactgcttgtgcaacaggctggatctaccagacgctcctcactgtgctcgccttccagctctggggcagactccggtggtgggactgagggtcagagtccccaatcctagacccccacatccacttgtcctcatggggctggtgctcatttccctgggaagcctgggagagtggacccagttctcctgtcctggggctcttttaagtgcacccacacttggcaacactggggctgggcccagtgcagggttcataaaatacagcccttgcactgccaggggcctggcacattctgccattcttgctatgtaatgacccagcagcccccatcctggatgctgaaatcctacccttgtcgtcatgccacagctgagacagtcagtgttcaccaaagcaggtgcattctctctcaggacactagtgttctccatgggaacgctgaggaagaacatctctgccacccccggtgtcgctgtgaagctgcttttgcccttcccaggagctgacactgcagatgaagagacagcactgtgatttctggaagagacagcactgtgattcctggtcctaatatcttggctttgtttgggttttttttccagatgaccattctagggtgattctgagccaactggatggaattccctgttcagactacatcaatgcttcctacatagatgtaagtgggcagaggtttcttgttcccctggcccagctggggcatgagcagtaagcactttcttgtctggtgcccggagtgtaaattgtcacaacctttctgggcagtttggccacaagcacaaagggtacggaactgcccgtactttacacactggcatcagcatctgggaatttgatttcaagagacagagatgatcacagaggatgttcactacagcattatgtatattcctgaccaaatagaacagggagcatgggtagttaaacagattgtggtaaaaccatgtgcagtggactattagaacttgatttgtattaatctttaaaagatcatttaatatcaattataaaattcccattaaaaatacaacataaaataaattgtacatgttcacccaattagaggacagaaatgtctgcatgtctgcttgtgggtgagtctgggaaaggtttggcagaaaaacagactagagaggggacgtatgaagtaggatttgttatttctggaattgctggtgagttttctttccttcttaaccttttcctgtgttttgcaaattttccatggtgaatatgtactgctttcctaacagcaacaccaacaaatcctttcagcaaagataattctgaaaaaatataaatctgatgttattttttctagggttacaaagagaagaataaattcatagcagctcaaggtaagctttttactaatttctcaacgtatttttggtaacgtgaatagctcttatttccttctctgtatgccaacaagaccaaggacttatactggatttgtgtgtgtgtgtttacacctaacagacacgttagatatccattcacacaacggatatgtgtagtcagagaaacacacacttattcccacacctatatggtgtgaacacagggcacgcagtggccccggctgccattccagcttgttaatacttgcatcagataaccttgaatttctctcagctggctgagccctacatggcacccaagtttgggcgaggggttagtggggtgaatagcttttcagatcaaggccataactaagaatatacttcagctgtgaaaacgtgcccttcaccttgcacagggctaccttgtgtgttgagtactgaatccagcatcactccgttccaccagaggttgtcatctgcaggacctggtgtacgtgcggttagatatcagtggagctgaaaccagattcctcagacttcctcactcttaggccaggagtctttagggcaatgagctctgaaagtcagcgtccatcaaaatcacctgggaagttgttacaaatgcagaatctctaagaaaaaaggacacacatgtgcacacgcagaggccatcaggaatgtgcccagctggaaacctcaggaaacctgacgatcctggctgaagcagatgaaagcatgtgtttctctcttgccagcagacacccacagggagctagcccacggcaggacagcagcagggccaggggcttccttatctccccgcccatccccctcagcacgtagcgcttagctcgggactgcaaaatagccgcagctcagacaggaagtggataggggcagaggactttctcctagtgacactttgtctgttgttcacatccccctcccgagggactttagctcatatcgtattggacagcaccatgctgagagtaagattttgacaaagaggaggggattgggaatgcagggtgaggctggccagtctctgcctctcgcaaggctttcaccagctctcccacacttggctgtagacccagccctcatctgaaccctgcttcttacctgtgaacgtcataactcaacctgggcccaattatcttgcccactgaggagttcctagctggagtgggtgagtggcaggacaggcagcccctaccggttccggaacgcttcagggcatgacgtgtgtgtccccaacaagcctgagaagggagtgaacagctgtccaggggccaacggccagggtgccggggctgggaccccaaagggacttcccttcatgccttttgacttcgaaattgtcctctacacacaggtcccaaacaggaaacggttaacgacttctggagaatggtctgggagcaaaagtctgcgaccatcgtcatgttaacaaacttgaaagaaaggaaagaggtgagttccaggcatctggccccggtatcacttcctttcagctgctgctgccgggctggggatgttcttaccacttccttttcctacttccctcccctcctcccactatcactgcagaaaaaaacccaaacacatgcagtggcttacagcattttcttcacgaaacaaatcccctgtgtccccagcatctcactgttatctaatctgtgataacacaatgacacaagagtttcctttttttcccaagtaagagtggcccccggctggccccatggctctgcctgcctgatgagagacatgaatcttagagttttaggatgttgagcgtgtcatgcggcagagctcagactagaaatgaacatgatttcgcgcttattatccagactagagaaatgcttttggaaaacgttggtatattgaagaaatgttgatttgtcatccgaatatatttaattagctgtttctaattcaaaaaaggatgcatgtacgttataagaatttgaatcattgacaaagaagaaaagttgaactgattcgtttcctaatgtaacaagtactcattagcatctgctgtgctgggccagctctgtcccaggtgcaaggagtaggggctcaaattcagggctgagaagtggtggctgtggggagcctgggtgcgggggtggggttgagtgacaggcagggagccatgccataggcagtgagctcactctccagaatgaaagaagaactgggagcctgagggacacttaccacaggtggggcgaagttaggaggctgtgcttctggcgtgttctggcatgaaggcccggttcagtgggagccgtgtgtcctgcccggccctgctcagggcctgctgtgtcctgagctcctcagtcatctgctggcctggccccagcagttcccaggcattgtagcgaggactgtggggaagggctgccatttttagatgggagtaccaggccttggggagctcagctggggcagaagatgggtggcaggagcccacaggaagggcaggctgggaggtgctctggtccccgcagtgccagcttactaattgccacccaaaacacaggaagcagcctccagccaccgtttctggtcaggaataggatggaggctttcattctgctctggggggagctgaaacaggactgtggagggccacccctttgcccttgcaaatcttgcccttgtcatgctttgtcatggggaagagggaagagtgacagagggaagtaggggattcccagcccaggactcttcactctgcctgcgctgtagcggccatggaggaggacacccacgcgagggaaaaggaggctgacccttcatcaggagcctcagggtcccccgtgacccatggcccatagggaccagtcttcctggggttggtgctccaagcatgagaccagcacagaagcagtggggctcaaggacgccctcacttccctctttcagtcattctgctgaaagtgtcactggcattttctctccatcttcccccacaacctcctactggatttttccactcctgtgactcagtgctgggctgctgccgcgtcctcattctcaccaattcagatgaaatcatttctcaatagagttccctttttcttaattgctcacacttctgttgtggtttccttggcttccacatcctgggctctgcattgcaaaacacagctgccctggcatctcatgatcgggtgggagggaggcagagggagggggtataaaaccagccaccaacactgagcccttgagaggctgacacatgttctcagttcctactggagagccttcaaggtgagaagctcaggagggaccccagggctccccatagggccaagactcacccaaaccgggacatgtaggcatttgcaattcccctgggctgcatcagagatggcctgtgacccgcagccccgcagccccgcccggagccaggtgtaaggagggggaagttgtcggtagccgtcataacacaatgatgctgctctctactaaataccagatgctgtttgtttcataagactgttaatcctggaggcttgaccacgagctgtgctgctcaggggccattccctggatatactctctgactactggcaggcttgttccattccagacatgtttctctggcagatgaagtagatcttttcccccttgaggtgggtcctcattcactcgcgaagtgatggaggacaccaccgggcaggtgctgcgggcggtgctgcaaaatgaaagggctcctggaacgtgtattttgggtcattcttgcttcagaggtcgggaaggtaaagaaatgggcctgtctgtagcaatgcaccctcttctgcagactccacggcagcctcgtccctgctagagaaaaatgaagatcgttagaccaatcataggttcatcactcttgaatggcagactggcagtggtgcaaattaactttgtccttagtgaactgagcaggaaaaacacaaattgctgaatccagtgggaaatgtctggggggagcaccgtccttgccctctagcctgagggtcacttggagttaggtgcccagctctgaaggctacaggctcagcataactggttgatggtcagttaataaaatgtatgggattcgtgaatgaatgaagaaatgagacattgttgctgtctacatcagaaagccttggggcatcctagtcatagtttcaaggctgctgttcaccagttacgcagcctcagtttccccattcaagaggtcgacacacgtgaacttgtttctcagctgtgggagctgtgtgactccagctggtgtgtgtgaggccttctgtagttgggtggggggatgtcatgatgcattgcacccacagatctatttgcttctattaaattgttccgtgcaggaaaagtgccatcagtactggcccgaccaaggctgctggacctatggaaacatccgggtgtgcgtggaggactgcgtggttttggtcgactacaccatccggaagttctgcatacagccagtaagcatctctagttgctgcccttccagaaagatcattttcagagagcatcatgcccagagttaacatccttctgcatttatgaagtgctttgctcccagcccggcactgtcgcagccctggctgagagggtgcagtggccaggctgtgataggcagacatgcaagagggccaagacaccagaggccggtgcacaagggtctgcaggcagtgctgggggctcctaattcctagtgactcctctgggcctctccaggaggaagaccagtcattggaggggcctgggggtgaggtcctccctcagtagcacagtgacatttcacacactgactgggaggtggggtttttttctaacactttccgaattctgtctgaaacctcctcgttattttccacacttgggttctgctagttccaccaccccaaaaggtttaagagagagatcagtaaaaatatgtgtatgcaaagcagatgaaatcaagatatagaagaaagtttaaaaccatagagaaaagacagaagaccattttgtcaggatttaaagatagagtcattggcataattaggtcacaaaataagtgtctgaggttccaagaagccacagcaaaaaaggaaaaggatgagctgattattcttatcctatcccctgctggcatctctcccagaaatgtgcacacaggcgcacacaggcactcacatgcacacgcacacacatactcccacacacaggcacacacatgcacacatgcacatacacccacacacaggcatacacatgcacacacacccacacacaggcacacacacgtacacctacccacacacaggcacgcacatgcacatactcccacacacatgcatgcacatgcacacgtacacccacacacaggcacacacatgcacacacacgcacacaaccgtacaatgcatgcacgttcacacacacatgtgcacacacacaccccactcacatgcacacatgcacacattcacacatgtgcacacacatacacccatacacattcacatgcacacacatgcacacatgcacacacattcatgcacatgcatacatgtgcacacacacgcacccacacacgcacagatgcacacatgcacattcacacatgtgcacacacacgcacccacacacgcacagatgcacacatgcacattcacacatgtgcacacacatacatccacacacattcacacacgcacacgtgcacacatgcacacattcacacatgtgcacacatacacacatacacgcacatgggtgcacacgtgtacgcacccacattcacacatgcacacacatgcatacatgtgcacacattcacacgtgcgcacatacacacattcacccacacatacatgcgcacacatgcacacatacacatgcatacatgtgcacacacatgcacacacatctacttccaaatacgctgtgtatcaccttccgtgatctgggcaagggaattaaactcatgggctctgggtccaaaagctgagagaggctctgagggcaggtctgggagactccaaagagcaggccgactgcatcatctgtcctcccaaatgtaagacagctttgcccaaggaaggatgtgctgttggtgattactcagcaccaccggcctgaggtgggactgtccaggcaagatgggccatggccgccctgcttgcacgggggtctgtgagcacacagaccaactttggggatgtgtctggctgcttgggccctgcctgacctgggcatagacggttgctgcgggccctgttctgtggccccaaaagcagcacatgttcagagtcggcaggggtaaggtccaggctgtctggctcaggcaggccctctgtggatgggcccctcccctacgcagccccagcacaggggagcccacggcggcgtcctcagaatgagatgctgggggagcagggggaggattgtttcacccactcttgtctccccgcgtcccccgcagcagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtaggtacgctgtgggggccacggggcgggaccctcaagggcaggccacagtgggatgactcatcctcatgggcaatgccaggggaccaatatcagggtgggcagaggtttgggcagggctgatgtgaacacaaatgtcagtgactgagccaggccccaagaaccctacaggagaatgttcagagagccccctcttcatcccagtcgataaaacccaccaaagccaggaggctccggttgatggtgggaatggagttctgggcaggtctgcttggccgccctcacctctccccgggaatcccaagtcacctctgggaaccaagatggaaatgagagaaagccccctggtttctacaggaagccccccaacaacacacaagtcgttatggaagagcacaccatgctcagatgggcccccacagcagagtcttccagaacacgctgtcctggagaccagggtccgaggaccaggctgcccctcgccagctgccacttcagcctcggtttcctcacctgtgatgggaaggacagcctcggcggagcctgtgactggcatctgggtgggctttgcacaacatgaagaattactcaaatgtacagccaaggccaccccacaaccccctgtccacagagagccccacttgttcctggcagtgattggcctcaccagggtatcactttgattagatactaagtttccatctgttacagacaggttcattctgagtatcacagcactgccagggacaaaagccacctgcacgcagtgatgcaggcgctctgcacctgtcatgcaggtgttcacgagaagccgtccaggaacccccgaagaacgggctttccccaagtctgagcaacactcgcttgctggggccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgtgcatagttgatctgaggtccctctgctcccagggggacagatctaggatgccaatcacacatataagaagaagacactgtttggtaagtgagaaaaattctccacacagcctaatccgaggcttactgcaccagctgttaatgtgcctcttagtagagtgtcggtggctatcagaggaccggcctgagatcactttactgagaccacagctccctctggtggccgcactgtagctttgctcctaattaaccaaaaaaacaaaaagttgcatccagtgacctgggtgcgcaggccccttcggggcctttcatttacttcgggaggagtgtgactcacgacgcagcatctttctctttccccaaagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatgtgagtcatgccttcctcttgccctgatctagcttcccaaagcaaacccgatgccttcgccacacaggtgtgcagggccctggctctgatgggcacgtggcaaccagcctgggcctggcctggcttcgctccccatagccttccctgcccacgcgtgggacctcagggactccctcgtcctcatctttccctcgtatcctcatgtgagatggggcaatcctactcccccaaacggtgcatgtacacagtgcgtggcgtgctcaccaatgtgaggctctgctgctaccgttctccttactcaagggcataaatggtcgttatccgtggccggtactctgactcttgcctcacacctccttgtgttggcaaaaagagaaaaagaagaaagccgccctctttggtctgccaagctccacgtgggccaagactgcagggcagagttgagggtgtgggcacccctggcctctctgcagatgcagtacacgttcatctaccaagccttactcgagtactacctctacggggacacagagctggacgtgtcctccctggagaagcacctgcagaccatgcacggcaccaccacccacttcgacaagatcgggctggaggaggagttcagggtgagtacagctgaccctcctctccatcctggtgtaagcagccaagggcacgaggaaaacaggtgaccatttaaaggaagcctctttcaatcacttgccccttaactgacctcagaaaaagcaggggcaatacctgagccatgatttacaagggaagaaggatcaggtggctttcagagcctcatagcagccctactaggcacacatttgtatttcccaatgctaaggaggcttcctgggttggagagtggtttcctttgagcaggcgtccttgccagcagcactagtcctcggctgagcaatgtgctcaggagtgtcagaggtttaactgtgtcattatatccttctctgctgcagaaattgacaaatgtccggatcatgaaggagaacatgaggacgggcaacttgccggcaaacatgaagaaggccagggtcatccagatcatcccgtgtaaggcacccgtggcgtggcttgggcagggctggggcggggctggtgccggaggctttcatcctggagaagccattgaccgcttacccctgtgcaccagggtcaaaagcagggtgtcctctggcctcaggctaagggctcctgtgtgctgtaccaaatgtcaggtagaaaagacacctgtgaagcaccagctgacccagacagtcctgcatgggtctcaggcaagctgcttgggatatgagcttgcagatgcgggagggcagccgaggctgatttcaggggagggcttcacagaagctggagatttgcggcaggcacgacttgggattccttgtctcattccttgtctccccaagcctgggcagaggcccgcctcccccttacacagaggggcctgagccacccagccgaggccatgcaggtgaactcagctgagaccacctaggaaaaggctgtggccttgaggaggacaagaaatgggcctagggtagagtcaggacactggtctgccacccaggtcatgggagagggaaggaggacctggcaggtgtgggaggagtggaggcaaagctggcaagaagacagggccacatgcagtgggcaggggagtgggaatcgggaggctcaccaagtgggaaaaagagaaacttgagaaacccggccccaaagcagactccacagggatccgaggaactagggagggaggtgggagatgccccgcttgggaggagggtgtgcctcgttatagacttgtcctcgacagagtcacagctcaacaaacaccatctggaaacagctgggagcaggcctgctgcagcagggtctccccgagcactgcaggcgagtagagctccccggggtgctgccatcttcagactctggcccttggttttctggggccccggtgtcctgctggccactctagattgcttgcctggccacattccatttactccttcagcgcaatatttttagtgcttgtattttggtatgtattatatcgattcctgaaaaatgaaaatgataattgggtggttttcagagttttccttcaaaaagaaaaatacccctgagccactttaattatcgtctctcataacgtaaactttccaaagagttggctttacgtagtgattttattaataggatctatattttgcaagcttgtagcaatggattaaagttagcaaggtgggaccctttttgtaataactaaaggaagataatgctttgcagatgacttcaaccgagtgatcctttccatgaaaaggggtcaagaatacacagactacatcaacgcatccttcatagacgtacgtatgctggcctgggttgtgtttatgcagatgtgtttccttcacatgtgaccacagacttgattagcttgttttcacaatgagaaagaattgacatgtttccagaaactcagccatttttgttagcagaattacttgcttaaaaaaaaaagtggcaaggcacgatggctcacacctgtaatcccaacactttgggaagctaaggcgggcagatcacttggggtcaggagtttgaaactagcctggccaatatggcaaaacccgtctctactaaaaatacaaaaattagctgggcgtgatggcaggtgcctgtaatcccagctacttgggaagctgaggcaggagaattgcttgaatccgggaggctgaggttgcagtgagctgagattacaccactgtactccaacctgggcaacagagtgagagcgagaccccctctcaaaaaaaaaaaaaaaaaaaaaaaagtggactttggaaatagaaggacatagactcgctgctaagtaattggctcttttttcattctgcttttaatatatagttatttttcttttacatatctgttacacaccaattatatatccactgcctctgtgctctttctcttgtgtgatttctgcaatgtgtacccacgtggacaatacaattatgtgttcagggcacacagaggctgtcttcatgcacagtggagttcgcagaagaagggcaaaagggggaatggcagccaagtgtgtgttcatattgccatttgcagatgagaaaattgtaccagaatccggtgggctccatgctgatctagctgaaacacacagaaacatgttagaatctaagccaccaggtgctgttcaggtggccacaggcaactaccagttcataatacccatttgttgatgacctcaggggctgacggtggccgttatggtttcagataagcgagcttcttgacctgcttgtcaggtgtgtgcctgagtgctcgtgccaactggggtctggtgcagaccatggaggatgagagagttttcctcattaggccttaggctgtcctaaacttagggagcaggtaatggagccaggatggaaggaagtcagactctaacctctgcgcctccatttgaagggctaccgacagaaggactatttcatcgccacccaggggccactggcacacacggttgaggacttctggaggatgatctgggaatggaaatcccacactatcgtgatgctgacggaggtgcaggagagagagcaggtgaggagtgccgcccagcccggtccctccagggcagcctgtgcacctgaggcactgtccccgttcattacaaatgtcccacctgccatcactgcaaacacatgggtgagaccaagccaggaccactagggaaggagagagattggaaatgaaaaaggtttcatttcaccctttccctttttgggagtgaggtttaaccatagctacccgctgccctttatccttagcctacatgttatttaacctgccctgaaattctgccatttggtattggccaagatcataacctgttgaagaaaaagacatttattgacttttttcaagacatgaagacaacagtaaacccaaggtttaccaacaatgtacatctatctgggttctcccccaagacataactactgctgtgtatttgtgtttttatttctttgctctaaaaaggaacagctttattgtgatataattcacctataattcatgcaattcatctttttaaagggtacaattcagtgaattggagtatattcacagagttgtgcaaccaccaccactatctaatctgtgatcattttcatcaacccaaaaggaaacctcgtaccattaacagtcactccccattccttccttcccctaacccctggcaaccactaatctgcttcctgactatgggtttgtctattctggacattattataaatggaatcatacagtatgtggtcttccgtgattgggttctttcacttagcatcatgctttcaaggttcatctatgttgtagcatgaatcagtaaatcattcttttttactggcaaatagtatttgcttgtgtggatatactacactctgcatatccattcatcagttgatggacatttaggttgtttccactttggagctattataaatagtgctgctttgcttggtgcggttgctcacacctgtaatcccagccctttgggagtccaaggcgggcagatcacctgaggtcaggagttcgcggccagcctggccaacatggcaaaaccccgcttctactaaaaatacaaaaattagctgggcatggtggcgggaacctgcaatcccagctacttgggaggctgaggcagggagaatcgcttgaacctgggaggcagaggttgcattgagctgagatcgcgccattgcactccagcctgggggacagaacaagactctgtctcaaaaaaaaaaaaaaagtttcttgaacattcaggtagtagtttttgtatggacatgctttttcacttcccttgggtatacgcctaggagtgtatatactaggagcggaattgctaggtcacgtcataactctatgtcataaacttactgtttaacatttttgaggacctgccagactgttttcctcagtagctgccccattttacattcctaccagcaatatataaggttctaatttctccacatcctcaccaacattgtcattgtctttttgattaaagccatcctagtggatatgttctttgcttttttaaaacatcttttaaaatcacatctgtttatgcctacgtagactgttgtttagttttacttgtgtttgaactttatagaaagagcatcattacagcatgttgtcttctgagacttgcttcttccactcaaaattgtgcttttgatattctatgttgatgcttatgctgtggttcattcgtcatcattatttcattatattccactgcacaaactatatcctgcattagctcaggtattccttctcctgtcatgggcacttgagttggtttcatttcgttgttttacaaacagtgctacctgtacattctttttttaaaactttaagttctggagacaagtgcagaatgtatagttttgttacataggtatacatgtgcatggtagtttgctgcacctgtcaacccatcatctaggttttaagccctgtatgcattagctatttgtcctaatgctctccctcccctcaccctccaccccccaactggccccagtgtgtgttgttcccctccctgtgtccttgtgttctccctacctgtatattcttgtacatgtcttatgctgcactaggactaagatgtatcaaagagccaaaatgcttcattgaagagtatgtgaaagtttgaatttgcaagataattcctaattgctttccaaagtggacatcaacaatgtataagagatatcattcatctacatacctagtatggtattctcaaggtgtcctaattattgttaattgaaaattaacaaaatattgttcattgtataattattgtataaatactatctttttgtggctctgatttgcatcattctgattccaaggtcaaccccatcacttcatatatttgtggatgacatatttcctcttgtgtcaaatgcctgttcctgcctttcactgatttttctattgtttgtcctttcttattgatttataggagctctttacgtaatcttgatactaattctttattggttttatgtattgcaaacatcttattgcaatctgtggcgtgtcttttcactctgttaatgatgtttgttgatgaagagaagtgaatgttactgtaatccaatgtttcaaattgttgcatcgtgattggttagctgtttgggctcttgtctagtaatccttgtgtacctcaaagtgaaaagatatttcttcttccaagagtttcacagttttgttttttaccttaaaccttactccatctgggtgtatttttattaaggttcaaggccatgacacgtggaagtgcagggtgtacactgcccagttctaggaagagctgggggcactcacatcaaccctggtagggaatgagtcagggatccaatttcattttccccaggtagaaaaccaatttttccagccccacatattgaagaatctctcctttctgccatatgttaaggtttcatatatatatgtgtctgtttctagactctgttctgttccctgggtcaacaagcattaacaggcatttatattcatattcatatgtttttttttttggtcagatgaaatacattaactggtttgagaacaattctgtgttataaactcaaaatcgccagcagcaaattatttattacaagacttaaatttttattttatcccctaaggataaatgctaccagtattggccaaccgagggctcagttactcatggagaaataacgattgagataaagaatgataccctttcagaagccatcagtatacgagactttctggtcactctcaatcaggtattgttgaagtagctctttaaacgcttgtgaatttagtgaaccacgccctccctctgggttctgcttgtcattgaaccagaatgtggccctgcacctgtcctgctccttcacctagtcccattggctatgaatggccaatgggtttcagagacagtggcaggcctcctgtacaattcccatctccctagctgcctacctcccatttatctctcaggagaattacattagccattagctgtaagaggaagaacaaaggggactaatgaagccacaggggcctctctggggccctcctccaggtgccttctcagagccccccactgtccccatttccactgggtccttggttctgctcatcctctctccttggcaaagaatgagaactcggggtcagctgtaggtaggatgactcacttgtacacaggtcttgatgctgagctccaaacagtcagtatcacgtaatgcacctgccactgtctcctccatgccagccacagagccaccctggccaccagactcagatgctgctcatttgagctctgaagggaaatgcagggccctggtttcttgagaaagtgattcccttctctccagcagagctgccaaggatcccgtaggggttgggcagtcctcacagggatccaggggatgtcctctggacggctcgctcccccttgcagaaggaagcacagccagccacctgccttcttctttaggacaagcaggtttcagccttctccttcaggctgcctcggtggggatgttggcagcacagaaggctcagggagggctcccagccttggccaatccctgagagggcagatggggctggggcctgttccccggcaggcaggcgacgctgagaccccctctcctccctgcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcaggtgagcccccagcccgaagccctccaggtggggtggacacaggctgcacccccccagtacccgcagctgtgggcagcagagcctggtcgctgcccctggccatggtattccctagagtctcctctctacctctccttacacacatgcacacacgacttcacttaagtacatacatgtcatcgtatcatacataagatgcatgtgtgtcatcttaacataaatgcagaatgcacttcagagggtggagttgggaaaccactcaaacacacatttccatgtgcttttgaagtcatcaaaaaattgccaggcagggctcggaggaacacactcctggacttcaagttcctgggtgggttttgagagactgccttactgggctgcattggcctacacccgccctctcccatgggctgggattcctggccatatgaggagtcccaactgggattgtagccacgctggtcctgcagcctcagcctggctcccaagtcaggcccaaaggcagagggacaccctgggcaggtgggacatgcttagtccgcaggtgaaggcgtgaaacacagcacgcccaggggcagatacgcaaatctggtcaagcccaccggccacccacttgcctgccttctgtgcctctgtagttctgatcctgctgcacacttctgctggcagggacctcgacacccggcaaggttcttccaagcaggagcttggggtgtttctatccttgggtggtgctaatgtgctcctgaaactgcagttccatggcttgtctcacactggtggcgcccactctttgtgactgcctttcacccccacccactgtcccaccccttatagctggcagagctctctccctgcctggaccccaccggggtgcactcctggcctggccagtaggtggagcacacacctcggtttttggttttcctggtgccttccaagaaatcatttaggataaacttgaaatgagttccatagggcactggagatgcagaggtgaacaagatcccacctgtgagaacgcagatgcggggccgatcattgcggcaggacaggagccttggaataagcccacatgtgagattatggagcacagagggcagccaggcatctccagaagacctgctggaagaggccggtccaccccacctcctccagcccagtacacctgggctctcctacgagggcctgggctctgctcttgtggggtttatcagcaaatgaccatggtaaatggagatgactcaaatcggccttgctgggaagtgtcagttgactgttcctggttgtgaatgtccttaaactgcccctccctttcagcatcacctgtttcagaagacacccctggcacagtaaggagagggtatgccaagattacctccttcctagacctgaactgggagggtttgcatttctggcaagttcccaggtgccaactgtgctgctggtccagggaccacactttgagaaccattgccctacacaaggaagaggggaaatggtgatacttgcttaaaaacttgtcactggtcctgtctcattttataaaatatcggtctcctgtaattagggaggtgttttaggaattttacatttgctaaatcttgctcataagttacactacatacaaatgatcaaaaaaaaattcagtcaaactcagatcattttcagcgattgttgcttcagtgctgatatgcaggggttggctgtcagctctccatttctcatccccaagtgcaagtcggatgatctgcattaagcgctttttctctgcagtgccggagctgggcgaacaggtacattcatagccctcagcaacattttggagcgagtaaaagccgagggacttttagatgtatttcaagctgtgaagagtttacgacttcagagaccacatatggtgcaaaccctggtaagaatctgaataaggatgttaccagaagagtggagaattatttcatgttgtatttgatgtatgtttcattaaaggaccttaagtacatgggggaggtgggaaggtaaaattcccaaggaaaagagccagctgcaatgtttcgcagtaaacctctgcagagccctccttccttgggtctgtgacgtgggtgtcttctgggcaagacccgggaggaggggcctgtccgccagtttcaatgtctgagaccactcggagagacgcactgaggataggagcttttgtgtcaaagtgaactattctacgagagtcctgtgtgcactgaaaaacatactcttatcaagttcaaaagcagcactgaaatttaaaatcctggtccttctcatttcaatgttatactcgtccatgtggcttgttttccctggcggggtctcactcagcctcaagataccgtccacgggctgcaggaatccctaatgtattagtagttttccccgtacattctttcatttcaaggactcctgctttctggttttcagaagcgattcctcctcaccaaatactatggctcgtgctgctaacccagcgagtacaattttaaagcctgttacaatgcatcctttttaccaaagcttcccacttcgcacctgtcctccctgcctgctcactctccacgctgacaatcctggctcacgcagcgccctgtgcatagagaggcaggaaggaggcccttctacgtccccctcacagcaaggcgcagcaggagcgaggacacctgagctgagggcgggtctgtccatccacacccaacgacctacagcaaagaccatctctctaagcagtagcatacagagcttcccctagtctttttagggactcacagctctcattaatctgcctggtctggccaatatattctatcttcgagagcatctgtcatccaggtgtcctcccgtctcagctgtgctcttcctgaccgcagcttgcccctccatgctccctgactgagaagctgccctcagatgttgtgtggctgtcatctgtgctctcttgcctggtaacagcttgacagagcactttgtagcctgacttttagagtaaagggtctagtccaatgcctggcccgtggcgagggctccagagcaagtggtgaatcagcaaacgaatgagggagaagagtcactaaataaccatcaggcgttgggcgcagtgcaaccaggtgccttacagatgtctttctcatttcatcttcaccatctgcttgcccttgtgcctgcttctgttcacaaggagtgttctgcaggtgcctccagttaggacggttgaggggcctgcctgagatcttcaggtattaagtgtcagaatgagattcaaactctatctgattccagaagggaaaggcttaactagtactgtatgctgccagatctaacatttggcagggagattttggcaaaaaaaaacacaggcacaaaaatattattgagtaaagagatgattgctgacctgcaggttgatttagccctgcaggtgagcacagtggcccaagaaccagtttccaattgctgagcactcagggaagacttgcttccagcatcctaggtaggctttggttggaactgacatttcaaaggccacaagtacatctgttctcctggagtctgtggattgaccagaaatgtctgtctgtgacctgaggtgtggcttgtatcatccgagcacactccaaagtacacttcatccatcactggccccaatcacttgtactcgagactacgtgggatggtcagcagttagctgctgtgttagctatgaaaacagagtaattagtgatcgtctccatttccatcccagactgagccagctttgatattcagtcaatgttgctttaagttggaaaagtcaatgttgctttaagctgtttgcctctttaaagagagcctgtatatttattgagaattccttctaagaattcaattccctttccttctgaaggctgggtgatcagctgcgtgtcttagtagccagaagtgaggaccctacaatgtggtcttggctcttccaacaacttcatgcaaattcagaagcaaagtttcaggctcaccttttccttctctggaaaactcagctccttcccatcctggccagaccgggactcaggaagggctaagctagctgtttggcatctttccacccaaaagcatttagatatttgttcactgtgtgctgagaagagcccaagtgcaatgtgttggaaagaagcagggaggtgctgaggacagctcttggcctctccggctttccaagcccctgtcccggccccaaactcacatatcccacccaggggtctgggaggaccagcctatatataaaacaatgtcccttttgtacagtaaatgtaggctttaaaataatctagatatgcattttatttaacttttatagatcgctttatgaaatttatctggcaatgttagtactctgatttttttctctttctctctttttttttttttttttttttttttttgagacagggtctcactctgtcacctaggctggagtgcagtggtgcagtggcacaatcttggctcactgcaatctgcctcctgggctcaaggaatcctcctgtctccgcttcccaagtagctgggactatgggtgtgcaccactatgcccagctaatttttgtatcttttttgatagagatggggtttcaccatgttgcccaggctggtctggaactcctgggctcaagtgatcctcctgcctcagcctctcaaagtgctcttattacagacgttgagccattgcacctggcctggttttttgtttttttttttaaattcaaaaatagttgttttccagtttcaatgtgaaagccacagacatttaactcagcccattaaatacactaagttgaaatgttaatacactaactgacacattctacgtagaaaaacagctttatttggaattctgcatgtgcctaaaaactaaattacgatgtgcataaaggtatatggtattttaatgaatagtcacacttatttatgtcttgtttttgagtatttctcctgattaatcaaatatatttttgggaatatcattttaatgtgtccttgtttgtcttttcaggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcagaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttgaagatcaaagaagtctttacaacctgaatccaggtctaaaacacactagagtagctggtgactataaataatatttaaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattgggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacgttattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttgagagttcgaagtcaaagccgaggggcacaggctttggttcatgtctaggagccctctgtcagaatccttgaagccctttaatggtctaac

SEQ ID NO: 16658 - DNA, 37580 bp, Human
tgtcacccaggcgggagtgcaatggctccatctcggctcagtaaaactgctgcctcccaggttctagcgattttcctgcctcagcctcccaagtagctaggattacagacatgtgccaacacgcctggctaatttttgaatttttggtagagaaggagtttcaccatgttgaccaggctggtctcgaacttctgacctcaggtgatccacctgccttggcctccaaaagtgctggaattacacgcgtgagccactgtgcccagcccatttaaagcaatcttaaagtgtaaactattattgcaagataccaacgtagatttttttaataagtgttaatttctcttttgttgggaggtaaactgccctaggaaagacaaaaataatcttgtaagcttactttttaggtttctttctatttataaagaagagaaaaaaatcaccattttttgtgcaaatcatagacctttgagttagaagggcaccaaaagtttcagctctattccctttaaacaaatacaacatttattgcattagttatgggtgaggaaattgaggcttagaaggatttgaagatttgctcaaggtggagattctcaaaagtgtcctcagatacctgcatcctaacttcctgggaagtttgttctaaagtttagactccagagcttcacccaaaacttactgctaaattaaatcctttaaaggaaatctgcatttttaggatctcctcttatgccttccagcatagtgcttctcaaaccctaatgttcatctgaatcacctaggagtcttattaaactgcaaagtgtgatgtagcatgtctggagtggggctcaagattctgtttttgtttgtttgtttttgtttttcaacttttattttagatttagaggccacatatgcaagtttgctacctgggtatgctgtgtgatgctgacatttgtggtatgaatgattttatcacccaggtactgacaatagtacccaacagtttttcaacctttgctccctcggtcccctctctagtagtccacagtgtctatttgttgccatctttatatccctgagtgatatggtttggctgtgtccccacccaaatctcatcttggccaagaagccaagttttaatgggtacacaagtgcataggaattggagagtggggagcgtgagttgactattggtcagggactgtcaacggaagggaaggaaccaatgatgggagtgagagcccagaactcggtgttcgaagtgggtaatttatgggaggggcatacctacgagcagacaatgcactcagacaaggaagatttgcacattggacagaagagacacctttttcctctgcaataagaaccaaggaggtaagtagggggtctgatatgagtttgtgcatgtgtgcagggtgagtgagacaatccatatatttgagaaaagacagtgaaatctttaaaggtaaaaataataaaaccagctgtggcacctattggataaggaattactaactgatgatttagaaattcctttatgtgcgttaggagctcatttgttatccccattttacagatgcgcagccccaggttcagcaatttgctctaaatgagactgtagaggctaattccagcccccggcagctctcaccttaagctgcctggctgaggtcagcagtaagttacctggcagcgtccgggggcctgcagccgaggacagggctggaactacacttcccagtgtgccaggcggggcggggcgcggcggggagggcgcaggctccttcccagaagcaaaagcggaaacaaaagagtctcgccggcgtccccgcccgcacactcgcgcacactcgcgctcgggcgcacacggagcagggaccggcgcccggagcgagccagggagcggctaaccggggacccaccgcgcggagccagcctagctgccagcgagcccaacccgcgacgacccacgcccctgagccccgcagccgacccctgccggccggtgtccccaccgccatccctgacccatggcgctgaagaggattcagaaagtgagtgccggggccgggcctggggctgcggggcagcggccccctgcccacgctgactcggccagtggtcccgagagacatgcggggagagcaagggatggaagggtgggccggggtgcgggcagggagctgaaggctcgggccgggccagcgggcatcggacaggtgaggtgggagcagggtcaggtcccaggcggccggaggagcttgaaggctgggggcccgcgcgcgttcgcgccggagccgctcccggagccccagggtagagagcctcttgcgcgtccagaccgtcccgaaatctgtgcttcacggtcacggccgggttttgccctccatggggctagttttgacccctgtcatgctgtgttttctccaggctgtttcttaagcctgtcctcttttatgttcttgcttacccggcctccccgggagggcaaggaaggtggggtgggcctgcagcctttctccgcggagctgtcgggttggttctttctctcctctgcggttggctcttgctcagttgcccgaatgggctggaaagcccatttgcggccaagaagtcaggagaaggctcctgccccttctattttggtgcctctgctgctgccacttcaggtcacatagctgtagcgaaaacatagttgctgatacacaacaagatgacctcctggctgtgattcacggtgagtcaagccaaacaggtttttttccccctcatgataaacttagatgtaaagttcgagacacaacataaactgtcgcaaataaattgttttgatgctttgacacatgggtatagaatgaggaagaaatatatatcttcatccaacaactgtttacccatctcaaccctgtgtatggaatcgtctttttttcacagtatttattgccaccatttcagatgcgaacatccttcagaattcagattcgggcatttctttctgttcatttttatttcttgttggtctgtgtactgacccaagttttaggttttacagttacagttcacactggcaacattgagaatgtgtttgttaaatagggagtgcttttcactaagttaagcaacaatggacagtgtattttgtagttgtttcagaagaaattgatgcccacatttttatccacttttttgaccaggagtccattatagcaatagtatatgttagagcagtgatagtgacgtacgcattgcattctgactcgccactggtgacatctttaggtacagaggacagcaacttttagagcctgccagttttttattttcaaattctaaatctgtggatcacctgttattttttgtgccatttaaaggtcatctcattgtaaaacatacagttaacaatcagcatcagcatttattaagtaataatgttttcttgtttgaaggtagcgcaattacacattgttttatataaataccctaattttgaagccttagcatctttaccataccttgcatacttattaatgacgaagtaatattggttcacatttggatcagaaaatgcacatcttccaaggaagttttcaaattctatttccttctttcctagttgtgagaatttttcacatgattttgcacatacaagagctttttaaatttcattgtgtttttttaagagatggggatctcactatattgcccatgctgatcttgaactcctggcctccagaaagtctgggattacagacacaagtcaccatacccaactaacaatagcttaagctgtataatttgtccacagtaagtggatattcaaagaaatatgaacattatttgtaaataccacccttggcagttctcatcaatcaccatgctgaactagtgtatttgatttatatttataatatggcgtgtgtccaaatctttttagtatttattggttattagtttatagaattgttgagtaaaaaaaaaaattacttacatagaattgatatcaaacatgtgacaaattgatattttggaaaagaaattggggatgacacaccatcacatctctgtgtgttcatttttggcttccctttctgatatcaggaaaatcgacttacacaaatcttctttccattaatcacacattcagaccaatccctcaaaccttaggggtgattattttgattgattccctacttttcctcctcctttacctacctccttgattagaagccaattctaggttagatgtgccgcctgccgtatgaacagttacaccatcttctttgatgtcatcagtatagaattcttatttgaatctttcatgttccaacaaatgaagatgtatactaacttttggcctttcttcttaagctcactgaagtattaatataattttcctgtacctatagatggtggcaggccatagagttgtgtggaacctcagataagtctgctgtagtgtagtagagggtacaagcaggggaacagcttctaaggcagtgtcttagaatcacctgtgggacgttttcagactgtcatcacttctataaatggagagatgttgaatccctcagatcggttggggtggaaagaagactgaggaccactgatgttctggcctgtccttattcaaggaaggatccagaggcctggagtggaggagtgctttgtccaaagataatctctttttttttttgagatggagtcttgctatgtttcccaggctggagtgcagtggcatgatctcggctcactgcaacctctgcctcctgggttcaagcaattctcctgcctcagcctcctgagtagctgggactacaggcgcatgctgccatgccccgctgattttttgtattttagtagagatggggtttcaccgtgttgcctaggctggtctcgaactcctgagctcaggcaatccacctacctcggcctcccaaggtgctaggattataggtgtgagccaccacacccggccaataatctcttaattggcttggctatttgagagtgttaaaaagttcatgatttcacatttcttcactatgaaaaagaataaagatgattggattaaaattatatgtaaagacagagcatggagatatcaatgcttaaaatatatttttatagtagaataaactaactatactagaatatactaaatgatttaatgctctgatttagtgtgccagttttgcattccagctcataaatttacacacccatgccctatttttaaataacagtgaaagatgttatcgcagtcacctaaatcattaaaagaaaaaaagtttgaacaaagtctaaggaaagatacctaaaacatgtctgaaaagaggaggacagtttttcacctaggtatctattttctagaagtaatttctaagttgtttcttctatcaatactattttcattacttgaaacactttttttggggaggattattttttaaattacaggtgttaatatcccaataccaaatgttttgaaaactaaagggcaaaaaaaaggaaatcctaaaacagtcattgtcatcatcatagattttatttgataaagaatttgaggtaatgaacatcatactagcattatgtgatgtgatgtgatgtgatgtgataagtttatttacatttttgtcttttgaaaagtgaggcaatagagttccgttttacaaacatagcaactcagagaactattccttagtgtgtaattctggcccccaaatggaacattagttgtttttgttttttaataatcaatgtaatctgaaacatatatagagagacatagattaaaatcaaatttgataaatgtttgagctgctgaatttttttgatttgtagaattttatgttaaactgtttatgtcagtctagaaaactttaggatacttaacccagccctctatggacggagcatcaaatggaagaaggaggtctgagttttttttgtttttagacagggtctcactttgtcacccaggctggaatgcggtggcacaatctcggttttctgtgacctctgcctctgaggctcaagtgaccctcccacctcagcctcctgagtagctgggactacaggcctgcatcaccacacctggctaatttttgtattttcagtagagatgggttttcaccatgttggccaggctagtctcgaactcctgacctcaggtgatccacccgcctcagcctcccaaagtgctgggattacaggcgtgaaccacctcacgcagccaaaggtctggtttttattcctggctgtgtggcttactagcttcgtacaatgaggctagtacatattttccatacatttccatacaatggatatgtatggatatccatacatatgaggctgctgatctcaaaaaccagggtgtttgtaatcgttactctgccttctaagtacttgacatatattaattgacttaattcttagtatacccaagaggtagaaacagtgttatttccattttacagatgatgatactaaggcagggaaatattgagtagtttactcatgatcacattatctagtaagtgacaatgctacgattccaaaacaaacagttggcttcaattccacattcctttttttttttttcagtcttagaatcttttatttaataccttctcatgcccagttaacacaaaaatagttgcagttacatatcgctactgaaagctaccaaactgcctatctgaagagagagtcaaggatccttctcttccacttcttaggagagaatgatagtttttggatgttgaagagagcattcactgagattactgaactcaccagatatactataaagctttctgtctaatgtagccagtagccacatggaaacaaattgggtatgaaaatttagttttcaaccttgagctttatgaaatctaaatatagatcaaatattgctgacgaaaatttagtatccaaattgagatgtgctgaagtgtaaaatatgtactggaatttgaagacctagtatacaaatctaaataattgttactaatgagatatttataaacatttttatattgattaaattttgaaatgatgacattttggataagccacctagtcaggctaagactcattttctttctctgtaaaatgaaggagtaaacgatatcagagtactacttgccttattctgtctttacattcaggttctagaaaccagaccatgggcagagcattttcctccttgttcagcagagcaaatttgtgggcttttaaagatggtaacattgtttcttaaatcactttccataatttaatatcagtaatctgtttatagaagagaacagccacattccctgacaaagttttgtatgactttactttttattttgcttttaagcttggctgtaatattattactgaacctgtgacacttcacttaaaatgtcaaatcctttagtggagagagtgttatttccttgtcttaatctttttatatgccaatgattgtgccccctaggatagcaaataaaatctgtcaataaactgactgaacaatgctatccaatagaaatacaatgtgagctacattttaattttaaatttcctagtagccacgtttttaaaacgggaagtagaagcaagcaaaattaaatttaatgtgtcttatgtaattccatattcttaaccacttcagtacatagcttctcttatccacatgaactcgtatctattgtacttaaactggaagacatagagtcaaatgggtttatgggatataagtgctttgcaaactggaatgttctatacaaatgtaaagtggtgttataattaagaccttggcatatttgatcattttcactgacacattgctcaaatgtgttgattgtgcttcgcaaatctctgctccaaagtaacacatgctgagatcgtttaacattgtaaatcagtaatataactttgatcatctttgtttcatcactttgaatttctctcctccaaaaggattttgaaacattggttgtagttcataaatgctctgtcaaaagtatcattgcattgtgaagtttttatttgagataactttttgaattgacagagtcatttagttcctgtagtggttttgagtagtaaactgttcatattatgagattaaatccaagactccagttctttctagaaagaatgatacaacttaaagaagcacggtatttatgcattttgggataaatggttttccttgagatgagagcgagatagtgttctttctctaataagccacgatgtaaatttttttttaaatctttgtaattaagctcagtctttcttttgtccttgatactgtatttttctttcttcatcgcaatagaggtataaaaaaatgaggtaacctatgacagttaaaaagttctgagatttcttctctgtggaaataaatagcctagaactaaataaagctgtttatgcctattttaagaagccaggcacatatgaaaaccaaacctagcaggatgtgggattgcctccaggaaagcaaaatagcgtccttactcgctttagttccctgaaatacgcatagaaaacatatgggccctttattttcatttaatgagtgctactaatagaaatgataaacctaatatttagccataaaactgagttaatggtcatctactaatgtaatagtccctgcctttttaatagtgaataaactgattacattgaattaacaacaggaattgagatacttatcctctctcctctcctgtgaaatgctggaataaatgatactagaatatataatatgaccatatttgcagtttgggaattggaggggtaggtcctcaggccaccttagcacatgtgtctgaaggcaggacaggttttatttctggcccatcttggtcttgatggtctctgagaagctaaggtttttctgtgcttaatttggttctgagatgaatctgtgaaggttcagtttcacacattagacaataacaggctgttgtgttccaggattgtccttagtatggggaggaagctgctatctagaagcatacagtctagtgctgtccattccaccatcatgctctgcatcctcttgtcttacctctttctggatgtatttcccactgtcctctattcatatggtcccgtttgtatggctcatctcttttagtgacaccacagttcttatttagattcctgggttttttttcagacttaagaaacttctccagtgggggtgagctgaggagttggttccttcaccttaagcttcctcagataataatctgattgttctcattctaggtggccaccctccttatgcgagcagagtttgggagtagtatggttggattgtctagagaaaaccaagtggacctaacaaatggtctgggttcatttttcttctcttctcttaaaccaggaaatctctggcttgtgtttttgcttctcccaaattttgctgtattttgttttcacttaaatttaaagatattttctagttttcctttttatctcttctttgacccttggattatttagaaatacgttatttatttgccatatgtttggagattttacagatagctttctgttgttgatttctaattccattatggtcagagaacaaattctattattatttgactccttttaaattgtgggtacttgttttttttggttttttttttgtttttttttttttgagatgaagtttgctcttgtcgcccaggctggagtacagtggcgcgatctcggctcactgcaacctctgcttcctgggttcaagcaattctcctgcctcagtctcccaagtagctgggattacaggcgcccaccaccacacccagctaattttttgtatttttagtagagacaaggtttcaccatgttggtcaggctggtcttaaacttctgacctcaggtgatccacctgccttagcctcccaagtggggacttgttttatgacccagccttttcaggtgctcaacagcacttttgaatgaatgatggttaatagtttgtagacttcattttggtattttccagttggtatctattgactgtaggttatttctaagaaatggatgccaaactaaggtgtacaccttcccagtatctttttttttctcttttatgagtttccaaacagtttagtgaataataaacatccactttttaaaatggaatagaaaatattagtgctttgcatatagtaagggtgttgtttcatgaaatttgttttagtgtgtgtgtgtgtactaggttgtaatgtaaaatctttttcatattataaattgctgtaaggaaagctggaaaatcactgttccataacataagatccttaggtaaaattaatgttaaaaatacatgccatacaaccatacatatacatgtatacatatatagggagagcaaatgaatacatatacacatacacagagacacacaaatatattgatacacatatacacataatgtaaactgttctagccttggaaacgtttgcatttgatacagaccgtatgcattgttttcttctacaagtagcagcattttagtgactgatgtacaaccataatattcaagaataatactggatgatactaacagagagtagagaatttattatgaaacactcaagtgcccactatatgccagttattaggtatagagctgtaagaagcaatatttaataacaaatatttggtaggtattggtaggcatgttcatgttttacacacgttttaataaataggcagctaggttttctctcttttttcttccatctttttttggttactgtaaagtaaatagtaagttttgataatggagcactcaaaatgctccatttgcatattttatgtgaaaattctatttatttaagttgtgtataatttcctgtaaagtttttcttgactctcagagtgtctttaaacacaacgctcctgaaagcttatgaaatagtattcgtttctaaccttttatatgatataagctcctgagaaaagataagaattccttctcattccttcacttatcacacttttgtttctctggagcatagctaaaaatgtgcaaatggccttaatacagtactggagcattgtttgcttcagtgttggttgaaaataatgtgctctagctgttacagtgttgaggtgagtattgaattggggtgggaagagtgctggagtagaagtcagatggtctgtccctttgtcctagtttggctttgtgaccttggccaggagactcagtctttatactcctcacttggaaacttaatggattgaacttgatactttctgtcatctcttctgaatcataattttaggcaaacctaaataatgtatttgctgtttttttttttgcagcaaacaacagtgatcacaaaaacaaacactgagctttggcactgtgctatggagctatattagacttgacttaaaattccatttactttgaaatatcagatttgaaataaatgttgacatctcttaatgtataaggtcaataaatcttattctctaactaaagagcaattatttatgatgcaaataaaatgtatttctattattgcactggtaacataacgtggttctctaattccatttagcttttctctatttgttagcttttgtacttaagattgttttatccacatatttagacaactgccatacacagctgcacagctgccttataggtaatagtttttttgttttttttttttttaatgacaaagtctggctctgtcacccaggctggactgcagtggcatgatctcagctcactgcaacctccacctcctgcgtttaggggattctcatgtctcagccccctgagtagctgggtctacaggtgtgcactaccatgcctggctaatttttgtatttttaatagagacagggttttgccatgttgtccaggctggtctcgaactcctgacttcaagtgatccacccgccttggcctcccaaagtgctgggattacaggtgagagccatggtgcccagcctatgtaatagatttttaagattcagtgctgggcacgtggctcatgcctgtaatcccagaactttgggagaccgaggcagaagaaacacttgagcccaggagtttgagaccatcctgggcaacatagtgagatcccatttattttaaaaaaaaaattaaaaaatagctcagcatcgtggcacgtgcctgtagtctcagctacttgggaggctgaggtgggaggatcacttgagcccaggaattcaagattacagtgagctgtgattgtgccactgcacttcagcttgtatgacagcaagaccctgtctcaaaagattcaagttaatgcatttatcaaacaccttctgatacaaggcatatattaaatgcagtaaggagatgctagttatgtagaaaaacaggtatcaccattatctaagaaatttaaaattaataagtgtaagaaaagtcctgtaacaactagatggatttaggaaagtaccaaacagaaaatacaatatatttaaacaggaagggagtcaaagatgggagaggccaaatttatttgggaaaatcaggaaaaactgtggagaagatggaatttgatataggttgggaagactggatagcattttgaaagacttaggggagccaggcttgtagaggaagctacggaaatgaagacactagaatatgcttggcttatttgggaaggagcagataatcctgcttttgggaatcgttcagaaacagtagaccataaagcttcatattgtagacaaccttgaaggcctgtgctgagaaatatgtacttaatgcagaagattggggaagccattgaaggtttttgagtaataggagctaatactttttttttttttttttttagacggagtctcactctgtcacccaggctggagtgcagtggtacaatctttgctcactgcaacctctgcctcccaggttcaagcaattttcctgcctcagcctcccaagtagctgggactacaggcgtgcaccaccatgcccggctaatttttgtattttttagtagagactgggtttcaccatgttggtcaggctggtctcgaacccctgacctcaaatgatctgcccgcctcagactcccgaagtgctgggattacaggcgtgagccaccatacccggccggaatgaacactcttaatcataggcatccttgccctcatcaaactcaagattgtttactgtttgtcattataattttgattaatgtcatgaaaagggatgcatggagtattctaggaatatagcagggacccattgaaggtttcagggaaaacctgaaggcaatgatgtttaagatgagacaagaaagtaaaagtaaagtagataaaatgaaagaatgagggagaaagtgtgttttggggaggggaggtgattaagtatcttctgccgaaaaggaagccatgtttgcaactaaaggcaagattaaaagtcatggctggtgcagagagcactggggaaaagtgttgcagatatgacgctagaaagaagtcacgtcttggaaggtctggcaagtcattttaaggacttataagtcttacatgaaggtgaatggaaaacatcgaagaggtttgacatggctcttcaagaagatgattttggcagcagtgtataggtagaaaaataggaggacagtaggtaagttaagatattgcacttaagtgagatccaaagagggtctaagctacagtgttagcagaggacattgaaaagagggatatatgacaaaaattacagggtgtttgtaccacctggcccttttgagttggtgtgatccatctatgcctacaccttcttggcctttcaagtcaagtatcacaggctccctggtctaggcaatctcttcagattcctccttctgttatccagtctggtcccagatattaagattgtctgcctggctggaacctttgggttcttatcctaaactacctctcctctggcttatatcagactcttctacacgttggacctcagctgtcctatttgatgggccttctgggaccctttcagagggagggatctagacagaaggagaatctgaacaatttggtacttttcaaattgtgaaggagtgggatgtgaagagaagaattagatggtaactccaaggtttagagtttgaattactagaacgaataaatgcatttttactgtaagccttcataaaacagattcaaatacagcttttacttggctactttggatttgtctaaaatcgatttttatttatgtaattcctctgatggaaatattatatgtagagagtgtgatcaagagtccgccatctaaacaggaagccatgtttgaaagtagaggcaagatagcattttgggaaattgaatcattatgcctggtgcagagaaaactgggggaaagtggttgagatgtgaggcactgagtaaataatgtctgtaattctgacctcaagcttttattctaaattacactcttttttttttttttttttttgccccgagacggagttttgctctttttgcccaggctggagtgcaatggcacaatctcggcttgctgcaacctccgcctcctgggttcaagcgattcttctgcctcagcctctcaagtagctgggattacagacatgtgccaccaagcctggctaattttttatatttttagtagagacgagatttcaccatgttggccaggctggtctcgaactcctgacctcaggtgatctccccgccttggcctcccaaagtgctgggattataggcatgaaccaccgttcccggccctaaattacactcttcatagttcacattcaatatatatgactgatgtggcaaagtcacatattattgctttcttcatcttccttttttgtggcagttggctgcattattattttttaaataaacagcttttgccagagagacttgatccaaggaaacagcaaagcagataggaccagtttgttgaagtgagtttggttcctataacttcattaattggatgtgtcagcattttgaagtcttccaggaagaatctacatggtttaaaatgcaaatgtactttaattcacaggcttaaagaggttctgtatttggagacatttctgatgatcgtttgacatctttctattgaaatagctctagtcaactggataaggagatcagggcctgaactgtaagcccatgaaatgtttatttacagacaaaccaaatacagcttatatatccttttagaggcaacatgaaaaatgcaatccagtaagaatcactgtcttgttttaggaattttgaggtaaagattgttgtgtcatgttaattaattgccagttgagccaggagttttgaaataatgctttcacaggctttggactcaataatttaaattttgggctgtaagtcagccgcttgcatggactgtttaatgtcctttacacacaaccagtggggtatgtattatatctattatggagatttagatcttctgactgttgaagctagaaaacaacaaagcatttttagtctggtcagcgtaattttttagggaatatttactgcattgcgtcatattaagttttatggtaaatatggcagttctcacttgtttgcttttattctcctctcttcagattggcctgttacccttctgggagccaggagattaatgcaggccccttctcttacattcccttctttgtttccttttatttgtttactttgtttgaattaggctgcctcatctacttttagattttaagtcccctagaggcagggattgtgtctaggttggttttatggagaacactcagcatattgtgggggtgttataaacatgccatctgtggcaatttaaaattcagtttcagacctttcagtacttttctttgtgtctcgttgtttatagaaatctgaactagaatagaggtgcttagcaatgtaaggctatataaatccattaaatatacatttttgtggctttattgtaagtgcttttatagttctagtcatgatataaaggcactatcctttaatttactgatcattaatatcttatatttttattttaaaatttagatacttctagctagtttttttatttgaatattaatcacattagaatagaaaattgcttcattggcacagactacttttttgtggaacatactttcaccagtttgatgatatttattgcttgatctgtttaggtatagggttgacttgttctaagcttatttttgtctcaaaggggaagaaggaaatagaatcaacaatgcatttcaattttagattaaaagtcactggaaatgaaaccgaaatacacaaaatatatgtatactcacacagtgtgcttctataatgaattcttttcatatacagatttattactagtcttattatttgatagccatcttttccattatatgaattctatagatccttgcccttttttttatgttatcattatgttattcgttgtggcaaaatacattttaaaagttacaatgtaaactttttgtttcagttatacagacataagtatacagcttgaccaatttttacaaagtgaacaaacctgtgaaaccagcacccagctcaagaaatagtattacaaggaccctagaaaccctttcttctcccttcttagctttacctctgtcgtcaaggtaaatcactattctaatctctatcaccgtacattactgtagcctgtttttgaacgttatttaaggggaatcatacagtatgtatcttttgtctctggctgcttttgctcaccatatttgtaagattcatctatattgttgcctggagctgtaagttcattcattcttactgcatgaatatgcttcgagttgttcgttctactgttggtggactttgggttgcttctggttcgttctactgttggtggacattgagttgcttctggtttggggctattacaaataatggcactttggcatgcatattcacttttctgttgggtatatacttagcagtagaaatgctaggtcatagagtatttccgtgtttgccattagtggttactatcagttttcctcttccaccaggagttccagagttccatttgcttcaaatctttgccaacacttgtactctcttctatttcatttaaatcattgtgttggatatgtagtggcatagcattttggtttaaatttgcatatccttgatgactaatgaaactgagccccttctgatatatatatatgtgtattggccatttgggtagcttcttttgcaaagtgcctgtttatgtttaagctgctttttaaaaagttgatctgtaggaatatcttttacatattctgaatgagccttttgtcagatacatgtaatattgcaaatattttctctcactttgtggcttgtctcttcacacttttaatgtgccttttggtgaacagatgttcttaattttaatcaagtccaaatttttcattttttcttttattgttagtgctctttgtgtcctgttaaatctctgcctttatggggttttaaaaagctttattattttagctttcacacttaaacctacagtctatttaggattgatttttgtatagtcatgcattgtgtaatgacagggataatttctgagaaatgcatcgttaggcaattttgtcattgtgcaaacatcatcgagtgtacttacacaaacctagatggtacagcctactatacatctaggctatatagtgtagtctgttgctcctaggctagaaacctatacagcatgttaccgtgctgatactgtaggcaattgtaacacagtgggaaatatttgtgcatttaaatatagctactcattaaaaaggtacagtaaaaatatagtataaaagagaaaaaatggtatgcctgtatagggcacttaccataaatggagttcgcaggactggaagttgttctgggtaagtcagcgagtaagtggtgagtgaatgtgaaggccttgggcattactgtacactgccgtagactttataaacactgtacatacacttagtatatacacatttatatgaaaaatatttttctttcttcaataataaattaaacttagcttactgtaactctttgtttataaactttatttttttaactttttgactcttttgtaatagcactttgcttaaaacacaaaacacattatatggctatataaaaatatttcctttttaatatccttgttctataagcttctattttaatttttttcacatttttttcactttttaagcttttttgttaaaaactaagacacaaacccacacattagcctaggcttacacagggtcaggatactcagtatcactgtcttccacctctacacctccacattttgtcccactggaaggtcttcagggacagcatggagttgtcgtctcctctgataacagtcccttcttctggaatatctactgaagaacctgcctgagtctgttttaccgttctttttttattttataagtagaaagagtacatgctgacataatgattaaaagtacaatgtagtaaatacatgaaccagtaacatagttgtggattatcactgtcatttattatgcaccatacacagttgtatgtgctatacttttataggactggtaacacagtagatttgtttacaccagcatcactaaagcatatgagtaagacattgcagtgcgatgttaggatggctacaaggtcattaggtgataggaatttttcatctccattataattttatgtgaccactatatatgcaatcagttgattgagacattatgtggcacgtaactgtatattatttgaggtagggggatcaaggttgttttttcctcatatggatacctaattgacccagcaccatctattgaaaaaaaactttccctctactagaaatgtcattgttttcactttttaatttttgagttctgggtttcacatttcttttttttctttccattttcaacacattgtcacagtagctaaaggtgaaataagtactcttggtcccattcagatgccaaacaccatcacttttgcttccacatcaaaagtggaagcacttttgtttgcctgagacagtgatgatatgctaagttaggtttaaaggatatgtttatttcctatgtgcaactttctgtattaaggctttgcagagctcccagggagcaacactcactttggggcctgtgtgaatggtgtcctttgttgtcagtggcacacggtctgtgtggcaagatggcagcagccctgagtcctacttgtaataactggcaaattaaaaaaaaaatcatggatgtggcgatatgtgcctggaatcccaaccacttggggagggtagggcgggaggattgcttgagcgcaggagtttgagtccagcctgggcaacataaggagacccccatctcttaaatcgaaaaaaaaaattactatttctatgcccccagcaatctaccatttcacaaataggggtactaaagtgtgccccaagtttaaagagatggataggaagtaaactctgaggcaatccttgtgacttttcagaatttaccaggtcttatcaccttactttttaatatttcatatatcagtttctatttttgatttagaaggtagtttacatcagttatttttactagttccttatttttgatttagaaggtagtttacatcagttatttttactagttccttactagatcactcttctgtcctaggataaactttctttccagggttccctgcagtattctaaactttagtgacacattcagaaggggacccttgagacttatagctactcttgtatttccttggaggtacaacttctgtagctacttttaagtttctaagaacctagaggacctctttgctataacttttaagctacatcttgtaaaaatattgtttccacaaatgagtaagttctcctttaatttcatgccccagtttaatcatcaacaatgtgcctgaccagtgatttatgaggatttttattagcatcataatctgatactattgcattaaatctttaatgccttggaggggtatagttgggatgaaagtataaaatctgaataatgcctgttagaaaggatgtagaagtacttaataaatttctacatttagcccatctggttaagttaaccatggaataaacaaacaaacaaaatctctgtccacgccacagactgcagcttgtctgtgggcagctctgtcactaaggattgccagtggttagaagacgacttactttgagatgaggtcagctcagcacaaacccctaactccccttggaaagcaacccatagctgtgtcctgaaagtaggtcaataccatcctaaataaacaataaggaatgtttagagctttgagatcttctgaactagagaaatggaaacaaaaatttaacaagaattttgtgtggctttggatactttgctagaatatataatacattctgtaaattgaaaatagttgtgacaatggcataatatcttagtaattaatattcttttgatattcatttttgtgtttcacatgttatttaaaagctcaccatagtgttttcaagtgacctgcactattctaacacctgttatactttttaccgtatgcaatctgcatatctatataaaagaataatttattttgatttgattctctaatcacttgcatttgtaaaatattgaaatttgagatatttatcttctactgatgaaatttttctttaaattttattgctgattcaaataataccaaacaccttatgtgaaaggcattgtgctaagtattatggcgggatccataaataaagtgcataaaattcttagttttaaaaaacattccggtagaagaggaacagatgggggaaagttagcatttattaagcatctattatacatgtcgggtattaagctaggtgctttacctatgtatttttatacatgggtatgaaattttaattctcagtacagttcttaaaggtaaccagagatgtccccatattacatacggcacacttgagactcaaagaggttaagtaaattgcccaaggtcacacagctagtaattggactttgaaaagatagcattaaggaaagcaggtaaaatttgatcatgggagatgaaaggaaggttattttagaagaaagaaaattataagggccagaaaacttaactgtgtctaggaaacatccaagtagtcaggttatacctgcagttcttaaactttttggtctcagtacccctttaatttttttttttttggttgccactgaacaaattaacctttaatattattaagtattgtagaatccaaagaattgtttgtttctgtgggttatttgtattatcatttaccatatgagagattagaacaatttaaatatttggccgggctcagtggcttacacctgtaatcccagcactttgggaagctgaggcaggagttcaagaccagcctggccaatatatagtgaaaccccttttctactaaaaaatacaaaaactagctgggcgtggtggtacatgcctgtagtcccagctacttgagaagctgaggcaggagaatcacttgaacctgggtggtggaggttgcagtgagctgagatagtaccactgtactccagcctgggcgacagagcaagactccatctctcaaataaataagtaaataaataatagaaaataaaacatcttaaatagtaaataatttaagaataacaaatccactgcattaacataaataacatttttttgtgaaaaataactatattttccaaacaaaaaagtagagtggcattgttttatgttttcaaatctcgttatagtcaagcttacagatgacagctggattctcacatatgcttatgcattaatctgttaaaataccacatgtcattaagcctctggaaaactctactatatactcatgagatattgagaatgaaaagatagataacatctgagttttattatgaaattaattttgatctcatagacttcctgaaagtgttttagaaaacccaagggggttctttggagaatcactgggcaagtttgtgaaggggaacccaaataagagtgtaggtttgggactagataatgaaaagatgttcactgggggaatttggtctttactaagcaatggggagccactgaaataaagtagaagagtgaaataaaaggagctgtgcttttagaagattttttttattgcaagtaatgcctagagtatcggaagcagttacaattgaactgtaattgatatttgaggtaactgtgggaagcaacgtaatgggttttgaggaagaatataaatatagtacatctgattaaatacaaaggacagacaaagaggaaagtcaaaacagtgctaagattttgagccttatgactggttggcttatgtcccattaacaggcatggggagtacaggaaaataattaagcttgggaaagaaagtagggaattaagttttagattgtatataaaaagttttacctctaacattttgaaataattttgtcttacaaaaaagttgttaaaataataaggttcatatatatccttaacctaacttcccctaatacaacttatataaccactgtgcagttaaacaaggaaagcaaccttggtatcacgctattaactacacacataattcaaatctcaccagttttttttcactaatgccttcttcctgttacaagatccaatctgggatcccacactggatttaattgttgggtcttcttagtagctatcctccaatctgtgacagtacctcagtctttctttcattgtcttataaaacatttttaatgaaaagagaagatgcttaatatatatgtagaggaaaaaaaaccaatgccattttatctctttttttatatttatgtatttatttattacctccattctctcagagtgggatattttatcttttaaaatgcttaagaacctgaataaaaatctttatttttctttaaaaagttacaaaagtattataaaaaattaaatggtgtagaaaacataaagaagtagcaacccagtagtatctcccagagataactaccattaacaatttgttgtgtatccttttatttatttatttttgcctagaatttatatgtatattatgagatcataatgggcatactgtcctgtaacttgtgtttttcattcaattgtatattacgttcacttaacatttttcaatgtcaatatatatagatctgtttcactgttttaaatagctactcagtatttcataatatggctgtattatttcatgaagccattctcttattgatggacctttaggttatttcagttttcatacttatacaagatgctgcagtaaatatccttatatatgtatctttagctaccagggcagtaatttctatgaggtgaaattgctgggtcagagaccatatccattttctacttttgcagttattaccaaatttccctccaaaagactgtatcaacttatcctccctccaacagtgagtgacatgcttatttcccaacaaagctgtggatggaagtattgtaattgacaatggtttggtccaggtatggtcttgtgggtgcttaactatacattgctcgctctcttttttcctacaaatcattgctttgcttttgtaacacacatatgtagataaaatacttaatgaaaatattgaatgcttttaaatcctttgtctttgagatcttttaatgcagcatgtgataaagacaaaagcatggccatgaagagttcttggcaggaagcctggggggcttatgaaatcgttattgggaggctatttatagggtgcatcttagatttctaggtagtggtggaataggaagaaatattcaagaagtgggaatctggggtatataaattgttctcaagagggacttctattagagtgaggaatgtggagttaagtcctggctcttcagaggttcctatggtcttgagcaagttgtctaattcagtgttaattcttacttggtgagtaggggagaagggcaagggaagagagtactaatcctaacatatccgtttggaataacataaaaatccttaaattatctttaataccccatatgtagtagtggtgctaaaagcagataactaagaatgtcagttatagcagagaaagcatagatcaggtagtaaggcagttccagaaaaacttagagtaatctaaatcaaaagaaagaattcaacaaataaaagtgatccttgattttgtctgtcatctaaaagtacactggctgctgcacagactaagcaaaaaaagtggggtttttgtttgtctagttgtagtttctatttgttttatattttcacctcattaacacatctcaaaattttccaaaatatcttcatttttcttttttcaaatttaaagtctgtatttttgtggaccagagtgggaatgtgttgtaccttttgttttctgtaggtcattctatctgcacatacgcatcctagtttcagttacgtatttctgaaaaaataacaggacgtatttccagacacatggattgacaaagggatagaacattaggaatctagaccctcctaaaaagtgtaggttatgtaagtctcctccccaaagcattactgtaattatttgtgacaaataatgatccatgtgaatattaaggatgtttgatatactatcagctgcctctttcctatgtggatgagctgtaataaagtgacagcttaagaactcggccttttcaggtgtgtgttagattttctctctcttccttagccctaacttctaacagaggaggtagaattagtgcatcaaaaataataataataacaagataacctttgtttttatatataatataatattttaaagggttttgaagaacagcctgacatgtgaaatttgaatatggttcaaggctgttccaactaaaataaggttttcatttttcttgttaataaagaaaatcagtatgtatttgtgcatatgtatgatttattcacatacacattatctctgtaaaatatgtacatgcaagtcattaacaattttttaaaactacagagactatcattttctgattaactagtttgctagttaaaatgagggcaaagaagtcccatttacactaatgtttagaaaattcaacatgatgaataattacagaggcaatctcctaaaagcccaaattagaaaactgttacaaggcacagcccttctaaaatggggctgtgatttgggaactgttcctccctcagtcatttaaactattttaataattgtattctgctgctagagaattggaaggctgtcagttccctttatttgaatgcttactatgtgccagagactgtgctgtacacttgacatgtatcatttcacttggttgtcatagaaactgtggatggaggtagtgccacttgaaaactgagctttggagagagaaaaaaagatttttcccaagatcatgtgggaagtgagtggtggcacccagacttgaacttcaaagccttgctgcttttacccagcatagttaagtcaaagtctgaaatctgtttccttattgctttttctttttctttttttttttaaatgcggtcttgctctgtcacccaggctggagtgcagaggcccaatcatagtttactgcagcctcgaactcctgggttcaggcgaccctcctgcctcagcctcccaagtaattggaattacaggcatgaatcagcctgcttggtccgttattgcttaactgtaacatggaccaaagaagcagctaaccctgttagttaattcttactaggaagagaaaccgcaccagctatttaaaaaaaaaaaaaaaaaaagcaaaacaaaaatgaaaataccaaggtatactggaaaataacattgagcttagaaggagacctgagtttgtacctggctcagtcacccagctcatttatcactttcttaggaaggcctttccctgtcacaccctccttcttgtttgtctctattagagcactgaactcattgccataattaccttattgcagtgattctaaggtggacatctttcacattttaacttttctaaagtgtggatgcattttacaattgatggtgttttaaaataaattggcagcattttttcttaattattggtacttaaaataaggatgtgctgtacagttgatgacatcttagatttgattaagtgcatatttatttttgtgtgttcccacaaaaatgtttacatcattctcatggttttaaatatcagatatatgcaatgattttccaatttctatccttttttaaggtccacccctgtatgttgaaccacattgtttcttcatatcacaaggattacagattcaacatatctactctccaaatcagtttgtcttctattgttctctatctcagtgaatggcatccacattcgtacatttgtggaactaaaacatgagatgatcgcccacctgggtttgaatcccagttccgccctatagtagttactcaagcatgcagtgaagtatgtcaccttaactattcacttgtaaaatggggaacataataacacctatctctgaggattgttagaatgactaagacattgaataaatgttagctgtccctaatcttcatcatacatatctatgacttctctccttcctctgcacatgtaattcatcaactcctgtgatagataggcccttcagagtatctcacatctaccacttctatcttgttgccacttctccaatctaagcccccatttttcttgcctatgcagcaactaatattgtagcttctcctctttcccatgtctaatccagtcacaaccatccattaaatcagaacatgccacttcttaagacctccctcaccccctacctaatgcatttggtataaaacaccacatcattaatgtggtctgtatggttgtctgtttcctgcctggcttctgcccacatttccagcctcatcctctgccactctgcctcccagtatcactcttttcctccaaaagtaactcctactcatcctttagatttcagcttaaatgtcacttcctcagagatgattattgatcttccaaactaaattaagttcttcagttatagtcctttatattgaatgtatgcctttcttctttgggatgatcagtttctcccaaactgtggctaaagaagtgaagtaacttccacaaggccaaagagtgagatctattagaactggaattctctctgttagaggaaaaaaaaaaatccaaaaaagagaaaagaagaaaaatggaaagaactggaattacaacccaggggcggggtgaactctaaagctgtgtcctttctgtgatctttgctgccttgagggcaggaaacagggtatgaatcaatgttctaagtttcaaaacatggcctgactgctgctcgtttatttcccatttcaagttgtccttaaatgagctgggtgcagtggctcatgcctgtaattcaatactttgggaggccgaggcaggtggatcacttgagcacaggagttggagaacaacctgttcaacatggcgagaccccatctctacaaataaaattagccgggtgtgctggcacatgcctgtagtgccagctactcggggtaggagtgggggcctgaggtgggaggatcgcttaggcccaggaggttgaggctgcagtgagctttcgtgccactgcactccatcctgggcgacaaagtgagatcctgtctcaaaaaaaaaaaaaaagttatcctgaagtattattctttctgagccttcatgctccctcaatagattgtaacctgttaaaatagtacctgttttctgatatattatcaacctagcatttacataaattatcttacatacagtaggtactcattaaatagtttttctcttagggatgttaaagaaaaacagtattttttttccatttaatcttttcaaggtctgaagctgtctcatggaggaattgagtaccttattctttctaccagtcaatgacagagtacaatttatgtttttatattttgaatagaactgctttaaatgtttttaaagctaatagtttgcatcttaatggatcattacccttgtttcattgggaaaagaaggaattaaccttacatatttttgatttccttcaggaattgagtgatctacagcgcgatccacctgctcactgttcagctggacctgtgggagatgactgtaagccttgctctatttctgggattatgctacctttaaaaatataggtttgaacatttgttaatgactccaaaactcctttgtttgtttcagtgttccactggcaagccactattatggggcctgtaagtatgattcatatctatgaaattaaccccctcagccatacttcattcttgccatttcacctttgatcagatgtttgtgatgaaggttgaatattcttgtactttgaatcacctaggaagcaaaatattattaaggatttacaatgattttccaaagcattggtggcaaatatttcctgggatcactattatgttttcctttgctgaatcctagatcattacacataatggagtgccacagctcgcaaccaggctgtgtgtttatcttttttttttttttttttaagtcacagagagttagttgtaattaaccataatcattctcacatccacagttttggtaggttagaaattagtctaatgaagccaataattgaattcctacaagtaacaagtgtcagtttgccataagtttcatcactgttcttttttgtgaaagagaatcaataaaatattacaatgggtctgtctttacctccttataaatttgctgcttttaattttgttgcattgtcctaaacacaaaattatctgctgtttgataattggctactctcaatacttattacttttgttaaaattatttctttcaatactttagaggcagttacaagacttgaaacaggctttttctttctatgagcaaaaaatctgattgcataagaatgagcactgacagctcaaatctactttctgggtgagagtacataagtaacatgtttccatgaacaccattctcttctccctgccctgaaagagctttatctagtgagttacagagtttttaatcatacgaccttgtgtttaactttaaaaaacaccaaaactactgaatttcaaagcagtactctgggcagttgtctcaaattattgttttattaagtttgtttttctaaaaaggcaaaatacaatgtatttatataacaactttcaataagaatccatttatttctgtttgtttttaattagttactaagaaccttcaaaatactctcatttaaaggcccacccttaccttttgaattatggcctttcacaaatattttttaggtgaatcacatgtaacaaatggttataatcatgttattcataactcccttactttagtaatgtaaatatttacagtactctggaccatatctgtcattgtaatttatcttcattttctatatttcttacaatttttgataaactagaattgtttaaacaatatatatagtaagaattattatacaggaaaatcctctagcatatatgtggaaacttaacgagaaagtaatgagtcttggtgttattaccagaatgctaatataacatgatatatttaattaaatatgaaagaattaaaatagaattgtaggtatagtttgctagcattttctttttttaaaatttttttgcttgtaatgttatattttctaatggctataaagaaacatggtcaaatttaaatttctctagtaaagttgattcccaatttgatagtagcatgaatatataattttgttttggatttttttgggttctctacattattttataaataattactaaacgaagatttggcacataaattgtgtagcagggtccttagcattttcttttcacgacagcctcttcagttcatctccattcttggtcatcaagtgaacatcagaacttaagttttactatcctcaaccctttttcaaaaaaaatactgattacggctgcagaaaatgatcttttcccacagcagtcgtgtgtatactgatctttaacaatttgtactcataaccagatttgtttggacaagtcacagcactgtgtgtgtcctgtttttgttttgttttaaattttatgatgtcggcatagttgttggaaaatcctccttcgtacctgcagagaaacctgttctcaaagtaaatgatttgaacttatgacaaaatggttgcatttttttcatattggtaatatttaatgaaattattttaaacatgatggcatttttttcaaactgataatatttgggggaaataattttgttgttataaataaatatagtaatcaaatgctgatgcaaatcttttgtaatttcagcctgatagcgcatatcaaggtggagtcttctttctcactgtacattttccgacagattatccttttaaaccaccaaaggtatttttatttttatgattgatgtgactcccatgtaagagattttattctttatctagagctcatttgattatctagagctcatttgatatgtcaaagactgtggggaggttagcattttcaaactgttttgtaaaaactactgaatctaaaatctgatttcttattgaaatactgtattaagtctataaaacaaaagtcagtacgtgtcatgctataaattaaattccttgcttttcttttccttcttattggatatgtgtagtttgggacgtttttatgattaagagtcagacttttctattcatgggattatccttacaaagttgatcattctttctctgttttttttttttaagtattcaataaacattcaccgagtacctactgtgttcttctacactggggaatccgaaagtaaatatgaagcagtcccttaatttagtatggtaggagagagaaacacatgttagatttagatttgctctaaagaggaaacaaatgatggggatatcagggaggggaaaagtgggcagattttgtcactcaggatataattattttaaatagttaaaaacagattaacattgtatttatgaaatggtatgacaactcttgtggaaaattaggattcttaatggatttcttagctgagacgcctcaactttgccctgaaacagcgtcagcaccctggttttagatccaaatgttacttccaggtatcaccaataatcaaattaagaaaaggattacttctacatatgatggaagccatggttaattactttagatgctgctcaaccagtcataccggctactagagacttatttattacactgtccaaaatactcttcagttcctttgagggcaaaagaaggaagctgacttgtttgtgttcacattctcactagctagaactgtgtgtagcacaaagtagataattatttgatttgtgttgatgacttttctcctctaaagttatgtaaagttgaggatattttaccctagagcaaattggttctgttttattcatagttgattcaaaggtgattgtcatattttgttgttttgttttatgtttagattgctttcacaacaaaaatttaccatccaaacataaacagtaatggaagtatttgtctcgatattctgaggtcacaatggtcaccagctctgactgtatcaaaaggtaatttcattgatcaggtttgaaacagttgataacagtgagacaggaaaaatacagcagaattacctatggactaaagttttaaaacaacaatcaactgtgctttctcctgttttgattttgttttgctctctttgctcttatgttactatggcttttggcagttagctttggttgaggggagtgtggatggacaaatctaaatgatgaaatgagaaaaaaccttaaaatatcagagctagaaatttggggataaacctattgatattttatccttttagcttgggtgttgtcttttaaaaaagagagagtgcccgggcactgtggctcatgcctgttattctaacactttggaaggctgaagtggaggattgcttgagcccgagttcgagaccggcctgggcaacataggagaccccatctctgcaaaagaagagagagaataagagatagtaaaaggaagattttgggactggttgtcccattcattaaatggaaatgttgacaataataaagctttacagctgttttacttcatccaagaataaaataccagatttgattgataaatgatttaagatgaaagacatttcacactgtaggataatgcagtacatatagcatgttagtctaaacttcgaataatcagtagcatcattatagtgactgacacaagatctgtgctgattctcaacttttacaggggtatagctgttctttgctggattatcaggtgtatacataggcatctcaagccattttatttcattagccactgctacttactgtgctagcactcttaatttatgtcttgtttctctgaaagaagagaacctgacagttggaaaatactgtttaggttagaagtagctgcactgaagcaaccatcaagttttccgtttttataaaattgaagaaaatgtttctcttgaagggatttatggaagcaatctgtactcattttttatttttaataattgctacttgaatatacagcatgtttttaaaagtaataaggtttataggaagcagggtccacagccgtagctctttcaaatattagataaataatagctctttcagttcaattatttatgaacgatagtttttctgacctaagatgctcatctacagtattcatatagattctcatattcttttaagaatctttcacacagtgtaactgtcatgcattagatatatgaaagattctgtgttgaagggttaattcaagttcatacgctgtttcctggaatggtgtcacaaaatggatctcacttggcatataaactgccaagtccttatacatataaaagaaatggcaaactgccagatattgagtacttatattctgacattggtagccttttataaagaatcagtagtgttagattctggaaaccatcctgtgagaaatgaaacagcctcagtttccttataagtaaaatggggattcttatagtgttaccatacagggttgctatgtacctagcacatagtgggcacttacatgaatgttaactgttacccttttccttaccttaaaggatagacatggtttgtgtgcatgatagtgaaactggggcaaatggctcctggcagtaggggtgagcagaggaggaacttccttcttgcttacttttttataagatagatcataccttgctcatttgtttgtatattttttactttgctatatttttttaaatttttaatttgtttatcttaaaagattgttttttaattaaatatagacagagtcttgctgtgttgcccaggctggtctcaaactcctggcctcaagtgatcctcctgccttggtctcccaaagtgctgggattataggtgtgagcaaccttgcccagcttattatttttatttttttattttttgagatgcagttgctgtgttgcccaggctggtctcgaactcctaagctcaaggattcttccacctcagcctcccaagtagctggcattataggcacataccaccattgcctggagcttttccatattttaaatgtcttcttttgctttttatcatgaggttagtctggaagcattctggggctgtaagttagccctgaaaatctgccctgttggtttaatatacaaggcttttaagtttcattgggcagatagaagataagaaagatgaataaaatactaattttttctttagttcataacacccccccaccctttgcctgtcattgtaagagtcaactctgctctataaatccacctttggacttgaaagagtacgaaaatagaaaggaaacgcagtggggtgggtgcaagtggaaatgggaggttggtccagaggttccatgaacctcctcagaagtggtggcatgcaattgaagcagacaaatgaggaaccagagtccttgttccctcttatttcagatacttagatcgttagtgtgtgtgtgtgtgtgtgttagtgtagctatttgcattagaattttgacatactggagtaacaactactttttcaattttcatttcttttttaaaatatgcaagctatataaagatagctgttcacattatttttaaatgcatgcaatacaaataaactacattaagtaaagattcattgaaaaaaattttacaaatttttcttctttgtagacagactatagctctaagccaaagcaaaagagtgtatgagcacagtatccaaaatggtttggactgttaactgtaatttgattgttctgtagagaactctcaagtttaaaggttgttaatagctactttggagggtcacatttttttaaataaatgggaactcggaatttaaaacttcaaaagctaaaataattttatattttatgcatcctatggtaattttataactttaaaaattaaagatcaatttgctatcaaccaaagtagaataaaatataatttgatgtgttcattttatgttttttttataagtacagtatctatattcactaaaattattttcacatatgtaatttgtatgaagtagaagggttattgtctaatgtgatgttctcttttaaatctagttttattgtccatatgttctctactttgtgatcctaatccagatgaccccttagtaccagatattgcacaaatctataaatcagacaaagaaaagtaagtgtttacttattttagtttctgtatggatacattcctatatagtatgccaaaacacgaatattatcaatatgttttaagtcaatttgattatggttgttatatgtatattgtttatctttttccaatggagtaaacctttctttgagaactctgttagaccttttatgataaatcttgttccttcccacttactgttcaatagtatatactctgtatttgaaaaatagatgtatatattctaggtgataaattaaaaatgaaagaatttaatcattggaaagtattaaatatatattgcttatcttctccaaggaagaggagttctctcgtacccatccaaactgacctaattctcaagctgcttcatcttgctagtactgtaggttcatttgcaatttgtagataatgctccttcaggattggcttttgtaaatttctgttagaagctggtttctgcattttgatttttgtgtatttggatacattttcatataggttgcagagaaatccatgagttaaaaaattatttttcctgttttatttctgcatgaacctaagtcacattgacccagtaattgatatatgtgtgattattgcaattaagtataagaaggtagaatatatagttttattagacagatgcttctgaaatattaattttgtatgtttttactatatcctttttgtgtatctacagatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctactatttgtcttgattacttaaaaaaataaaaatataagtaaggatcaaaactctaaaattttgcatgaaaattacatccaaattgtgaaaatcagatctattttgtttgccattagtcaccattagttatataaattttattgttttaggttagtatctctttactaaattgtcagtctataagataatatatgttgatcccttgctgtagaggagaatttagagtaatttggggtttgtcttggattatatctaaatggattatttgttaaaagtactgaaatgagtataaggcagtatcacccatccaaaagaaaggtctttatagacctgcacagtcactagattaattcattaaaatgcccccaccctgatgtaattgacattacatttcttaacattttaaaatctagaatttctaaaatggaatttaatgccatcacaatttgaaaaactttttttttttttttactatagaagttacaaaggaagttctaaaattatgcctccctctgtttttataagttgccatcgaaaagtgatttaaataagcaggttatctttatagattttaaagaaaactagaaagttttaatgttttaacttggggaaaaatacatctctttaatgtttagcatgcttgtcaaccttgagtgagtgtcatttttaagaacagttgtagcccttctgattattgcagtagctgtagaagtatgtaagaatatgtgatgggtgtagtcattagcaaagcatttaaatcacttgagtattttgtcatggttcattattattaaagcacaaaataacctattgttagaaaatatgtgtttttataaatgaatgtaaaataattaaatgaattgtgaaatggatgtttaagaaaatataggcttaaaaagtaaatctataaaatgatgtcttaaaacagccatatcatgaaaaattctacttagctatattattataagctacatttgccctgaatttgaacactcaacatcactagatttaaatatttagtatattttgatagtaaagggttttgtttcttgaatatcttcactttaaacaaaaaaaaaaaacaactttcatttgtgtggcatttatttttggaagtgtcttcttttttttctttattaaagtttttgaaacttgcctaacttgtttgccttt

SEQ ID NO: 16659 - DNA, 50950 bp, Human
gtggtcctcttgccttggcctcccaaagtgctgggattacaggtatgagccactgcacccagcctgttatgacagtctaactgtctatcaggttaattctaagacaagggtggaagcctctgttacggtctccagtttataaaagaatggttcctgcaagattacatcaaggccggaaggccatttaggatgctgaaaagataagccctatggttatttagcatcacaaagggataggtggagttgttaagagctgtcttcctttgtgttctgcctcattaagtcactgggtccttaggtgtcagggaatatagattgaacgaacaggtgtgtttcactttaggagcaagcctgggggaaaaggggtaccagtgacattttatgtaaatggaccctttggagtaatgcagcaggttattgtacaatttctttttgacttttatatcaagccacctgattttttgtcttcttttgctttccaaagtacacagatgctcctcaactttcaatggcattatgtctaaataaaaccattctaagttgaaaatattgttaaattgaaattacatttaatacacctaagataccaaacgtcatagtttagcctagcctcctttaaacatgctcagaacacttatgtcagggtacagttgggcaaaattatctaacacaaagattattgttattattttttgtagaggtggggtctcaaacacctgccctcaagcaatcctcctacctccaccacccgaaatattgggtttacagttgtgagtcactgcacctggcctattttattttattttaaaattttatttatttaattaattaatttttttgagacagggtttcactcctgtcacccaggctggagtgcagtggcgcgatctcagctcagtgcaacctctgcctcctgggctcaagcaattctcctgcttcagcctcctgagtagctggaactacaggcgcctgccaccacacccggctaatttttgtatttttagtggacacggggtttgactgtgttggccaggctggtcttgaactcctgatctcaggtgatctacctgccttgaccccccagagttctgggattataggtgtgagccactgcacctggccacctggcctattttataataaggtgttaaatatctcatgtaattacttgaatactgtactgaaggtgaaaaccagaatggttatgtgaggacttggagaagtaagtgtctactgattgctttcacagaaagtctaaacattgttaaatagaagcattgttaaattgaggactgtatatatgagtttttttttttgaaacggagtcttgcactgttgcccaggctggagtgcagtggtgcaatcttggttcactgcaacctctgcctcccgggctcaagcgattctcctgcctcagcctcccgagtagctgagaatacaggtgcccgccaccacgcctggctaattttttgtatttttagtagagacggagtttcactatgttggccaggctggtcttgaactcctgacctcatgatctgcccgtcttgtcctcccaaagtgcgggactacaggagtgagcccccgcgcctggccccctgtatatatgaaatttaaatgtagtgttgattgtatcagtacatttttggtttcagtcttaatttaaaagaattggacaaatgtaagcttttatgagccccccagctcaattttattgctttttacttatttgtaaccttcagataatttgtttttccctgtagtttatggctgtcagataaaaaactgatctggtgacaatgatctggtgaaaagctcagcccagaagaactataggtctgggctgttaggacttttaatttttggagagcatgtttgccctgtttttttttttttcttttcttttgctgttgtaataggcccatcatttactttttaattttaagtcttgtgccttgaaactcacctttgttgttggacactttctttttgaggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttggtaagaccctttgttgtatagtatcacgttttgttcagaaaaaacacttacagaaagttgtattaccaggtggaaggttctgattggagttgtccaggtttttggcacgttgaacaaataattgaacatcatgcatgaacaagcaatgaaagcatagatttattgaagtggaaggcaatagaagctaaagtacatgtcacaggatgggagcaggcctgagcaagtggctgcagagcccttgtagcaaagtcttctggggttcaagtaccctctagaggtctcccactgtttacatcctatgtaaatgaagtgctggctcacagcccattagaggccaaagtgaattggagctcggccattccaagactggtgtggattggcgccttatgcaaatgaaggtcctagaatggacggatcataggccagagtgcaaattcttccttttttgtttagtttcaggaatttttttttttttttttttggcaacggagtcttgctctgtcgcacagacaagtgcagtgacgccatctcggctcggctcactgcagcctctgactcctgggttcaagcgattctcctgtctcagattcctgagtagctgggattacagacacacaccaccacacctggctaatttttgtatttttagtagagacggggtttcaccacgttggccaggctggtctcgaactcctggcctcaagtgatcctcctgcttcggcctcccaaagtgttgggattacaggcatgagcaaccgtgcccatctattccaggaagtttgcgtgaattggccatagattccctgccttcagaccctattttcctgccttagttagttgcagcagaatgcttgagccactcttagaataattctggagtttgaatgtgataaaaggtaaaaccaaagaggcagtattgggtgttgccctggctgttacctgctgtggattctgttcatttactctttcaacaaataataattggacatttacaatgtgctgtccatccaaagatctgaaggtagctttggaccctcttcctagaaaaatgcagattcactcaaacttgcaaacattatcccctaatcacaaaagcttcactagttaacctctgctgtggtttgccacagcttcagagaatcagagctgttcagaatagagatggccatttgttgactacttgttacttgtttttgtctcaaaatagccaaccttgtgatttaaacatgttgaccctttctgacacctcctggttccaatagtaagttttgctctgcatatgtttaaaatacacatgtgtgtattttaacattgccaggcatggtggctcacgcctgtaatcccagcactttgggaggccaaagcgggaggatcacttgaggccaggagttcgaaaccagcttgggcaacatggcaaaaccctgtctctcctgaaaatacaaaaattagccaggtgtggtggcgcatgtctgcaatcccagctactcaggaggatgagacatgagaattgcttgaacctgggaggcagaggttgcaatgagccaggattgcaccactgcactccggccaaaaaaaatagtgttttttttcctttcgcttacattgcaatgacctctttaataaacaaatttgaacttggcattaacaggatagaatatgttaatataaagaaatgaaggactgatgtatcattttgtgttttgtcactcaccatccttgttttatttcatgtctaactttgatatcttgaaaaaactataaaaaatggaggaatatacctgcattccacatatacaactttaaatttataagtagacactcgaagctatttttaactgatttaaaatatatttttcagaccgggcattgtggctcatgcctgtaatcccagcacgttgagagaccaaggcaggtggatcacctgaggtcaggagtttgaggccatcctggccaacatggggaaaccctgtctctgttaaaaatacaaaaattaggccaggcgtggtggctcatgcctgtaatcccagcactttgggaggccgagatgggcggatcacctgagatcgggagttcgagaccagcctgaccaacatggagaaaccctgtctctactaaaaatacaaaattagctgggcatggtggcgggctcctgtaatcccagctactcaggaggctgaggcaggagaatcggttgaacctgggaggcagaggttgcagtgaaccgagatctcgccattgcactccagcctgggcaacaagagcgaaactccatctcaaaaaaaaaagaaaaaaaaatttgcggggcgttgtggcaggcatctgtaatcccacccacacaggaggctgagacaggagaattgctggaacttgggaggtgggggttgcagtgagctgagattgcgctactgcagtcccgcctgggtgacagagcgagattccgtctccaaaaaataaacaaataaataaaatacaatatattttttcagataggcctataggtttagatgagtgagaaatagaaatggtgagaaagggctaaatgggatacatcacctttaaaagtaagaaaacaaagaggctgggtgcaggggctctcaactgtaatcccagctcttagagcagcagaggtgggaggatagcttgaacccaggagtttgagacctgctgggcaatatagcgagaccccattctccacaaaaaggaaaaacaaaaaaagacaagtaaacaaagatcctgataggatgaccagcataaagtaggtgctgaataaatagagactgtttatcattattattattattattatttgagacggagtctcactctgtcacccaggctggagtgcagtggtacgatcttggctcactgcaacctcaatctcctgggttgaagccattctcctgcctcagccacctgagtagctgggattacaggtgcccaccaccgtggctaagttctgtattttttagtagggacgggttgtcatcatgttggccaggctggtttcaaactcctgacctcaggtgatctgcccgccttggcctcccaaagtggtgggattacaggcgcgagccaccacgtctggccgaggctgtttattattattatttgttaattatttatacctatgttttcttttaaaattttacagttttaattcctttttttaaatttttgtttgtttgtttgtttgtttattttgagacaggatctcactctgtcatccaggctggagtgcagtggcacaatctcagctcacttcagcctctgcctcccaggctcaagcaattctcccacttcagcctcctgagtagctgggaccacagatgtgcaccaccactcccagctaactttttgtattcttggtggagatggggtttcatcatgttgcagtctggtctcaaactcctgagctcaagcaatacatccatcttggcttcccaaagtgttaggattacaggcataagccacagtgcctggcctagttttagctcttatgtttaattaaggtcctttattcattttaagttttatttatttatttattgagacggagccttgctctgtcaccaggctggattgcaatgtcatgatctcggctcaccgcaacctcctcctcccggtttcaagcgattctcctgcctcagcctcccaagtagctgggattacatgcttatgccaccatgcctggctaatttttgtatttttagtagagatggggtttcaccatgttggccaggctggtctcgaactcctgccctcgggtgatccacccgcctcggcctcccaaagtgctgggattacaggcatgagccaccgtggctggcctaacttttttatttttattttttgtagagacagagtctggccatgttacccaatctgatcttgaactcctgctgtcatctgatcctcctgcctcagcctcccaaagtgctgggataagaggtgtgaggcaccatccccggccagtttgcagtctaagtatgatgttagctgtgggtctttccctttccctttctctttcccttttccttttcctttcccctttcccctttcttttttcctttcctttcctttcccttctgctttcctttcccttccgctttcctttcctttcccttccgctttcctttcctcccctcccctcctctcctctcctcttttctttcctcttctctctcctcttctctcttcctctctcctttctcctctgatatctgaagactaagctgtggatgtttcataaaagttctttctggggtgggtgcagtggctcatgcctgtaatccaagcactttgggaggctgaggtgggcggatcacaaggtcaggagatcgagaccatcctggccaacatggtgaaaccccgtctctactaaaaatacaaaaacaaaattagccgggcgtggtggcaggagcctgtagttccagctagttggtgatagagtgagactctgactcaaaagaaaaaaaaaatgctttctggctggttgctctgactctttcaccctataatctcagtgctttgggagcctatggcaggagaagtgcttgaggccacgagttggagactgcagcaagctatgattgcaggccacagagcaagactttgcctctaaattaaaaataaatagataataaataaaataaaagctctttcttaggttgaaggagtttactcctattcctagttttctgagtattttttgttataaaagggtgttgcattttgccaaaatttttttctgtgtctattttcctatattctattgttatcgtgtattatattaattggttttcagatgttaaaccaaccaagctttcctgggttaattctttttttttttttttttttttttttgagatggagtctcgctgtcgcccaggctggagtgcagtggcgtgatctcggctcactgcagggtctgccccctggggttcacgccattctcttgcctcagcctcccgagtagctgggactacaggcgcccgccacctcgcccggctaattttttgtatttttagtagagacggggtttcaccgtgttagccaggatggtctccatctcctgacctcgtgatcgcccgcctcggcctcccaaagtgctgggaatacagatgtgagccaccgcgcctggcgtcctgggttaattcttgtttggtcatttgtaatcttttttatgtgttgctggatttagtttgctactgttttgttgaggatttttatatctatattcacaagggatattggtttgtggttttactgtgatgtctctgtctggttttggtatgctggcctcatagatgagttgacagtgttccgttccgaatttcttcgaaaagtttgagaataattggtattagttctttacatatttgatagaatttaaaatgaagccagccgtgtgtttcttttttctttttttttgagacagggtctcactcttacccacgctggagtgttacccactatcacgtttcactgcaggcttgacctcccaggctcaactcctacctcagcctcctgagtagctgggacctcaggcatgtgccaccatgtgtggctaatttttttattttgatagagatggggtgtccctatgttgctcaagctaaagtgaggcaatctgggactgcacttttctttgtagggatattttgattactcattcagtcttttgttttgttttgtttttttggagacagagtctctctctctgtcacccaggctggagtgcagtggcacaatattggctcactgcagcctctgcctcacaggttcaaacgattcttgtgcctcagcctccagagtagctgggactacaggggcgcgccaccacacctggctaaatttttttttgttttgtttttagtagagacgggattttgccatgttgcacaggctggtctcaatctcctgaagtcaagcaatccgcctgccttggcctcccaatgtgctaggattatcattcagtcttttcacttcttatgggtatattcagattttctgtttcttcttgtgttagttttggtagtttgtatctttctaggagtttgtccatttcacctatgtcatctaatactgtcacacaattgttcaattattctttttaaatcatttttatttctgtcagatcagtagtaattatctctctcattctaattttagtaatttgagtcttgtctctttttttcttgttcagtctgtctaaggtttgccaacttgttgatctttttaactaactaaatttggatttgttaattttctttttctttctagagatagggtctcactctcactctggagtgagtggtgcaaccacagcttagtgcagcctcgaccttcaggctcaagtgatcctccttccttggcctcccaaagtactgggattacaggcgtgagccatcgtgcccagcccatatgtaattttgatagatcttgctaaattgtcctccctagacaattatagacaatgtgtgtataaattatattcccaatggcaatgtatgagagtacccgctttttcatacctcttgccagcactgggtgatatgaaacttttggatttttgccaatctaataggtaaaacatgaaatcttaatgtgtttttgatttctgaattttcttatattgggttagcttggccacctttcatatgtttgagccagctgtatttctgtttcttgtaaattatcttttcatatcctttacctatttttctactggactgtttagcgttttcactgatttataggaacctaacatttattagggaaattattccttttcctgataggagttgctagtattttccctagtctgccttgcaatgaacatttaattacctgccatgtgcaatatcccaagtgctggagttgtactgttaaacaagaggtctccagctgccctcctggaggttatgttctaatgcagggaggtggggagaaaatatacaaataagcaaggtaatttccagccgtggcccatacccaaaaagatataaaacaggataacattatgataacaggtgagtaatgtttatataacaagctgagcgggaggccgggtgtggtggcgcatgcctgttatcccagcactttgggaggccgaggcgggcggatcacaagttcaggagatcgagaccatcctggctaacatggcgaaaccccgtctctactaaaattacaaaaaattagctgggcatggtggcacgtgcctgtagtcccagccactcgggaggctgaggcaggagaatcgcttgaacctgggaggtggaggttgcagtgagccgagatcgcgccaccgcactccagcctgggcgacagagcgagactccatctcaaagaaagaaagctgagtgggagatgatagtagagtcctaaaggcagatagtgttgtgtagatagtatctgttatacaaaaggcaaggtggaatgagccatttgtgtagttggggaagaagtgctaagaccacaaggcagattgaacccagcattcttgggggcagtgaaaggaggccagtggtgctgggtgtcatgagcaaggggagaggggtatgaggtggggctggaatggtggcagacgccagaccctgagcatctagtaggccatgaggaagagtgcagattttatgctaagtgtcatggaaaacctcaggaaggtaataagcaggaaattactgtattgcaagtaattttccaagtcattaaaaattactcgagaacttttaatgactatttgttatttcacggttttatatatatatgtatgtgtatgtgtgtgtttgtgtatataaatacatatattaatagattataatatatattatatattattatatatttagatataattactatattataaatatataatatatgttatattgtgtataaatatataattatatttaagacaacttataaaataaatttatataacatgtataataaatacaaattatatatattatatataataaatataaaataaatatataatatatattaaatatttgtttatttatttttttgagacagggtcttgctctgttgcccaggttggagtacagtggcaggatcacagcccattgtagcatcagcttatcttgctcaagtgatcctcctccttcagcctcctgagtagctggactacaggcatgcaccaccacatctggttaattgttttttgttttttttcagacagagtcttgctttgtcgtccaggctggagtgcagtggcgcaatcttggctcactgcatcctccacctcccaggttcaagcaattctctgcctcagcttcccgagtaactgggattacaggcacccgccaccacgcccagctaatttttgtattttttagtagagacagggtttcaccatcttggccaggctggtcttgaactcctgacctcgtgatccattcgtctcagcctcccaaagtgctgggattacaggcatgagccaccacacctggccatttttttttttttgaaactgggtctcactctgtcgcccaggctagtgtgcagtggcgcagtctcagctcactgcagcctcgacctcctgggctcaagcgatcctcccacctcagcctcctgagtagctgagaccacagggacccaccaccacaccctgctgattttttattttttgtagagatagggtttcaccatgttgcccagactaatttttaaattcttggtagagatgggtgccccctatgttgcccaggctggtcatgagctcctggggtcaagtgatcctcctgccttagccttccaaagggctgagattacaggtgtgagccactgtgcctggccatgtggttatagataaactgccatttgttaaactcattggtaatgttgttttttctctcctaatttttaatcttgtaaaatcttgataagcagattgataattctgattgccttcttaggctattttcctacaattagcatttatgagcaatttttaaacgtttgatacatgaaattcaacagccctctgatgcatgcttttatattacagaatgtgtgaatgacaactactggtttgggagggacaaaagctgtgaatattgctttgatgaaccactgctgaaaagaacagataaataccgaacatacagcaagaaacactttcggattttcagggtaggtaatgaatacccatgtatctaggagagctggtaatttggtcattgtttttagatattttcccactataaatctctgctattcaaagtctgaaacaaaatgttctctattttaggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaaggtaatattattatcttatggttactggaattttttttttccactctctcataggaggaaaatttgtcctgtccttacagaatatggtttaagtgagtaaagatgagtaagttgctgggcgtggtggctcacacctgtaatcccagcactttgggaggctgaggcggatggatcacctgaggtcaggagttcgagaccagcctgacccacatggagaaaccctgtctctactaaaaatacaaaataagccgggcatggtggtgcatgcctgtaatcccagctattcgggaggctgaggcaggagaatcgcttgaacccgggaggcagaggttgcagtgagccaagatcgtgccattgcactctagcctgggcaacaagagtgaaactctgtctcaaaacaaaaaaaaagatgagtaagttagcactcaagattcaactttgccgtcctagttgcattgtaaaattatgaaaaagttccatccagacagatttttaaggttttaaggtttaattggttttatgtaatgccatatactgttttttttgttttgttttgttttgtttttttttagacggagtcttgcactgtcacctgggctggagtgcagtggtgcaatctcggctcaccgcaacctctgcctcccagtttcaagcgattctccttgcctcagcctcccaagtagctgggattacaggctcctgccaccacacccatctaatttttttgtacttttagtagagacggggtttcactgtgttggccaggctggtcttgaactcctgacctcgtgatctgcctgcttcagcctcccaaagtgctgggattacaggcgtgagcccccgcctggcccatatactgttaattgaattatcatggtgattaaaataagttatagttcattgattgattcagtttataccacatcagtcttagatatctatgaattgttgtttcaggccattaattcatttttccttcctcttcacctcattctttcctttcttcattttttccattcatttttttctttctttctttttcgagacatggtctcactctgtctcccaggctggagttcagtggcactgcaacctctgcctcccaggctcaagtgatcctcccaccttagcctcctgagtagctgtgaccacagacacatgccaccacgcctggctaattttttgtatttttggtagagacggggttttaccatgttggccagactggtcttagacttctgagctcaagcagtcagtctgcctgccttggcctcccaaagtgctgggattacaggtgggagccaccatgtccagccctattcatttatttctgtatacatttattgagctccttttttttttttttttttttttttccttgtgacggagccttgctctgtcgcccaggctggagtgcagtggcgcgatctcggctcactgcaagctccgcctcccgggttcacgccattctcctgcctcagcctccccagtagctgggactacaggcgcccgccaccacgcccacctaattttttgtatttttagtagagacggggtttcactgttttagccaggatggtctcgatctcctgacctcgtgatccacccgcctcggcctcccaaagtgctgggattacaggcgtgagccaccgcgcccggcctattgagctctttttatatgccaggtactaggctgtgagtgcttctgtaagaggctcactttagagcttctacctttgtaaatactacaaggttatcgtgcacaagtggagatgtttatcagcctcatcaggtagcattttataagcatccatttctgaaactatgaaaataacatctaaaatgaacaactgtttttctgggtaatatctagaaaggatacctgacaaaaacaaccaatagagttaaaagtagctcagcgtgattagacaggaggaatacaatttttctttagttaaagaaaccatagacgttcccaaacttatctgagagtcgaatgacttggagggtgtctatgtgtgtgcgacacattttgaaaataaaggttcatataagcactcttctccagattctggtagggattttaaaaatcatgcctctaggggctgcggcatgagtctgtagtccctgctactcagaaaggtgaggctagaggatcccttgagcccaggattttaaggctacagtgagctatgattgtgcctgtaaatagccactgccctccagctcgggcaacatggtgagaccccatctaaccaaacaaaataaagtcatgcctaagggattttcatgcaagtcagtcttcagtctggtatcttggaactatgtctatgttgggcatcctaaagtacattttatgattaacttagttttccctgtttctattttgactattttgttttcttttcttttcttttcttttttttttttttttttttgagacggagtctggctctatcgcccaggctggagtgcagtggcatgatctcggcccactgcaagctccgcctcctgggttcacgccattctcctgcctcagcctcccaagtagttgggactataggcgcccgccactgcgcccggctaattttttgtatttttagtagagacggggtttcaccgtgttagccaggatggtctccatctcctgacctcgtgatccttccgcctcggccttccaaagtgctgggattacaggcgtgagccaccgcgcccggcgaccattttgttttctatctgacagttatagtcagggcagctgctttaggttttgctgtttgtgggtacctaggggaggaggcaactgggtgctgaaatttggtctgtcctctccttgacaagctgtgtgccaccttctcattggtctactcaaagggcacttttcttcctcttttaaaaaaattaaataaacattaaaaaatttatttaatagataaataaaaattataggctggcgtggtagctcatgcctgtaatctcagcactttgggaggccaagacaggaagattgcttgagtccaggaattcgagaccagcttgggcaacatagtgagaccccatctctgccaaacataaaaaaattagctgggcatgctgctgtgttcctgtagtcccagctacttgggagtctgaggtgggaggattgcttgagcctgggaggtcgaggctacagtgagccatgattgcaccactgtactcttccctgggcaagagagtaagaacgtgtctcaaaaaaattatatgtatttatcatgtacaacatgttttcaaatatgtatacattgtagaatgactaatttgagctaacatgcattacctcacatatttatctttttttttttaatagagaaaatacttaaaatctactctctcagctgattttcaaaaatacggcggggcgcggtggctcacgtctttaatcccagcactttgggaggccgaggctggcagatcacctgaggtcaggagttcgagaccagcctggtcaacgtggtgaaactctgtctctattaaaaatacaaaaattagccgggcatgatggcaggcgcctgtaatcccagctactcaggggtctgaggcaggagaattgcttgaatccaggaggtggaggttgcagtgagccaagattgcaccattgcactctagcctggggtacaagagcgagacttcgtctcaaaaaaaaaaaaaaaaaaaaaacccaaacaaacaacaaacaaaaaacagtacattgttgttaactacaatcaccatgttgtacaataaatctctgttttctctaatttgaacaaagatgtcatataggctaaaggtgacccttattaaagtaggtcagactggtcctctgcaggctgcatttggcctatagatattttattaggcatttactgatacttacagtggtaatgtgaacatccagatgtcttagagaagttgtaatatgtggccacagtgagtctatagtcccacaaccggaggatctgtaggcactgagtagaggctgcctcctttagatgggaggtgtgttttctctccccacttctccatggtgtcttaaactcaacacagcctgaccctgttacattaccttcctgacttgtgtggacaatggcgtttgagcccttgaagtaaaccttgacaggagaaatacatcatgagagccaatcaaatttctacattctcagatgccactggaacatacagcgttatgaatagctacaagcatagagggacacttgtgcctgggtggccagcaggtgtctgtcaccagacaagtgcctgcctcttgtgtaccagcctgaatgaaatatactcaggtggctcagatttgtgccagagactggatccttaggttattctagggaggtcaaaacctgtcacctgagatctgagaaactcaagggtcttaacaaatttcacctttcaagatggcataggcaattgcaaatttatcattgatgactttgtagaattgaaatatttgataatttatcacaggcttggcccacgtgggtggttaaattattaaatcatcagcactgtcctgggttatagaatttaaaaagtagttgttttactttttttttttttggctgggcacattggctaactcctgtaatcccagcactttgggatgccaaggtgggtggatcacctgaggtcaggagttcgagatcagcctggccaacatggtaaaatcccgtctctactaaaaatacaaaacttagccgggcatggtgctgttcgcctgtaatcccagctactcaggaggctgaggcacaaaaattgcttgaacctgggaggtggaggttgcagtgagctgaggtcatgccactgcactccagcctgggcaacagagtgaaactctctcaaaaaaaaaaaaaaaaaattactttttttaagatacagcccaaataatggagaaaaaagggaatttgtttagaaaatgttatttacctagctttacaaatatgttgaatatggtttgcactataaaatacttaataccggatatataaaggtataaatggctgagagatgataatacccgtatggtgatactgatggcctaattttcattgggatatttacttgcctagaccattttttctaggctcagactgatggattgctttttgattctgggcctgttgtaaatctgcatgggcattttatattagtgtaattgattgatattctgaggtcaaggaatataaataatgttgtgttacggattttttgcactagtttcagagtgatgcttatagttccattgaagcatgaaatttgactatcatttatttctcaagggctttacaatatgtattagcccactaatacctattatattacatacatactaatttccttaaggttacatgttaaatgtagttaaaaacagttcttatattccatatgatgaataaattttagaatcagtgatcgcctcttgtgaataaattaatgaaacccatttctactcttttcttccttagtttttgtcttttttgatctgactgtagatgatcagtcagtttatcctaaggcattaagagatgaatacatcatgtcaaaaactcttggaaggtaaattattttcttatataaatgcacttaattttttcactatacatttgtgattggtggtttctcatttctgattttataacactcattatgtattgataacatttgtatggtatctatttgtgtattattttttatttttatttttgtgtgttatttcacacagtcattttaatttatttttattttatttctttgtgagacagggtgttgctctgttacccaggctggagggtagtggcacgatcagagctcactgtggccttgatctcccaggtcaagggagatcaggcatgcagcaccatgcacaactaatgtgtgtttttgttttttagagttggggttgcgctgtgttgccagggctggtcttgaactcctgggctcaacccatcctcctgccttagcctcccaaagtgctgagattagtagcgtgagccaccatgcccagccaaatatttctttttttatttcctgtgtgtgtgtgtgtgtgtgtgtgtgtgtgtgtgtgtgttagtgtcagagtcttgctctgttgcacaggctggagtgcagtggtacgatcttgactcactgcaacctccacttccagggctcaagtgatcctcccaccttagcctcccaagtagctgggactatgggcttgaaccaccgtgcctggctaatttttgtattttgtgtagagatggggtattaccatgttgcccaggctggtcttgaactcctaagctcaagcaatccacccatctcggcctcccaaagtgctaggattacaggcatgagccactgtgcctggccatgtgtatagtatttcattgtgtatatatacaccacatttactttgtccgttcattcatttatggacactttggttgcttccctatcttggctattgtgaataatgctgaaatgaacatgggagtgcagatatctcttcaacatactgatttaaatttttttttggatatatatccagaagtgggattgctggatcatatggtaattacaattttagctttttggggaacctttatactattttccaaaatggctgtactaatttactttcccaccaacagtgtaccagggttctcttttcttcacatcctctccaacatttgttattattcatctttttgataatagccattctaacaggcttcaggtgatgtcattgtggttttaatttgcatttccttgatggctagagatactgagcatttttcatacatcatgataggtgcatttttgatgtgtttgaggtgaaattaactctttcgcctcacgaattttattggtgataacttttttttctttgagacggagtttcactctgtcactcagactgaggtgcagtggcgtgatcttggcccactgcaacctccgcctcccgggttcaagcgattcttctgcctcagcctcctgagtagctgggactacaggcttgcaccatcacagccggctaatttttactttattttatttttttgagatggagttttgttcttgttgcccaggcaatggtgtggtctcttgttgcccaggcaatggtgtgcaatggtgtggtctcagctcaatgcaacctctgcctcctgggttcaagtgattctcctgcctcagcctcccaggtagctgggattacaggtgcccgccaccacacacccagctaatttttttgtatttttagtagagatgaggtttcaccatgttggcctggctggtcttgaactcctgacctcaggtgatctgcctgcctcggcctcccagagtgctggattataggcgtgagccaccactcccggccctaatttttatttttttttttactgtagagatgagtcttgctgtattgcctaggcttgtctcgaactcctgggctcaagttatcctcctgcctcagcctctcaaaatgttgggattacaggtgtgaaccactgcattttgccaagacatttttatattaattcattaggtaaatttactacatgttaagatgagttacatttatttttttcttcttgagatggagtctcgctctgtcacccaggctggagtgcagtggcacgatctcagctcacttcaacctctgcctcccgggttcaagcaattcttctgactcagtcacccaagtagctgggactacaggcctgtgccaccacacccagctaattttttgtatttttaatagagatggggttttactgtgttagccaggatggtctcgatctcctgacctcatgatccgcctgcctcggtcccccaaagtgctgggattataggcatgagccaccgcgcctggcctgagtaacattttttataaaaaataattattaaaaagattagtgagaagagaggcactgttcaacatttttgcaaaatttttttaacatctggcttagttagaagatggctagattctgtaatttgtttcgtcattcagtctgttatgttgtcacacgccacgtagtgtctggaaatctccatacttatgagctaatgagaatggaaaacacaaataatgtcttagtattattctgagcatagttgtggctttgtggatgccctgcaaggtcttggggtccttttggggtgatccaatcatactttgagaaccatttctttaggaaagtatcaggatactgttaccacattacaaaatgttcttcatcccccttcctgtctcacaaaggtctttctactgatatttttggaaacatggaaggaaagtacataaaaggaaataatcatccatattcctgcaacatagttaagcacagtatcctctgtattatatgggagaaattttagtttactgatactgaattcagtaactgatgtgtttccatatttgcactggttgcttggaatctaaccgtcaaaccctttcttaagaaatgtatgggctgggcacggtggctcacacctgtaatcctagcactttgggaggctgaggcgggtggatcacctgaggttgggggtttgagaccagcctggccaacatggtgaaaccctgtctctactaaaaatataaaaattagccaggtgtggtgacgcatgcctgtaatcccagctacttgggaggctgaggcaggagaatagcttgaacccaggaggcggaggttgtagtgagctgagatcacgccactgcactccacccttggcaacagagtgagactctgtctcaaaaaaaaaaaaaaagagaaaaaagaaaaaagaaatgtatgaggctgggtatggtggctcatgcctgtaaccccagcactttgggaagctaaggcaggtgtatcacttgagtccaggagttcaagaccagcctgggcagctgggcaatagagaaatcctgtctctagaaaaaatagaaaaagttagctgagcgttgcggtctgcacctgtagtcccagctacttggaaggtggaggtgggaggattacctgagcccaggaggtggaggctgcagtgagccatcatcatgccactgcattccagcctgggcgatagagtgagacaatgtctcgggaggaaaaaaaaaaaaaagaagaagaaatgtatggaattcaatgttttcctaagggaagatttaatatgaattctctaacttgtagcaaatgatagaaactcaactcaaatgagtcaggtaagagaaaaaatttactggcttttgtaactgggaaatagccaggccgggcatagtggctaacgcctgtaatccgggtactttgggaggccgaggctggtggatcacttgaggtcaggagtttgagaccagccgggctgacacagtaaaaccctgtctctactaaaaatataaacattaactgggtgtggtggcatatgtctgtagtcccagctacttgggaggttgaggcaagagaatcgattgaacccaggaggcggaggttgcagtgagccaagatggcatcactgcactccagcctgggtgacagagcaagaccctgtctcaaaaaaataaaatattaaaataaataaataaataaataaaaataaaaataagcaggcaaatccttacttcaggcatggctggatctaggaggtcattaggctttacttcatggtctttgagttctgatggtctggttgactgcgtctaagagctcctgcagtgtcaccagggctctagctccatctcttgattcagctgtttgttggcttcctatagaattgttctctctatgtggtaggaaaaatggctaccaggggctgcagaatgatattttctttgtctagaaactacaacagagagaagtctgtctcccaatgtcagcatttgatttcaagggcaactctggctgtaggtatgaatgaatgacagggtgttgctctgtgtctcaggctggagtgcggtggcatgatcatggctcactgctccagctcagttttggttatgtagctatcctgtgtttctaggagtaggggttgtgccatagtagacacccagctagagctgcacggacttggggaggaattcccaggcaaagggtgactgtttccaggagaagggaaattggaaagtgctttgagctgattttaaaaagaatagttacatggacccttacctcataccatacataagaattaattcaaagtggaaccaagaatgaaatataagaggtaaaactatacaactctgggaggaaagcatagggacagctcttcatgaccttgtatttggcagtggtttcttacataagacaccaaaagcacagcaacaaaagaaaaaatagataaattagacttaatcaaaattaaaaacttttgtgcctcaaaagatacctatcaataagtgaaaacaaaaccaacagaatgattaaatatttgcaagccctatatctgataagggcttatgtctagaatagataaagacatcttagaactgtacaataaaaaaacaaacaacctgccatttaaaaatgggcaaaggcactgcactgcagcctgggcgacagagtgagatcctgtctctaaaaacaaaacaaaacaaatgggcaaagggcttgaatagacatttccctcaagaacacatacaatggccaaaaagcacatcaaaagatgctgaatatcattagtcattagggcaatacaaatcaaaaccacaatgagataccacttcacacctacctactaggctgaccataataaggaaacagaaactagtaactgttggtgaggatgtggagaaattggaacccccatgcactgctaacgggaatgtaaaatgatgtagccactgtggaaaatagtttggtgatttcttaaaaaggtaaacatctgagctctatggggcataaaaaacaacaacaacaaacaacaacagaaaaaggtaaacatagaattatcacgtgactcagaaattctccttctaggtatataaattccccaatttaaaaaacaagtgtccaggctgggcacggtggctcacgcctctaatcccagcactttgggaggctgaggtgggtagataacctgaggtcaggagttcgagaccagcctgcccaacatggtgaaaccccgtctctactaaaaatacaaaaattagttgggcgaggtggcacacacctgtaatcccagctattcaggaggctgaggcacgagaattgcttgaagccaggaggcagaggttgtagtgagccgagattgtgccactgcactccagcctgggtgacagatcgagcctatatctcaaaaaaaaagcaaacaagtgttcagacaaaaacttgtacatgtggccgagtgcggtggctcacgcctgtaatcccagcactttgggaggccgagatgggaggatcacgaggtcaggagatcaagaccatcctggctaacacagtgaaacccccctctactaaaaatacaaaaagattagccgggcgtggtggcgggtacctgtagtcccagctactcgggaggctgaggcagaatggcgtgaacccgggaggcggagcttgcggtgagccgagatcacgccactgcactccagcctgggcgactgagcgagactccatctcaaaaaaaaaaaaaaagaaaacttgtacataaatgttcatagcagctttagtcacaatgaagaagtataatttatctattgtttttcttttgttgcttatgcttttgttgtcatactgaagaaaccatttacaaaaggtggaaacaaaccaaataaatgtccgtcggaaggtgaatagataaactgtgatacttccatataatggaatattattcagctgtaaaaaggaatgaagtaccacaaatgttatggcattacgctaagtgaaagaatccagacacgaaaggctacatattgtatgattacatcaatatgaaatattcagaataggcaaatcaatatttagagaaagtagattagtggttgccaggggctgggggctgagtgctggggacagggtagagtgaggagtgactgcttaattgcttaacaggtacagggtttccatttgagctaatgagaaagttctggaattagatgctgatggttgtagaacattggcaaatgtacttaatgctactgaattgtacactttaaaatgattacagtggtaaattttgtgttatgtatatttaacacaataaaaaagatgtcttggtaagcccctcaactcaccccttcaaaacccacaatagttataatagtctacttcataatgggtaattgatgccctagtagccattatcttgggctgacccaagctttggaggacagatcctactcaggattaactgtgttctgggtaatggcttggagagcattcctcctccatgagtagtatcccatttaactgcaaatctctgtgagaggttgctgaaagtaggctgattgtgtaatacgtttggtttcttaggtaatctgatttgatttagggtgcaacttatgtcatcaactgcttatgcacttcctttgaagatggagaataagaaggaaagaaatttatccattaaagttattcatttgcagattctgtttaccgttatttgtttgttttgggcacttatttttgaccagggaggactgtttctagttaatgtttttctgacctctcggatacgtagtttctctctcatttttctcttagtatctttctgggaatttcacaatccagggctacagtaagacccatgtttgtattgctgggctcagaaatggaatttggagctgacttagtgtttttggctgttaagcccttgacattttacactggtgaagtttcactgtgtcctctgcaaacagggacaatggaaaggctgttatatggaatgtctgtaaattctaatacttgaagtggacccaggagtggtaggtctcataattaaaaacattcagacaatcactatctttgtttttccctctagtggtgcctgtggagaggtaaagctggctttcgagaggaaaacatgtaagaaagtagccataaagatcatcagcaaaaggaagtttgctattggttcagcaagagaggcagtaagtaccaataaaaggctgatcaccttttattaacacgtcttcataacttcccaaaataatcttagattgatgatttttaaactcaggaataaccccctgcttagatggatgaatttgtgagtatcaaagaacatggaaaattttggggcatctttgattaatctagaaacttttacttatagataatttggttccaaaagtatttaattgtacataataatgagcatagtgggaagtttttttttttcttcttccaagttcaaagtcgttacaagattgtttttacaataaatgacaggaaattagagaaaaaaattcagccataatccccactgtaaccccacagctgttttcagttttccttttccttctagattttgttcagatgaaatcgtgtttttagatggttgaaatcatcttgtatatacagttttgtattttgcttttccacaaatgcattatagcatagacttttgcctaatacatcctttttgatgactgagttttcatgtcatcaactttattgtaatttacttaaccatttctctggctgatcatttaggtaatttcttattctttgctgttctgggtaatatggcagtgagtatccctggtttatggattagccatagatttttaaaattttaattaaatcattgaaatagcctttctttatagcagccatttattttactactcttttgtaatcaacatttactgtatgggagagatggccaaatgcattggtctttccacatgtgactcaacaaagtaatgtaaaacacagcctctaatcacattttccctagtggccagctgtttctggctattatactttcacattctttaaagatcaattttttttccccctagacaatgccattctcacatggcaagaggaatttcctttttgtgttcactttgttatagatcttttcccctatgattctaagatttgtttcccattttggggagaagaaaataccaactagattgttaaaaactgggagtaaaattttacgttttgatttcattatttgaatcagattggacctttgtgaccatcctgttatcagagtataccctgacttggtaatgagtttagcggcttacaggaagaggcaggctcttaaaattaaacatctgggtttcttagctgaagttcattttacataaatatgtaattctatctcctctttgcttgtggagggtgtagcccaggaagctgagttacttgattcatccttttggaattgtaacagaacaactttagtaccctgaagcctcctcttgtcagagtctcagtaaatatgcgaggctgctgttgaagttggaacctgtatctgctctattagcagaaatttgacttcacattttctttatatagtttaattgaacaccttcttgttcatgttttttgtttatcattttaatgaataaaaatagttccatagctaataagtagggtttactaattaaaatgaacacagtggaaacacacttgtttctgactgtggagactagggcaagtggcttctgttttctgagccttggttgccccatctgtaagatggggattctgaggcttatgagacatgatctctgtaaataaagagcttggcacagggcctggccatttattgagtgcttactatttgccaagcattttacaaagttattttaggtgaggtatttaagtcattgacctgggctttgatttctttgtataagtagagctgggtttggaactcaggcagccttgagtcaactgagtttaactgtaaatgtttttttaaatattggcaattattattactaataaactctgttattctgtttatcaaaggacccagctctcaatgttgaaacagaaatagaaattttgaaaaagctaaatcatgtaagtattattatatgactcatacttagatttatctatctcaaaatatgagaagagtataaagcctttcagtataataaagataatattggccaggtgtggtggctgatgcctgtaaccctagcactttgggaggccgaggtgggtgaatcacctgaggtcaggagtttgagaccagcctggccaacatggtgaaaccctgtctactaaaaatacaaaaatttagctgggcatggtggcacatgcctgtaatcccaactacttgggaggctgaggcaggagaagtgcttgaacctgggaggcagagattgcagtgagccaagatcgcgccactgcactccagcctgggcgacagagtgagactgtctcagaaaaaaaaacaagaaaaattaaaagaataaataaagctaatattaacctgggttctttaacttatgtgtacattcacacacatgcctagctgtcatttagctgggaagagttttaccccaaaatgttactgagtgaacaataccgtataaagatttcatgattaaataaacaaatgatatttcttctgagttagttcttgaccaaaacatatagcaattattctatctcatagacacaactggttatattagagaagacagtgttaattttagtaaatttggtttagttatacctgaagttttaccacttttgaataccttttatttggagtaatccaaataaatccaagggtatccattaagtatgacaacatcctgtccttatatctgattaaatggtgtctgtggcctagttcttatctttttgtgcaatgatgactatgtctcaatgaaaaatgtgtctcacttttaaaaagtgagaagaaaaattagagggtgggcttaatcttatcttgcttttttttgtttttttcccgtttcttccttaattcataagtgcccatgaaggcataagctcattaggcaatggcattaaactcaaggcaagatctctctcctgtccagctaatgatgatcttattctggcattttttttgtttgtttttttttgttttttttttttgagacggaggctcgctctgtcacccaggctggagtacagtggcgcaatctcggctcactgcaagctccacctcccgggttcacgccattctcctgtctcagcctcccgagtagctgggcacaccaccacgcccggctaattttttgtatttttagtagagagggggtttcaccatgttagccaggatggtctctatctcctgacctcgtgatccccccacctcagcctcccaaagtgctgggattacaggcgtgagccaccgcgcctggccttattctggcttttaacctcgaaacagcaaaaaggtttcttctctctttttctacctctccaaatccctcaaaaaagtcagtagaaactgaggagcaattactgttgttgacacaatacttcagcaggttcctttagaactctgtgagtggacctgaaaacctatgagaacctgagtggctgaccttcctgcttggctttcttctgtttcttttgcaaattattcgtcctctctgaatttgccaggtcctttttccaagagatttggagtctctctttaacacacacacacacacacacacacacacacacacacacacacacacatatttttagagacagtctgtctctgttacccaggcttcagtgtagtggcacaatcatagctcactgcagcctcaaactcctgggaccaagcgatactcctgcctcagcctcctgagtagctgggactataggcatgtgccacaccataccctgctgggagagaggagccctccaattttctggggtggggttgcatcagacctacccttaagataaacacaaatgcggtgggcgcggtggctcacgcctgtaatcccagcactttgggaagccggggcgggtggatcatgaggtcaggagatcaagaccatcctggctaacacggtgaaatcccgtctctactaaaaatacaaaaaaaaattagccgggcgtggtggcgggtgcgtgtagtcccagctactggagaggctgaggcaggagaatggcgtgaacccgggaggcggagcttgcagtgagccgagattgtgccactgcactccagcctgggcaacagagcgagactccgtctcacaaaaaaaaaaaaaaaaaaaaaagataaacacaaatgctcagggaattttctctgatgtcagatgatcttcaaacataacatttgtacaaatccggtgtccagtgcaatagagaagaattcaaaaccctaaaaaagatttctagacatatttatttgcattttacaagggcacaagaaactcttgggaattaaacatgggcccatgagtgcattttgatgcttggggacaataagtagagtctagtggccaagagagcctgacctttggagtcagagattgatgtgattacttttcgaacacttgtcatgccagttgtcttgtggaccccggcagtggtaagcacagatattgctgtccttcccttccctcactttagtgtgactttagtgtggaggcagaactgggttcctgtctcagtactatcaaagcagctgagaagtcgtttgagaagttcattttatttattggagcccccgtttcctcagctgtacaatgaagacaataagaatacttatgtcacaaggtcagtgtgagaatttaatgagacgtactcctaaagctttcagtgcagacaacacacttggagagtgacagagatcgttaattccctgaactgctttcccagtatgacctaagtggaaggtgtgggttagtagcttctgattcctggtagagagacccttttagctgtgacagccccaggcagtgaccctggaggtagcggacactagaggaagtaattcacactggttctgactatcggacacctcttcatgctctgttagctccagaccccacccattttcagataggtactggcactgcccattatgaagccaaccagaaccaagcagttccctttttccttctctccgttccttttctatatgtgtcttttctttttgttctcctttatttgtttatttatttatgtatgagatggagtctccgtctgttgcccaggctggagtgcagtggcatgatctcggcttactgcaacctccgcctccagggttcaagtgattctgcctcagcctcctgactagctgggattacaggcgcccaccaccaggctcagctaatttttgtatttttagtagagatggggttttgccatgttggccaggctggtctcgaactcctgacctcaggtgatctgcctgccttggcctcccaaagtgctgggattacagacgtgagccactgctcctggctttattctcctttaaaaggtactttttacagccgtgcatggtggctcatgcctataatcccagcactttgggaagctgaggtgggaggattgcttgagcccagaaggttgagactgcagtgagccatgatcaccccattgcacttcagcctgggcagcagagtgagaccctgtctcaaaaacaaaagcaaaacaaaacaaaaaacacacaaaaaacctgaccacatgactcgagctacctgtttatgttttccccatcctacccagaggtaatgccattaccttgaatgctgtgtgtactgtccctttgtgtgtgtgtgtgtgtgtgtgtgtgtgtgtgagctggagtgttgctctgttgccaggctagagcacactggtgtgatctcggcttagtgcaacctctccctcccgggttcaggtggttctcctgcctcagcctcctgagcagctgggactacaggttcgtgctaccacactcagctaattcagataatttttgtatttttagtagagacagggtttcaccatgttggccagggtggtcttgatctcttgacctggtgatctgcccgcttcagcctcccaaagggctgggattacaggcgtgagccactgtgcctggcctgtcccttgctttagtttagtttagtttagtttagtttagtttagtttagtttttagtttagtttagtttagttttttgagacggagtttcactcttgttgcccaggctagagtgccatggcgcgatttaggctcactgcaaactctgcctcccgggttcaagcgattcccaggtacaagcgattctcctgtctcagcctcccaagtagctcggattacaggcatgcaccaccacgcccagctaatttttttgtatttagtagagacagggtttcaccatgttagtcaggctggtcacgaactcctgacctcaggtgatccacttgccttggcctcctaaagtgctgggattacaggcatgtgccactgcgcccggccccttgcttttttaaagccacatatatgtgtatccctaaataatatagttttactgcttgtttctgaatcttataaaaatgatacagattgagtgtcccttatccaaaacgcctgggaccagaggtttttgggtcttgaatctttttggattttggaacatttgcattgtacttcctggttgaatattccagatccaaaaatctgaaatccaaaatgctccaatgagtatttcctttgagtgttgtgtcagctctcaaaaagattttgggccgggtgcagtggctcacacctgtaatcccaacactttgggaggctgaggcgggtggatcacgaggtcaggagttcaagactggcccagccaagatggtgaaaccaagtctctactaaaaatacaaaaattagccgggtgcagtggcaggcactcataatcccaactactcgggaggctgaggcaggagaatggcgtgaacccgggaggcagagcttgcagtgagccgagatctcgccaccgcactccagcctgggtgacagcgcaagactccgtctcaaaaaaaaaaaaaaaaaagatttggattttgggagtattcagattttgtatttttgtatgtgggatgctcaacttgtatcatactctttgaagtcttttctgacttggctttttcattcagcattatgcttccaagacccatctatggtgggaaaactgggcattcattcattgctatataacaattcattgtgggaaggttccattggatgatcttaatcagagtgatgagtgatgaatatgatgaaatacacattatgggaagatcaatctggcaagttttaccactcttttgaatctaaaaccaaaaaatctgatgactcttttctttttaattctgatataactacagtcctccaatgtgctggggtgtgtgtccctgatgaatactcaccaaatcttttatttacccactgagcttaactgtcttctgacttctgtatcgtaaaaacaataggtgtgcccaccgggcgtggtggctcactgctgtaatcccaacactttgggaggctgaggtgggtggatcacttgaggccaggagttcaagacgaacctggccaacatggtgaaaccctctctctactaaaaatacaaaaattagctgggtgtggtggtgcacgcctgtagtcccagctactcaggaggctgaggcaggagaatagcttgaacccgggaggcggaggttgcagtgagctgagatcatgccactgcacttaagcctgagcgacaaagtgagactctgtctcaaaaaaagaaaatgagactgtctcaaaataaaaaaaaaagaaagaaaaattaaaaaaaaaataggtgtgctaagtatgaagtcatgatattgtataggcattttaaaatgtgcagtattctcttccttaccctcagtgttctccatgcaccctgcattgatcagtggtcatgaactatcagccataggtgtgtgtgtgtgtgtgtgtgtgtgtgtgtgtgtgtgtgtctgtctgtctctctctctgcccccgacccaagtgtgttttagagttcttataaaattagaattttcctcttcctttgaaaaatggtaggatcttgttccatggggtccaattgcctggaggttccagttgcccagagcttaaataacccttgtttggcagcatggctgggctcctacttgacagcttttattcatgctacttgtcagtctccctcagggttccttaggctgtccttgagtacctctgctctggggtagtgaggaagaagactgggaagagacctagccttcattcccaggtagcatccttgcatatgaaatatgaactagtctctcaccatcatggtggggtggaaaatttcttgcatgttctcactgaggagttggctagattctgtctgccttctcccctgattgaacttccaagcctctgaggcagggggccagatgcctgttcttggcctccctgtccctctgggcagatgttctaagctcttgtggttttcctcttgggagtttctcactactttcccttttttctccccctcttcttagccttgcatcatcaagattaaaaacttttttgatgcagaagattattatattgttttggaattgtaagtagtaaactttttaaaaatttctgtttccattcaaatgctttataaagccaccaaagaatctaatgtaggcttgcctttctcatcctggggggcctcaacgtatgtatgtagtagtggggcccacaaagtctgtgtatagggggttaatatcaacccaaaaaaccctccaatgtttccaaaaataggtggtatgggattccaggtcctggatctatgatcaggacttgaactccactctgcagttgactagctgaccacccatgggtcagtttaactcacttttctgagtctcatcttcatagtgttaaatggggattataatgaacccccacatgcagagtccttgtatgaattaaatgctatgagggatggaaatcccccagcagagcacctggcacatgtgtgtactcaccatggggcaatattgttataattggctcaccataactgtgggtttttacatccgtgtattcaaccaacctcagatcgaaaatacttagaaaaataaaatggatggttgtatctgtaccaaacatgaacaaacatttttcttgttattattttctaaacagtactgtagaaccactatttacataacatttacattgtattaggttttgtaagtattttagagattatttaaagtatccagggccaggtgcagtggcttacgcctgtaatcccagcactttgggaggccgaggtgggtggatcacctgaggtcaggagttcgagaccagcctggccaacatgatgaaaccccatctctactaaaaatacaaaaattagccgagtgtggtggcgcacacctgttacttcagctactcaggaggctgaagcaggagaatagcttgaacccgggaggcagaggttgcagtgagctgagattgtgccactgtactccagcctgggccacagagtgagactccatatcaaaaaattaaaaaaaaaaaaaaaaaaggccgggcgcagtggctcacatctgtaatcccagcacttagggaggccaaggcgggcggatcacaaggtcaggagatcgaggccatcctggctaacacggtgaaaccctgtctctactaaaaatacaaaaaattagctgggtgtggtggtgggctcctgtagtcccagctactcgggaggctgaggcaggagaatggcgtgaacccaggaggcggagcttgcaatgagctgagatcgcgccactgcattccagcctgggtgacagagcgagactccgtttcaaaaaaaattaaaaaaaaaaaaatagagaaagaaagtatacaggatacagcctgggcaatatggtgaaaccccatctgtacaaaacacacacacacacacacacacacacacacacagacacacacacacaaaattagccgggcatagtggcacgtgcctggaatccctgtgatttaggaggctgaggtgggaggatcacctgagcttgggaagtcaaggctgtaatgagctgagattgtgccactgcactccagcctggacaatgggagtgagactctgcctcaaaaaaaaaaaaaatagtatatgggatgatatacatagattatatgcaaatcttacgccattttatataaagggcttgagcataatggattttggtctctgagagagctcctggaaccaattccccatggatactgagggacagctctactctgaaatatctacctgggtaggactttctatgcgggtcctttcaatccaggaccaggttgcatggtggcacctgagtatctttcagtgtcttggtagtttatttcagtggcgataatgtcttgtgttatttggtgtaatcagaataacttcctgtctcatttctggaagatgcctgtcttgatatctgctcctgcataaatattaagtgtttctgggagcagctattgtggcaggcacagaatgctttgctcctggttggcaaatcgtatctatgcagggtgatcattaagactgtatagacaacaggctgggtgtggtggctcacacctgtaatcccaggactttgagaggctgaggtgggcggatcccttgaggccaggagttcaagaccagcctggccaacatggcaaaaccccgtctctactaaaaatacaaaaattagccaggcatggtggcatgtgcttgtagtcccagctccttgggtggctgaggcgtggagaatcgcttgaacctgggaggcggaggttgtagtgagccgtgatggacagagcaagactgtctcaaaaaacataagaaaaaagaaaaaagactatggtaaaaacacccctgatcacccctgatcacagcactgggagagcctggagccccttgtggatctgctgctatcaaataggagattgttacctgactgaatccagttaacacagttaataaaagtgataatacagagccgggcacggtggctcacgcctgtaatcccagcactttgagaggccgaggggagcagatcacctgaggtcaggagttcgagaccagcctgaccaacatggagaaaccgcatctctactaaaaatacaaaattagccgggcatgatggtgaatgcctgtaatcccagctacttgggaggctgaggcaggagaatcgcttgaacctgggaggtggaggttgcggtgagccaagattgcgccattgcattccagcctgggcaataagagcgaaactctgtctcaaaataaataaataaataaaggaataaccttgccaagcacctgtgccaggagcttttcctacatcagccatctcttaatttttataacaaccatcaaggtagatggtatcatccccattttttaagtggtagaaacaagctgagagaggttaaatagctttcccaaagtccaaaagctgggaaatggtagagttagggttcagatcctggttgtctgtttgtaaaattctgtttgctcttctacatcagtctcagaatcatctgtggtgtgtgataaaaatgcaaactcctgactgggtgcggtggcttatgcctgtaatcccagcacttttgggagggcaaagtgggcagatcacttgaggccaggaatttgagaccaacctggccaacatggcaaaaccttgtctctactaaaaaaaatacaacaattagccgggcatggtggtgcatacctgtaatcccagctacttgggaggctaaggcatgagaatcacttgaacctgggaagcggaggttgcagtgagccaagatcgcaccactgcactccaacctgggtgacagagcgaggctctgtctcaaaaaaaaaaaaaaaaaagcaactcctgggccccacttccaagctactgaattggattttttaaagttccccaggtgcctccaatgcccaatcctttcatctcattccttagtttccaactgggacatctgattgtgaataaaccttattagttttaaaaatgagagtcaaaagtgaataaaaatgtcaactgtttgcttgtcttaatgaatttgttttgttgttttattgtcttctgtccaagtgcgttttcccccaggaatgaaccccttgccttgcctttgtgtttcaggatggaagggggagagctgtttgacaaagtggtggggaataaacgcctgaaagaagctacctgcaagctctatttttaccagatgctcttggctgtgcaggtaaaagaagccctcaattcttttgacagctgcctttcttttagttgaattactccctgaattaggcagaaatcgagggaccgtggattaaaactcagaagagaatctgtgtgtttgctgttctcttcttggcaaaaatgtcctactcctttcactgagatgaaaaagctctcactggcgaggcgcggtggttcatgcccataatcccagcattttgggaggccaagcgggcggatcacgaggtcaagagatcaaaaccatcctgaccaacatagtgaaaccccatctctactaaaaatacaaaaattagctgggtgtagtgttgcgtgcctgtagtcccagctactcgggaggctgaggcaggagaatcacttgaactgggaggtggaggttgcagtgtgctgagatcatgccactgtgctccagcctggggacagagtgagactccatctcaaaaaaaaaaaaaaaaaaaaaagaaaaagctctcactgtgtagcttaagagaaagtaagaaagggaattaaagaaataaatagaccaggcatagtggctcacgcctgtagtcccagcactttgagaggccaaggcaggaggatcacttgagcccaagagtttaagaccagcctgggcaatataatgggacccccatctctacaaaaaataaaaatagccaggcatggtggcgggcacctgtggtcttagccactctggaggctgagttgggaggacggcttgagcctgggaggttgaggctacagtgagccacagtcatgccactgcgctccagtctaggcaacagaatgatgctctgtctttaaaaaaagagataacatggccctatgtcgcctatctttagcttggaggtatttctggaggggtcttgatcattagttctttagttctgcttgatccttgtagaagtctctcttaactcagagtgggagctgggcaggtttgagggcagagctgcaagttgtgatgattgtgacagatgggttggtcccccatggctcagaactaggtgtttcccttcaggtgcagcatcctgttcgctgcagtgggcgggccggcagggaatgcacatagccatctctattcagtaggtgttagatgaaagaatagctggtggcacttgctttgaggaacatcaccatttcccagaccaaatgtggttgtggccattcccttccagtctcttcttgaaaacccactccttgcaggaaatgcagtgattgggagcaatccttgtacagagtgaggatcgagagaaatttttttatgattgatctacctaggtttgccctccctggaggtttcaccagatccatttcccagtaaagattttgcaaaaaatttttgttctaacccagagggacatccagagaagattgaagcccataaacacaagccttttaaatttatttttatttgtttattttttttgagatgatgtctcactgtgtcgcccaggctggagtccaatggcacgatctcggctcactacaacctccacctcgggttcaagtgattctcctgcctcagcctacccagtagctgggattacaggtgcctgccaccatgtccagctaatttttttttttttttttttagtaaagatagggtttcaccatgttggccaggctgttctgaaactcctgacctcaaactatccgcctgccttgagctcccaaagtgctaggattacaggcatgagccaccgtgcccgcccacaagcctttttaaaaaaaaaatttaattttaattttaatttttgtgggcacatagtaggtgtacatgtttatggggtacaacgcaagccctttttaatggtagctgtcacctactcagtgtattgctcccttattggtttattccatttatttatattgagtaaccaagaatattaacatgaattgagtacagtttgtggatatgtgaaaattttgtttcctaaaaaaatatggccaggcagggtggctgatgcctgtaatcccagcactttgggaggctgaggtgggaaggtcactttagcccaagagttccagaccagcttgggcaacattgtgagatcccgtctctacaaaaaaataaagaagttagctggttgaagtggcatgctttgtgcctatggtcctagctactcatgaggctgaggtgggaggatcacttgagctgaggaggttgaggctgtagtgagctaagatggtgccactgcacttcagcctgggggacagagtgagaccttgtttcaagaaaaaaaaaaaagagaaaagaaaagaaaagaaatatggcatagtatgttggtgtttgttcatttttatatgctatttcagacaatagttttttcaaagacaaagtctttgcattgaggaataggttaactcacataaacagatatatatttgtatcacataaatagatatttacaaatatatatttgtataggttccctttaaaaatattctcaggactgcaataaccaaatatatcattttggtggaatttttgtgtttatttggtatgttctcaaaacattttctgttacccatttgaatttttattgaaattgacaccttacatttctgccgtgtgaagagttgtttattatcttaaagtgaaatgaaaggttaattgttctaagttgcttttttcatttccctgctttttaaagatcttctcaaacaaatttgtaaactttaccccaacagttttctatgattttggagaatatggttgtgtgtatcacggcttacggtttcacccagctgtgagatgtgtgtgttggtaactttgattctacttaagtatctactgcatgaatctgagggtcatgcctgcctttctgtgtagtaccttcatgaaaacggtattatacaccgtgacttaaagccagagaatgttttactgtcatctcaagaagaggactgtcttataaaggtaagaaattggcattctgtatgtggctattcctgtagattcttgttcagaaacttttaattcctcaaataaaaagtgggagcgtaaaaaggatgagaatctgaccctttcactgttaccaattattttagagatcaggtgatactgctcttatccagattcgaatgagcatttattgagctctgttgtgtacaagtgacctttgtgcttagagagagaggaggggtctaaatggacgagtgggctgggcatggtggctcacacctgtaatcccagcactttgggaggccgaggtgggcagatcacctgaggtcaggagtttgagaccaacctggccaacatggcaaaaaatacaaaaatttagctgggcatggtggtgggtgtctgtaatcccagctacttgggaggctgagacacgagaatcacttgaacctgggaggcagaagttgcagtgagctgagatcgcaccactgcactccagcctgtgcaaaagggccagacatcatctcagaataggtgaatgaatgaatgagtaatcacatgcgctgcctttccctgtttctcaagtctggcatcactttagaatctcttgttaggatttatgacacccaggctttacctcagaagctgagagtggcactcaggtataagcatgtgtttccaagctccccaggtattccatagcgcagccaagtttgagacactggggtctaagaaccatgtagaactaattagaatcctgaagtgtctgtgataaagataataagctttttgtaagattacagaggacataggttaagttggaaagcctgagtgttgagattcctaggctcaggaattttaatttaaccaaagttaaatgtcttaacttgcaaagacatgaatctgtaaattccagattaatggcaggtgtgaattgtacaatagaaactgatctagcctacatgtcttcttggactggcagactatgttaatctttttattttatgacaagttcaacattattcccttttgtactgaattttagattactgattttgggcactccaagattttgggagagacctctctcatgagaactttatgtggaacccccacctgcttggctcctgaagttcttgtttctgttgggactgctgggtataaccgtgctgtggactgctggagtttaggagttattctttttatctggtaagaaatattttcattgcttcacagactggtaggaggtgattagatgaagtcacaaatgtgtcttgctctgttgtccaggctggcatgcagtggcttgatcttggctaactgtagcctctgcctcctgggtcaagtgatcctcccacctcagcctcccgagtagctgggactacatgcgcacaccaccatgcccagctaatttttctattttttgtagtgatggggttttgccatgttgcccaggctggtctcgaactcctgggctcaagtgatcctcctgcctcggcctcccaaagtgctgggattacaagcctaaggcattgtgcccagcctagctcactttttgaccattgatttaaagaaaaatctgacttttcattatgctgaaaaagaaatctttatatctgaatgccactgagaatgccacttgatttcttttcctttctctctctaccaatattaagccttagtgggtatccacctttctctgagcataggactcaagtgtcactgaaggatcagatcaccagtggaaaatacaacttcattcctgaagtctgggcagaagtctcagagaaaggtatgaatatgaaagggttaagaatttgtggtatgctaaaatgtgtatgtgctgtggtgggagtttcttcccaaattccatggtgttttctcctgtcaattctgttcttattttctattgttagtttcacaccatttgagaggcactggaaattattaagagcatgcactcaggtcctgggtctgctactacttagctgtgtggccttaggcaagttatttaacctccatctccaatttctttctgtgtaaagggaccctcaataatccctaccttaaaaggttttttgagggttaggtataatgtacacaagtgcctggtacctattttagtgagcaaaataaatgcacttgtaactttttagttacaaggtttcctttgagtaagcaagcgtgtaaaaactagatgtctttagttaccttgtattttataatttatcctggcaactttagttccctgaagagaaagtagaaaattaaatgtcaaataacataacataggtgattgtgttaaatgtcagaatatttaaggaataataatgttgtaatatacaggccagcgtgcatttgttgcttgctggagtagtcaagttttatttctgacaagtctgcagttccagggagcctctccctggctgagtaactgtcacccatccatctgtagatgtcagggagagtttgctgtgcatcccaattatcttagaattgggtagaagtttagctttaattagtttgaccttgagtctagcaacaagagagggaacaggcagcgaagaggtcgtgactgatgtcccagcagcaggagacagggagtgtcattatcattcctggtcttctcacagtactctgaatacagagagtgaggaagattagggggccctgtctgctgactccctgatgatctcagaccctctctgctctttctggatggtggcctgttaattctggcatactgttactgataatatatttatccttttcactgtgatttgcccaattgttgctttagctctggaccttgtcaagaagttgttggtagtggatccaaaggcacgttttacgacagaagaagccttaagacaccgtggcttcaggtgggtgtgggacagtgcctgctagcataaaatacatgggaagccctgctgcctgagagacatgagacagaggacagaaacatgtttactttgttgaatgtttaatctaattgttttagatgtatggggggtatcttggaggatgggttacaacctgttttttttttttttttgagacaggttctcattctgtcaccctggctggagtgcagtggcacaatctcagctcactgcaacctctgccccctgggttcaagtgattctcctgcctcagcctcccaagtagctgggattaaaggtgcatgctaccacgcccagctactttttgtattttttgtagagatggggtttcgccgtgttggccaggctacaacctttttgatattactcatggctgttggatgtacaagctcactttatgtcctgttctggttccacttggctgccccgagtctccagtttggcctgtgttcttttgagggcttgttctggctctactcccagccatgtccactgctcttcataggtggggtgcattctagccatcttcaaccttaaatcagggaagtgggggagggggaggagggcagcctccctggggagaatccagctatttctcaagcccaagtgactgggtataaagggtcccactgcttgttcattcaggtgagtaaatgtgtccttagtgaaggctgtcacctgcacctttcatctgtgttactgctgtgctcctgctaggggttggggctgccattattaaatgctgacctcatttggaactgccaagagttggaagtacgttgtggctttgctgggttaatctttagttttggaattagctacggcattgggcaggtttttctgatagatgtctggtcttctgtaatgagcagttccattcagcacagccatgcccctttctattaattttcttttggtctgtgtattagtctgttctcacactgctataaagaactgcccaagactgggtaatttataaagaaaagaggtttaactgactcacagctccacatggctggggaggcctcaggaaacttataatcatggtggaaggggaagaaggcatgtcttaatggcagcaggtgagagagcttgtgaaggaagtgaagggcgaagatcctcttatgaaactgtcagatctggtgagaactcactcactatcacgagaatagcctgggggaaactgcccccatgagccaatcacctctcaacaggtccctttctcaacacctggggattacaatttgagatgagatttgggtagggacacaaagccaaactgtatcaatccgttttctgtggagatgggggacagaactggtagcttgagctagaggctgttacttgagctaaatgctgtttctctggggattactggtccaggaactccttgggcagtccagcctccgacccgtacttctgggactctgggaagactgtccctgttctctgttccaatcctctacacctaacagttttgctcaggccagctcaggttgagaacaacaaaaacttaaaacaaacaaacaaacaaacaaaaaaagacatatatgtgtttggatgttgccctggaaactacagtctccccagaagaaatctgtcagatgatttagcatttaatagaccacacagatttgaaacagtgggaccctggaggaaaggggtttggaaacaaagggtgcctttgcatgtggggattttaattttgatgaaaaagagaaacatgtcttttggctcttttcatgtgtcctaatagggaaactcttgggtctaaatgtagaggtacaggagctgtgttcatctctaacaaaaaatagagctggccagttgagcctgggaacagggtttgcatctgcctgaaatttatgagcaagcatagcctatctttcttgtacttttttgtgtcaaagaaaacttattaacaaccaaggagaaggtgaagttcaactctgttgcaggatctccctggaatactcttttagccaccttttgtttttgcagtgaaaggaggaatgagcattgaatgaagacaaggatgaagactgaccatctaaaacatctgttagtgatagtttgggttttattttgggaaaattcagtgtttttgcaaaaaccaaatggttttgtgggtctggcgctggactgagtgttgggaatgtggattctggtctctgttttgtcattaacagagtgcccagttttgggagcatcccttacatctactctctgcctcatatttactgcctgaaatagaggatttcttctgtttgctttcaagggatattataatttaatttttattttatttattgttggagacaaggtcttcttctgttgcctaaactggagtgcactggtgcaattatagctcactgcagcctcgacctcctggccttaagggatcctcccgcctcagcctcacaaagtgcttggataataggcacgagccactgttcctggctaatttaatattttggaataattgtagacatcatgaagaaaatcaatgtttatttatttatttccttttttgagatggagtcttgcttttgtctaccaggctggagtgcaatggtgtgatctcagctcactgcaacctccacctctgggttcaagtgattctcctgcatcagcctcccaagtggctgggattacaggtgcctgccaccatgcccagctcatttttgtatttttagtagagatggggtttcaccatgttggtcagactagtctcgaactcctgacctcaggtgatccacccaccttggcctcccaaagtgctgggattccaggcatgagccactgtgcctgacctgattacttgttttaaatataggcctgattaggcttgtgaccactctgtttggcttcactgaagggctgccaagagatggacttttgagagtgacactgcaagataattgagatcctaagtaaggccgtgagagggtgcggagaggaatccagatgagcttgctgctgtcaaatggcaatggggagctacactgagaaactcaaaacagagtgacctcaagtgatctgccctgccttggcctcccaaagtgctgggattacaggcgtgagccactgtgcctggtccttctttccttctttctttcttcctcctttccttccccctcccctctcctccattcctttcccctcccttctttcgtcccccctcccctttttccttccttgcttctttcctttcttccttcctcagggtcttgctctctcacctaggctggagtgcagtggcatgatcactgcaccatgactttcaggctcaagtgatcctcctgccccagcctcccaagtagctgagactacaggtgcatgccaccatgtctggctaatttaaattttttttttttttttttttggagacagtgttgtactcttttgcccaggctggagtgcagtggtgtgatcctggcttactgcaacctccgcctcttgagttcaagcgattctcctgcctcagcctcctgagtagctgggattacaggcgtgcactaccatgccctgcttattttgtatttttagtagagaaggggtttcaccatgttagccaggctgatctcaaacttccgacctcaggcgattcgcctgccttggcctcccaaagtgctgggattacaggcgtgagcctccgtgcctggcctaatttttaattttttttgtagtgacgaagtcccactatgttgcccaggctggtctcaaattcctggcctcaagcaattctcccaccttggcctcccaaagtgctgggattataggcatgagccaccatgcccaacctagtgttgtaaaatttccatatccatcaaattgccaaatggtggaggactttactgtatcctctccctttccccactgtggtatgcttggctcagtgggaggaggggctggagttgggtgggaaagtacatgaggcactggaatcagataactctgggtctgtattctgcacatgccacctgtgagtggctgagctgggcttctggccagcactcaaaggccacattcctagttatggatgttcctttcaccttgctgaagatggggagagctgcaccagaccacctctcagggtttcctaatgcaaatcctcgaaccctgcagaagtgagcatccagagaggtgggagctactcgcatacacactgtctgtgccctcctcatctcctgctcctgcagcatgaaacccctcacctcccgctcctgcagcagaaacaaaatacttggttctgtttattgtctccctttctcattagacctgagctctgggatactgtgggcttaagtacttctgaaaatttgtatggcatctgctgggtgaattttcctagggtgctgggctggttgttaggacagtctgggtgactggcctcattcatggcaggggcagcaggtggagagtggtccgggaaggatttgaggagctgcacggagtcaggcccagcctctggcctcctgattgccacctttctcaggatcttggatactaattaagaaactcttgactgctggaggctgtgattgacccactgagagcttttaggcatgtggatgtgagtcagccaggattgatggagcattgactgctaattagactcctctgggaaggtagaggcgggcaacacataatgccttcgctgtgggagcttcatcaaggggatgattcttggacggacatcttttcctccctctttccacaggggcatgctagccctgtcattctaggagtttattatccttcagacacagctacttatgtttttaattccctcacaggatgaagacatgaagagaaagtttcaagatcttctgtctgaggaaaatgaatccacagctctatcccaggttctagcccaggtattcgtattcctgatgatcactaaatgtagtctgggcttaaggagctgataagcaaagatgatgaaattcaagattttcctgagtagcaattgcttaacattgtttcagttataatgtagtagaaactctgtttgaacttgattcactccagcacccttagatttaaaaatgcaggatatgtttaatatctaacacataatagacagataagcacagctagggattgtcatccaaaaggtcacctgcaaggcaatttcgaaagactctattagaggctcaaatataaatttgttggaaaaattaaaatttgggtcagtagttgattccttgattacaattttattctttaaagttctttgtgagtataagttaattccagtcctgcttttttgttgttgttgttgttgaatggtagctgtcctttttcccactgtttcctccccccccgattttttttttcttgagacagagtcttagtctgtcactcaggccagagtgcagtggtgcaatctcagctcactgcaacctctgcctcctgggttcaagcagttctcctgcctcagtctcccgagtatctgggactacaggtgtccgccactgtgcccagctaatttttgtatttttaggtgagatggggttttgccatgttggtcaggcttgtctcgaacttttgacctgaagcgacctgcccacctcggcttcccaaagtgctgggattacaggtgtgagtcaccacacccagccttcctcccaattttatatatgggaaaacaactaaggcacaaaggttgtcttcccgcaaaagaccaagacttggggcttcaactgagaggtattatagtccttttaaacttgatatttagaagaggacgatcaagaggaagttggttatgctacttgctttcagtatacatcgttcagaggtcagaagccataagggagagaaatatctattagataagcatgtctgagttgggggctgtggtgaggactcagttgtcaatgatgacaaccagtaatttttggttctagaatttcacatcaaatgcccccactttactggaagcatattgaggaactttgataatcttaaagaagccagtgattttcttttgaacatttctccattttcctttattttcagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgggctttgtgcttctgcttgataatcggttctttagttgaatggctttattatttatttatttgagatggagtctcactctgttgcccagcctgaatgaagtgcagtggtgcaggcttggctcactgcaacctctgcttcccaggttcaagcgattcttgtgcctcagcctcctgagtagctgggattacaggtatgcaccaccatgcctgttaatttttatatattttgtagagacagggttttgccatgttggccagcctggtcttgaacttctgacctcaggtgatctgtctgcctcagtctcttaaagtgctgggattacacgcatgagccactgagcctagcctgaatggcttttttatatttaaagttgtgtgcctttcatctggagctacaccttggctatcactaggcaggtttcccaggatgtcaccctggtctcagcctgtgagagctgaatacaaattctaagggccccttggaaagttccagggaaaggagcatagcgaggttgggggtggagtttgtagagactggctggctggctgctgacatcttcatgagaacagcaggtaccttggtgcataataacaggccaggttatattctcatccttgccctcataaagatacaggtctacagtctctgaaacctttgggctagataagttgtgaaatttaattacccaattttaggaaggtggtaaggcatatctactatgtgtatgtgtagcaccccagtggagtcctacacatgtggagtcctaccccagtggagaccaaacatgttaatatttccacagcaaatattcacagtaagagggatagagaaagattataggtagttgcatattgattcatatcagtcttttcttccaaatgagctacaatgactcgtttttgagagctgtttgggttttggaagtggagataaggcatggttatgtcttgttgacccaataatgaccagggaggccctgtgcaaagacttacccttggctgctcttgtcctcacagtgattctatgagtgaggtcctctagccactgtcatgtcacaggtgaggaaaccaaagttagaggacgaaggtaacttttctgatgtcgcacagctggtaaatggcagagctgggacccaacccaggtctttttgactctaaaactaatgttccttattgtccactgaatctgcttttataactttgcttggttgatgctaggacactttgtagctcgctggccatgccatgaattgagtgccatggttcaaaggccactggcgattcagtcagggcagggtcaagggcacacagccatttccttaggaaatgggggtggtggttggaaatttctattaaagggtatataagcattttgagacttggctggcctggtgtagggggtttgatgggaatttaggtagtttgcatgtttaaaggaatgaggctgagattgccaattagatgggttttagctcatttgaatatttaatgtggaggctgtggtttcctgggacatttttcccactgtggagagttagccagcttttctctgtttcttttttttttttttcttttttcttttttttattaaattgagatgaagtctcatgcttgtcgcccaggctggagtgcaatggtgtgatctcggctcactgtaacctccgcctcctgggttcaagtgattctcctgcctcagcctcccgagtagctgggattacaggcacctgccaccatgcccagctaatttttgtatttttagtagagatggggtttcaccatgttggtcaggctggtcttgaacccctgacctcaggcaatccacccgcctccctcccaaaatgctgggattagaggcatgagctactgtgcctggctgcctttctctgtttctagagcattttgtattaactccctctcatgatatcttccatggtaggctgaataatggcccctccaaa

SEQ ID NO: 16660 - DNA, 9622 bp, Human
ttctcccaaaacatttcagaggcccggagtaagtctccccacatctgaaggcacatcagaacccaggtggcccaagctgatgagagttaaacaggaagttggtttcttggtccggcagagactccaatcacccccacctcttttccaacccacaggacagcacgtgctcaggaggctctggagttgggacagcccagttaaaaaaaaaaaaatcattgatttccctcccaacgaagagggagaaaacacgttaggagactcgtggcccagtcctggcaaaaaccaaaactatgtccctttagagggcttagatatcaagagatggacttgcttttagttctttttcccatcctgttccctccctaccaaaataaaattgaccagctaatccgacttaataacactaaagaattacttaggaacctgctatcttaacatttcactttttgcatatcctccaaataccaggtagcagtcttactactgtttgcacccctagaacctggaatagtgctgcccgcagaggaggaagcaataattacttgttagagaaggtattgctgtgcatttctggggaatttcacattttgtaatttgctttaaaaaaagtggacaggcatatttacgggggtttctcggacttctccatgttaatattcgtgtgtataaatcgctcccgtgctgctctctgggggcccctctttcacaaacacctggccaccctcacgccacaatggccaggcaggaacctcgacctcccctcggagagggggctcagggtcaaccccggggtctcagtctctacatgtgacgttttcctgtcccctcatttaaaataacaagaggctgggcgcagtggcttacgcctgtaatcccagcactttgggaggccgaggcgggcgatcacgaggtcaggagatggagaccatcctggccaacacggtgaaaccccgcctctactaaactacaaaaaattagccgggtgtggtggcgggcgcctgtagtcccagctactcgggaggctgaggcaggagaattgcttgaacccggaggcgaaggttgcagtgagctgagatctcgccactgcactccagcctggtgacagagcctgactccgtctcaaaaaataagaaaaaaaaataaaataaaaataatagaggccgaagcgggaggttcacttgagctcagaagttcgagatcagcctgggcaacacagtgagacctcgtttctatttaaaaaataaaataaaactaaatttaaaaaaatgcacgctcatagtacaaactttagaaatggaacgaaaaactaaaattgaaggtattcccctccaacccagagataacacctatcgtttattaagccctcactattgttaaacttagttttaaagggcacgatctcatttcttaaagacttctattccgcagaatttctttccaggcttttttctttttctttttttgagacggagtctcgctctgtcgcccaggccggggtgcagtggcgcgatctcggctcactgaaacctctgtccagtcttttcgaacccaaggcccaactgcgctctatctcgactttcggctccactcggatcccgaagtggcgcacgagataaaatgttgtcaggctgaggtaattctctgttagtcccggtaaaaattcgtcagtctggaaagctctcggtttggaattaaattctgtcactccggatggaaataagtccgcttaaggggggaaaatccgtttgtggaggacacgctcccgcacgtaaccccccgcggaaaatgaccccaagtacctttggccagggattgccgctgccacgccggactccatagccacggtcctgaaacgccccgccgggcaggccggaccaatggacgccgagctcggccgtgcgtcacgcgacgctggccaatcgcggagggccacgaccgtagaaaggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggtgggcgaggggccggggtctggggccagatctgaagccgggactagggacaggggcaggggcaggggctgggagcggggacccagcactggccgccccgcagggctccgtcgcctttggcctggcgggtcggtgccagcgtggcgcggggcggggcaggaagcccggactgaccggatccgccacgctgggaacctagggcggcccagggctcttttctgtactttttaactctctcgttagagatgaccagagctggggatgcgggcacctgtcttccaggccctcttgctgtgtggccgcagactggtggttcagcctcttaactcggacatgaggtcgaataatctgttttggtttactgctatttctggagaggcgcggagctgaaataacagagctgttgaaagggctgggaattctgcgaggctcactggtctagctcagtatctgcgttcttaaaatggaacctacttcatgaggtctttggggagattgagacttggatataatgtgcctagcacttagtcctccgtaaatgttcactcttttgtgatcattgtgccttctgtgatttatgaagtgtctcttctgagttaattcttttaaaaaaaaaagtgtctcctccaacagacacggacccatcagcaggtcactgcctaggatctcaacactagagatcagggagtggcatcagcctctcccttttctaaattggactgggggacggagggttgatgtcatagcaagattgcagccttcactagattaatgaggccaggttggatcctgtttaagagaactggagacaggaagcagcgggggaatagatggggaaagaggaaagttccttatgatgcaagatgaatagtgtgtgtgtccagccccagtgctgtgacggggatgagtctgaggtggacggatgatgcaatataggagagaataaagcaggtcttcgagctagattgacagaagactgtattttttattttgttttattgaggggaggagcctgaagtgtattttatcattagtctgtcttatactgtaaataaaaatgaaagcaccagctggtaaagttttcaaataaagacataaataaggtttgatatgactcagtgtggtatgttccttctcttcctaggaaactgaaaaacagagtagcagctcagactgccagagatcgaaagaaggctcgaatgagtgagctggaacagcaagtggtagatttagaagaagaggtaaaactacttaaggtcaaactcttttatccattgtatacccttccttggtgaatgttctgatatttgcttcccatcccaagttgtttcagcccctattagaatacaattgaatatatgattaaaagttaaactaggctgggcatggtggctcatgcctgtaatcccagcactttgggagcctgagttgggcagatcacttgaagccagcagtttgagaccagcctagccaacatggtaaaatcccgtctctacccaaaaatataccaaaaaaaaaaaaaaaaaaaaggccaagcgtgagtgcctgtagtcccagctactcgggaggttgaggtgggaggattgtttgaacctgggagagggaggttgcagtgagctgagatcgcaccactgcactccagcctgggcaacagagtgagactctgtctcaagaaaaaaaaaaaaagtttgctgggcaccggggctcacacctgtaatcccagcactttgggaggccaaggtgggtagataacttgagatcaggagttcgagaccagcctgaccaacgtggtgaaaccccatctctattaaaaatacaaaaattagccgggtgtcgtggcaggcacctgtaatcccagctgctccggaggctgacgcaggagaatcacttgaacccaggaggcggaggttgcagtgagctgagatcacgagatcatgccactgcactccagtctgggcgacagagcaaaaaccctgtctcaaaaaaaaaaaaaaagttaatctaagttaggacagagagttggtgaagtggtgaagcttgttgagggcagaagtgattgactttgtggcatttggtgctagatgtatctcaaagtagatggatttaacaatgtttattgagtttgtagtaagaaattagcaagggctaataggaaataattgcttaaactttacattcttcctggcatggccagaaattcactaaaggttcctttccccctctagggtccacctgttaatcaatcttaaattgttgccaattacacatcttgaatacatagagattatttatattgtttttttaaccccttggtcaatttgcatatattgagctttttaaagttttaatcattagttggttcttctaagaatcatgagtcaggagcagggattttttttaacttattttggatttatagtcaccactaccacttttattattacctgccagttcaagatagttatttatttttattttatattattattattattattatcatcatcattattttgagatggagtctcactctgttgcccaggctggagtgcagtggtgcaatctcggctcactgcaacctctgcctcccaggttcaagcaattctccctgcttcagcctccagattagctgggattacaggcacccgtcaccacatccagctaatttttggattttttagtagagatgggggtttgccatgttggccaggctggttttgaactcttgacctcaggtgatccacctgccttggcctcccaaagtgttaggattacaagtgtgagccaccgagcctggccaagatagtttaaaaaaaaaattatatctacattaaagccacaagtcaccctttgctgaagtcagtattagtagttggaagcagtgtgttattcttgaccccatgaagtggcacttattaagtagcttgcttttccataattatggcctagctttttaaaacctactatgaacaccacaagcatagagttttccaaaagttcaagaaggaaaggaaaccaattatactgaatcaggtagattcttaactgaaataattagatgttttaatagcctcttatgaactttcttccagaaccaaaaacttttgctagaaaatcagcttttacgagagaaaactcatggccttgtagttgagaaccaggagttaagacagcgcttggggatggatgccctggttgctgaagaggaggcggaagccaaggtaaatcatctcctttatttggtgcctcatgtgagtactggttccaagtgacatgacccagcgattatgtttacagtctggacttctgatcaagagcgttcttgaaattttccttcagttttaagacattttcatgcaggcagagtgttcttcccctaaaggcacttgacactcattttttaagtgtgtagtgaacagtactaagatctaataatgaaaacaagttacatggctccctaagaacaagtactaacaaatgcagtagccaacaagattaccatgcaatcattaaggagaaccaaagtaagagagccactcaaaccagattttgaacgctactaaaattaaagtagttctttgatgaatatgaatgagtagggaaaggattctttgtaatagtgatacctctgtggtaagagaagggtggtatgtgagttttagtctacagattatggcaaattcagtgacaacaatcaaatggtctaagattgacagtagcacagttttactctgtgaaggtaatgttcaggacaaatttcaagaaaactagaaaaccattctttacagctgaaatctttccctaaccattgttatttccacttttaagtcctcaagagatgagaaaagggaggtaaggcttccttatacatttcctgcacaatgaaacatttttcctcctccaggcaaagattcaagcagaactggcaaatatcttatcttgctcttctcaataataataatgttgttagataataaagttctatagcaatttaaccctagaatctttttgaaaagtaattctttaaagttgagaatcacagctgtctagcaagcatttccttgggcacttgaagctgtttattcactttggtctttcctcccaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagaggtagggatcattctgacttattaaagagctatataaccagttaattccatctgtttgatgcttgacatccctaactagacagatgagggttgaagttagtttttggtggggttggaggtgaacatcaactaccttcctagttccaggtaatatagaacatggagtgaagtgtagataaatgggtctggtgggtcccgaggtcatcttatcacataatgactaatttacattatggaacccagtacaaagtgttccagttagattttccattgtattctgacagttgtacttcatttaatttttgcctcttacagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcagcatccttgtttgatttcttctagggccgtaagtcttgttttctctccagatgtttatctgtgtgctgtggtaggaattaatccaactgaagtgagcctaacgctttttaaagtgactgaaggcttttccaccttaattactgcctgctttaattctggactgccataagtgatataagctataatttgagcagttactgtctttctgagacagattcttgagcctaactgaccaatatcacagctagtaagtggaagagctagaaccctaaccactatttgctacaccatcttataaatgttaaacaaggacacaccatcacatatcgagattctcttgcccttattatgggaattaagagcattttctagactgaaactccctattttcaactctgccactggtaagctgggtaacccaggggttatatataatcacttatttcctcatctgtaaagttggataatggtatctctaaaggttaagattcaaagagacgatgcattataagcatttagtatatgctaggcaccatcctaaacactggaaagttagttagttattatctcctaatccactttggaagggttttaatctcttccagaattatatttactcaagaatttgtttcatcaaagaataaacctcggccaggcgcggtggctcatgcctgtaatcccagcactttgggaggctgaggcgggtggatcacgaggtcaggagatcgagaccatcctgcctaacatggggaaaccctgtctctactaaaattacaaaaaattagccaggcgtggtggtgggcgcctgtaatcccagctacttgggaggctgaggcaggagaatggcgtgaacccgggaggcggagcttgcggtgaggggagatcgcgccactgcactccagcctgggcaacagagcgagactctgtctcaaaaaataaataaataaataaataaataaataaataaacctcttcaagaaaaaatcctagtgatattaatacaactcccaaagacttgataacctcctcatccttcatagcatcttttccttggaaatcttacaaggttttacaggactttacttatttataaaaatttcacctatgccagtagatgaaatcattctatgccaatttagcatttaaatgctatgttcccaacttacaaagactaactctggggaggtcaaagtgaatgagtagaaaaaaggcaggattcagagaatcccaagcagcaaggcaaagtggattatagaatacctttggtgtaggccaggtgtagtggctcacgcttgtaatcccaacactttgggaggctgaggtgggcggatcacctgaggtcaggagttcatggccagcctgaccaacatagtgaaaccccatctctagtaaaaatacaaaattagctgggtgtggtggcgcatatgcctgtaatcccagctactcaggaggctgaggcggcagaatcacttgaacccgggaggcagaggatgcagcgagccgagatcgtgccattgcactccagcctgggcaacaagagcgaaactccatttaaaaaagaaaaaaaaaaatagaatgcctttcatgtagtgactggaggcaagtcagctagctgccttcaagatccggtcgttgaagccagggc

SEQ ID NO: 16661 - DNA, 81819 bp, Human
aaatctgattgaagacagcatgaagtatcaaaataacccttggccactttggctagtgcccgtaggaatataaacaggtgggccacaaatccaagccttgatgaatgacctatgccagcaccaatttcctccctccttctggatcagagcctgtttccttccaaagtggtggacccccgaaatcttacaggcttttttttttttttttttttcctctgtctcactctgtcgcccaggtagagatcaatggcatgatctcggttcattgcaacctctgcctcccgggttcaagcggttctcttgcctcagcctcctgagtagctgggactacaggcagccgccaccatacccggctaatttttttaattttagtagagacggggtttcaccatgttggctaggctggtctcgaactcctagcctcatgtgatccgcccgcctcggcctcccaaagtgctgggattacaggcgtgagtcaccatgcccagccgagtctaactttctttacgatttcctggggtcccagctggacggagtctcatccctgccccccttactgggaggaaaagggaatgcacctcctccatgagcctcagctgcactttgaggcacctggaatccccggatgtggagcgagtctctgaaatgcagaacccgaggggccaacccatggactgtgatgggtaaaaggggagagagcactaaagaggccaagtagggaggacattatccctttccccttttattattattttttgttagaaaaaggcaggtggacatatttagcttgcgaagcttgcacaaggaaaatccagagcgtctccagaataaggatcccacgagagaacgtggacacaagtaggccctcagccagccttgtacccacaggcccaacaggccacttggctatgaggccagagcgtcgccataggggcccgaacgctagcgtttagggaatccgcaggctagaagtggaggcgggacgccactggtcgtctgagcgctgattggctggtggcgctagtcaccagccaatcgtcaacagacgccatttgttgttggagccacgcacctgacgcagtgggcgtcttgcacgtgcagccgtttaagtcgcgtgggcgcctgcgagggcttgggagagcaagccgcggagaggtgagtgggccgcttttctacgggaactggcctgaactcggccgtacgggctccccagtaaccgacctttggccaaagtgtggatggagtaggaggagttttgaagccgtccttcgaagcctttctgcctcggggtctcagagtcccacgggtgcccaaagtctgggcttgaggcctgcagaggaggcgaaggggccttattcctggcttcttcactgcgttttctctgaacagacatggtccgagtaccatttgtgtacaaatccttcttgatgaagctggttgtcctttgtcggcaggatttgggcaaccatacccttcttcccttccccactaaaatccaaggcctccctcttcaccgagtcgccgcccccctacccagtcgactcccgtacccctgtccccgcccccacgcacgccacaaacaccccaaagcaaacatcctatccaccttggatgttaatcatgcgaagggagaaatcttaagtagtttctgaaaaaagttgcctctcccttaatattcagtaagtcgtttggggaccctttgagggaggagataaagtctatgaacagatgtttgggaaaagcctaagtcttgctggggacatggcgattgctagaatgactaggtaagaggttcaactagtttctaaagctaagaaaggatggagataaatgccacctttagataagaagagacctaattccttctttggaaaaaacttttggggtatcagcacctagttgggtagtttcaagatgtatgtgaaacaatgagtttatgcttttaaagttatgattctgatctaattgagtccaaatgtgcatttttttttttttatgaatagaacttgaagccaccatgggagatgaagattgggaagcagaaatcaaccctcatatgtcttcctatgttcccatatttgagaaggtaataacatttaaagtttagttattaaatgctacggattttatcaaagttgaaaatcactgtggtgagagttctaaattatacagtctgtgtcagtgtttatctccatgtgattgttattaactattatatggggaataagagacaacctaagcctcgtataggatacaatagcttgaggcaatttgataattaaaagctaaaatagatgtaaaaatattaatgacctaatttaaatctcaatgatttaggacttcctcaggtgaaagcaaacttgggcaaatgtggttgatatcagtgaaagacgcttgtatggaaaattgaaaacaataattacgttttgggagatattttaaattctgaaaattgattttgtgcaaggagggttctcaggataaatgatactaggctgattgagttggtaacatcagtttgtatgaatcttcagatcttttttcttaatggcatttggggagttacattgtaatttaggggacagtggggtaagttttttgggcttcagttctgacttggaaattggctttaaaaagatgaatagaaggtactttaaaagataatagattatttttgcatgtgttacttactatatggtgtctctacaagttgatttttttgttccccttcagaatttccagtttgagtgtatgtcagttctgacactttctgatttcaagttttgccttagtggaagttcttattttagacaaaaatataaaatatgcaatcttttgtcttagttgaatttgatctatatgtgaagtttatattaaaatacccaaaatactaatataaatttatcatgtttcttttcttggaactttttaaaagaaataacatgttacctttttttttattttttaaaatttttgtagagatgaagtctcactatattgcccagactggtttccaactcctgagttcaggcgacattctcaaagtgttgggattacaggcgcaagccattgcacctggactgtgttatctttttatagttctcttctcataataaaaatatagcttttttgggaaaagtggagaaagtcacctacaaatcttgcccaatagacaagcactcctgttaaaatttttagtcaattttcttctgttttttccaaacattttttgtttgtttttgatacagtgtcttgctctgtcacccaggctggagtgcactcatgcagtgtgggctcactgcagcctctgccttctgggttcaagcaattctcctgcctcaacctccctcagcgagactacaggcgcatgccaccacgcccagctaatttttgtatttttagtagagatggggtttccccatgttggccaggctggtcttgaactcctgatctcaggtgattcactcacctgggccttccaaaatgctggattacagtcatgagccaccgtgcccagcccaaacatgttttatatagttttgatgatagtatataacagtaatttttttttttttttgagatggagtctcactctattgcccaggctggagtgcagtggtgcagtctcagctcactgcaacctctgcctcctaggttcaagcgattttcctgcctcagcctcccaagtagctgggactacacgtgtgtgccaccacgccccgctaatttttttttttttttttttgtatttttagtagacacagggtttcactatgttggccaggctggtctcaaactcctgacctcaggtgatcctcccactttggcctcccaaagtgctgggattacaggcatgggccaccacacccagccatataacagtaacttttgaatccatctttcttgacacttcagcactaactattccatattacaacttttgtgggaatttcagtggtgttagcttctcactgtgtattgtcattaatgtttacatcttacttgttttaatttggtaatttttttcaaaaatggaattacttgttcagaggacattttttatcattctttttcctccttgttctcaatagatttgttataacacaaagtttaattcacagatagatactttattccccctggtcttaatagccatctgtccaatttcttttttcttagtttgagatttttgtcttcatgaagtgtttaagcagcacactgcactatagcgtgttgtgcatatttattgcattgggtttctgaaattaaggatgactgtcaaatctttcaaatttccctttttgggatctttatgctattcaataacatagtttcttcacattgggaatactaaattgaatatgttgaccagtctaccttatgatgcttaatacatttgtgttgggtgaatttgtagtgtatcttttgcatttgtctgcaaacttaacacctggtgttgtgctggttgtgccattagttctatgcttagttgactcgaaggaacatggtgcaatcaggatctttatttgccttcctaggttgaataaaaagtgcaggatggccaggtgcggtggttcatgcctgtaatcccagcactttgggaggctgagacagccagatcacttgaggccaggagttcgagaccagcctggccaacatagcaaaaccccttctctactaaaaatacaaaaaattagctgggagtggtggcacacgccagtagcctcagctacttgggaggctgaggcaggagaatctcttgaaattgggaggtggagactgcagtgagccaagtccgggcagctgcactccagcctgggcaatggagcaagactctgtctgaaaaaaaaaaaaagtgcagaaactagagatgaatacattacatttttatgtagaacaaatctaaagtctttcattccgtttcttttaaagacaccattttgatttgttctaactgaatttggttttcaagaaaaagctggccttctcttttatagcggctttatctgtgatcatccttttctgagtgcttctcaggagctttatttggagacttaatgttgacatacgcttatataattttgaaataatttgtcattgttctagtataacagatagaattttgggtagaacttctcaattctaaattttaaagtgagtgtaccacctgggaatagaacagcgaaagatgtgaagttaagaaagattttataatgtggcaattatatagtccagaaatctcaaccattaggcatttgcacgttgcctgcaggcttattggggtgagtgttagaatggatgggtatggtgagtgtattagataattccgttgcttacttactagctgtgaggcctcttgttaactgaccgtgaatgtaagcctgtatagtgatcacttctgtctgatctatttgccatttttgtggcacatttcagaaggcaaaatctcttgtggttaaagtggaaacagtaattgagtaattagaccatccacaattataattttattaagcagcagtagcaatgttagcaataattgttgagataagaaaataaacatatatatgatattacaaaattgaaagtaagaatacaggtgaaaaaaatgtgttcatcaaaatgcaaaaggattatttgtagctgcatgtgagaacacttatgtgttaaacattcgaaatttctgaattggtgcatttgggtggtttgagagataataatggtttacagctaagtattttaagaggtaagctaaagacaagacctatgattcattcaacatatttttgagttctagtaggtgctggagagagagtggtgaatataaggtgcttgctgttacattgtattttactggagaagacagaataagcgcgtttgagaaccaaataattatagtgaaaagtactataaaaaattagagaaatgtgtgtgtgagactggtgtggggtggatttagttggagagggaaggcttctctcagacagtgactcatgagcctgagacttaaaggagtcccagcaggacatcaggtgcaaaggttctcaaggaacctttgagaaggaggagggaacaaacttggggtattagggcaacaagaaggccaatgtgttagttttctgtggctgctataacaaattaacacaaactgggtaacttaaagcaacataaatttattctcatagttctggaagcctgaagttaaaaatcaaggtgtcagcagcgctgccctccctctggaggttctgggacagaatctttgcttcttctagcttctagtggctaagggcattcctcggcttgtggctgcatatctcttagctctgtcttcacattgcacctcctttgtgggtctttgtgttatttccctctgcctctctattataaggacacttgtgatggcaattaggactcatgccgataatccagggtaatctcatctcaaaatctttaacttaatttcatctgctgtgaccccttttctctctctttcttttcttttttgagacagagacttgttctgtcacctaggctggagtgcagtggcgcaatctcggctcccttcaagctccacctcctgggttcaggcgattctcctgcctcagtctcctgagtagctgggattacaggtgcccgccaccatgcctggctaatttttgtatttttagtagagatggggttacaccatgttggacaggctggtcttgaactcctgacctcaggtgatctggctgcctcggcttcccaaagttctggaattacaggcgtgagccaccgcgcccaaccagttaagcttttttaatgataaaattctgttggaaattatttttgatgtattttttcaaaattcatcttggaatttgtaagttggatgtatgtgggatattaagttccatagcttgaagcttaataataagtttttcagttctttagtgtaagagtgttttataacacttgtaaaaccagcctttttttttttttttttgcctctattcactctatagtactttgagccttacaaacaagaaaaaagtcttcagattttaaatagaaaatattggataattgttcttgttttaatgtctgtggtagtaataaactggaacttttttttactgtagcaattaccaaaaccccaagtcatttcaagtatgttgttatttttgtgcccttaatgatgactcggaaaaatgtttggatgactcttgagctttttaaaagtagttttaaaagtcagtgtctttgagaaagaaattttagcaaatagatgttacctaaagaagcctaccttggtgcattctctctaggtttgggacttagttaaatgaacttatttgaaggaacattgtaactgttgtaatatagttagttgattaagagatcatctgtagatttcctttcattcttaaattattaaattctgattgtcatgtgcaagaatttcagagccgtattctgaacttttgccataattaaaggaagtttacgtgagaagaaataaagatgtggattaatgatgataaggacaccctaagagttagtgagaaaaaaattactcaaattgtcattaatctagagctatccagagaaatgttggaaggttccaaaattaacctgcattcagctattgattttataataagttgaattttctaaatctggcagtcattctaccactgctaatgtaatgcatgtgtgttaatagtaaatgattttctttagcctaaagtagggaaagtgaacagttagtatttgggagcaaagacagtcttcagctactgctgtgacaaatgtgattaaaattaaccatgaatattctgatgctacagctgaggatataccttttcattgtagttgtagtgcagtggcaggttgcatatataaattgtttccagtccataagtgaatttactttacagtgaatccttttttttctttttttttgagatggtgtgagacagtgttttgctcttgttgcccaggctggagtgcagtggcacgatctcggctcaccacaacctctgcctcctgggttcaagcgattcttctgccttaggctcctgagtagctgggattacaggcgcccatcaccatgccaggctaattttgtatttttagtagagatggggtttctccatgttggtcaggctggtcttgaactgctgacctcaggtgatctgcccaccttggcctccccaaagtgcttggattacaggtgtgagccactgagcccggccagtgaattcctttttaaaacatgagagtaccattaattggtttcactataaatgcagtagagattttaaaaatttctgtagtacttttctagagcaaagattagtgttaaatcactaatactctgtaatattgatgaatatactgtaatatatggaacttggcatacaatagtgtgtattgaccagtgttgatttattcatgtattacttgtcagattttataatgatattttattatattttcttttctatttttattttttgagacggtcttattctgttacccaggctggagtgagtggtgtgatctcagctcacttcaacttctgcctcccaggcgaagtgaacctcccatctcagcctcccgagtagctgggactacaggctcatgccaccacacctagctaactttttgtatttttagtaaagctagggtttcaccatgttgccccggctggtcttgaactcctgggctcaagtgatcctcctgcctcagcctcccacagtgctgggattacatacgagagccaccacacccagcctgattgtacttttcaggaatatgggtgacttaaatgactaaacttttactttaagtcaggtgtcagcaaaccctttctataaagggccagataataaataatttagactttataggccttacctgtctgtcacaactttgctgttgtagtacttcaatcaaactctttacagaatcaggtggcccaccagatttggctggtggctgtagttttctgaccactgttctattgatatatattagtactatatatacagtgttaaagtgaagatgtcttggaataattagtaaaggaacatccagtgatttagaaaaccttacagtctatcattattttgttctgaacaaagctcaattgttataattttctagtatttgtgaaataaatgacacgttcatattcaaagtaggaaactagttttttctttcttctttctcacaggataggtattctggagaaaatggagacaattttaacaggactccagcttcatcatcaggtatgtgttatgggaaaaaggtaaaaccctttttagtttaagggtttcatctagtgaatgaagagcagcagactagtagacatcttgtagagggtgttttaaaaaatttcttagtgaaagttccttctgatttggatattgtggaatgggggtacttctagttagaggaattgagagagggaaaagaatagactgtattatttgatttaatggattactataaaacatttgcctaacttggaagttgcacattcagcttccaggctgctagggcatcatcatcatcagggttcctgacataagggagtagaatataggactataaggttgtcgaagcaggttacaatggtgatgacctgtcaggataataactgtttaagccaaatctgtcataccatcaggatatcttgagtttctttgggatcagaaaactaatttgggaaaggtcttaggagaacaataaaaacgtgtcaaggtaaaggaacccatatccttcctgttgcgccctcctcccaaccccactctgaacttgttttcactttggttgcccctcccaccatcatttttccccttgggttgtccaactctattttacagagtggatgtagatgggaagatgggtggaagtggtaggactaggctgggaaattgaactcatggcagtagtttttcacattgttgaagtccaaaacaggatgaaatgcaattgttactatattaaaataattttgaccggactctggctcatgcctgtaatcccagcactttgggaagccgaagtaggaagaccatttggggccaggagatcaaatgatcatttgaggtcattcgagaccagcttgggcaacatagttggagtctttgtctacagaaaatttaggctgggtatggtggctcatgcctgtaatcccagcactctgggaggctgaggcaggtgaatcacaaggtcaagagattgagaccatcctgaccaacatggtgaaaccccgtctctactaaaaatacaaaaattagggtgtggtgctgcatgcctgcagtcccagccactcggaaggctgaggcaggagaatcgcttgaacccgggaggtggaggttgcagtaagtcgagattacgccactgtactccagcctggagatggagtgagactctgtctcaaaaaacaaaaacaaaaaaaattaaaaattagctggtcatggtggcctgtgcctgtagtcctaactacttggcaggttgaggattgcttgagcccaggagttcaaggctacagtgaactatgatgatgccactgcacccttgcctgggcaatggagcaaaaccctgtctctaaaaacaaaacaaaaacattaaaaaactatgatgaagtatacataagatttaccattttaatgtgtacagttcagcagcattcagtacagtctcattagtctgtaaccatcatccaccatctacccccagaactttcttgtcttcccaaactggaactctgtactcattgaaaaataactccccatttcctcctctcccctgatcctggcaaccaccatctacttccggtgaatttgagttactataactttactatgagtctctaaatcgagttactactatttttaaggcagactagcataaggaagagggcctggtggtatcaggtagtaattttatcatttttcttataaaaaattagtagatgaggtaaaacattttatggtcaagggagctgcatgctcactgaaacctggcctatggtggaaaacacccatggtgaggtagtttccaaaatgtgaggatagtttgagagtcagtttatcaggttaaagcaaatctaattctcatgagcatcttaagttcagggtaaatatcttgacaaaagttaagtttaaaagagatgactttgctattttcaaaatatgtttatcttttataagcatttaaacacagtggtttaatacagaaatattcagattctcagaagttcttggaatcctgcctgctgaaaccccagcaaagggctaattttgcttctaccatataaactctgtgtgtacttagagtattccagaaagacaaatggataaacgtaatagataccttttaacatgtctatttacatcgattgctgtgtaatcaggagaaacctggttttttgaggtatgaacagaagccaatatttgtaaaggaatgaaagtttaggtctatagtatattaacgcataacactgttttgtattggaattttcaagaaactagactgaaataaccaccaactaaaagctaagtttttttttttagcattagacctatgaatgtttaggctaatgaaatgaaatcattaatgaaaatcactaatgaaaaatattgattgcctgcttaccttcttctagataacaagtactttttgtagttcttcataattttttatttttttatgaaaattttcttattagagaaatataaaccaggacagtgaatgtaagccaagccaatacctaaatatgcttattgttttaaaaaaaaggaaaaagggagaaataaaatatgaaatcttagcccctaaatttagctaccattgatgtctattgactctgattttttagattcctgtgtatattcccacatacatgatcgtatgccactggcataatatattaatacatatgttccttttttataaatacttgtcttgtttttcctttgcttacccatgcttaccttccatgcccttttcatgctcttaaaattgtatttagacatgcgtcttttcattctgtattttatagaaatggaatcgtgttatatcacatcttgcttttatttaatagtcatggaaacccttctaaacaactggtattatctgattatttccaaaattaagcgaaaacaatttcacattacttggctttaaaatgtcaataggaggcaggtgtagtggcttatgcctgtaatccctttgctttgggaggctgaggtgggagaattgcctgaaactgggagttcagaaccagcatgggaaacaaagtaaacaaagtgagacactgtctgtacaaaaaatttttaaaaattagctgggcgtggtgatgtgcacctgtaatcccagctactcaagaggctgaggtaagaggattgcttgagcctagaattttgaggttacagtgagcattgatcacactactgcactccagcagggctgatggagtgaaaccctgtctcttaaaaaaaaattctgctgaaccttgcctgccttgtatttgagggtggatcattaaaatcctggttagaaagtcagctctgtgcagggacgcactgatgggctctaccgtcaagtgattgggccagggctaggctgttttgtttgggagagcaggatcctctagtctctgagatttaagtttttgtaactgtatatgctagttccagcctttccttcctcccactctgtcctcactatattgtacagcttctatgttgcttttgctgatttctttattactcatgtttgatttgaaacaagctgtttgtgggaggaagttttagggattttttgccctccccttccccaaaggagcaattcttttgtatgtgtgtgtcttttttttttttttttcccagaaaactttttgcaagttgttttatttgcaatgccctttgaaaggccacgaaagttaactggattacaaactaggcagaaattgctttacaaaaggagggaaataccaaaatgtcagtttctgtagagaatccacagttcagttttattcagagcaaaaaaaaaaaaaacttttaatcacactagaaaaaactcagcaatagatttggaatctgtactcaaactacacatgcaatgacagtattctgctaatgcagtcgatttgctgttgtatttgtctacttttttatattaataattataaactctaaagcagtgcaactagtatttggaacaatctttacagtgtcaggcacatttcacttttcttcacaccattggttctgtgtacgtgggcttcctccccttcagtaaagtcgttttgatattgaaggtcttgggaatgtccacaggtgttttctccttgatcttattggcagcagtcttgcatgtaacaaacctttgataatagcttgcagctagaataaggtcaaagagagttccttggtgaattttcaggaattcctggtcccaaacaggatttttatctcttcatttttcttctcattattctcaggaggaggaggagggtcatctttatgggggggtgcaccactgaatgaccttttaaaatactgcttcattatttggtagaggactgggtcatcatatccttcaatcattcattcccaaatcttccaacgtgatcttgatagtatagattgtttggcaatttctacattaacctcaaatatttcttcattggaactccataactaattgaaggcaggctagaggctgacatgagccgggcagcatcagcacagaagggaagggtggaggacatgactgctctgtgtatgtttttaaacgtgtgttttctgagcatattttgatgtgtatttttaacttagaattttttttttacttttccccctcatcactgtttaagatatattcctaattgataattgatttccttatttctaatgactgtgtggtatttcatatacttttatcaccaagttttatctactcccattcttcctccatgataggcactgagattacctcctgttcccctctgttaccataggatgggcattcttgtatatgttcatttatgggccagagtgagaattactttggatagtggactcgagtagaattacagggttatggaaaggagtaatgtacttaatttgtctaaatatttcaaaaattgctctccagaatagctataccagtttatactcccatcattaggatgtgagggttctcatagtccctatattcccaccaacatttgacatttttaattttaattaattttagccagtctatttgggtataaagtaaaatcttttttttgttgttgttttttgagacagggccttgctctgttgtccaggctggagtgcagtgctgcagtcatagctcactgcagcttcaatctcccaggctcaagcaatcctcctgcctcagcctcctgggtagctgggactacagacttgcaccaccatgtctggctgatttttaaaatttttagcagagatgaggtattgctatgttgcccaggctggtcttgaactcctgagctcaagtgatcctcctgccttggcctcccaaagtgctgggattataggcgtgagccaccatgcccagcatcattgctttactatgcatgtatctgactgtctcttcatatacatgttgttattctgtaagtttctacttttgtaagttgcctgtttgtatttttagtctatttgtctattgagctagcttttcctattgttgattggcaggcattgttaatattctagattttaggctctttcctgatttagacactgaatatcttcttccattctgttgtctgtcagctttgttcatggtatgccttattaatcaaaaatttaattctgaagttattaaataatttttttgcttcttgatttgattttgtagtttaagaaattcttcaccatctctgtcaaaaagtagcctcctacattatcttccttagacttttgcctttcacattgagcttttaatcgtctgaactcatcctttttgaatcatggtggccatatttatttgagtgtcaaatcaagacatagtgtatgcagtatgaatatacctaaatgactcacaaaaaaggaatctttgacgctaaagtttttctggtcagccctgaccattggtctctagttattgaggagttttgtttgtgaactgtggtaaactagacataatagaaaatttactgtcttaaccatttttattttatttatttattaatttttttcttttctattttttattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctctgtccatgtgatctcattgttcagttcccacctatgagtgagaatatgcggtgtttggttttttgttcttgagatagtttactgagaatgatgatttccaatttcatccatgtccctacaaaggagatgaactcatcattttttatggctgcatagtattccatggtgtatatgtgccacattttcttaatccagtctatcattgttggacatttgggttggttccaagtctttgctgtcgtgagtaatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatggtgagcattttttcatgtggtttttggctgcataaatgtcttcttttgagaagtgtctgttcatgtcctttgcccactttttgatgggattgtttgtttttttcttgtaaatttgtttgagttcattgtagattctggatattagccctttatcagatgagtaggttgcgaaaattttctcccattctgtaggttgcctgttcactctgatggtagtttcttttgctgtgcagaagctctttagtttaattagatcccatttgtcaattttgtcttttgttgccattgccctatgaagtccttgcccatgcctatgtcctgaatggtaatgcctagattttcttctagggtttttatggtttctggtctaacgtttaagtctttaatccatcttgaattgatttttgtgtaaggtgtaaggaagggatccagtttcagctttctacatatggctagccagtgttcccagcaccatttattaaatagggaatcctttccccattgcttgtttttctcaggtttgtcaaagatcagatagttgtagatatgctgcgttatttctgagggctctgttctgttccattggtctatatctctgttttggtaccagcaccatgctgttttggttactgtggccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgttgtctgcaaacagggacaatttgacttcctcttttcctaattgaataccctttatttccttctcctgcctaattgccctggccagaacttccaacactatgttgaataggagtggtgagagaaggcatccctgtcttgtgcctgttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagctttgcatcccagggatgaagcccacttgatcatggtggataagctttttgatgtgctgctggattcggtttgccagtattttattgaggatttttgcatcaatgttcatcaaggatattggtctaaaattatctttttttgttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatactgttattggtctattcagagattcaacttcttcctggtttagtcttgggagagtgtatgtgtcaaggaatttatccatttcttctagattttctagtttatttgcatagaggtgtttgtagtattctctgatggtagtaaccatttttaaatgtaccgttgaatccctttttttcaatatggtgagaaatagggatccaattttatttctgtccctataacaacctagttttttccagcaccatctaagcattctgtcttttccttgttgatgtgtgatgcaaatttcatttcttaaacgattttgttctttgttgtcttaaagcattggataaaatctacagttcattgacgagtagtagaaataacaaacatctaggcttttcctcacttcaatgggaatgctcccaaatttttataattatgatgtttgcattaggctactaatagttattttttaaaatcatgccaagagagtttcttttcatttctacttgaatatttgttttgttcaggaatggcagttgaatgttatcaaatggctttttagaattactgatttctattatttctcccttatatctattaatgtagtaaatgaatttttaaatgaactttgtgttcctgggctaagccttacgtgactcttttattgtactattggatgaaattagatattttatttagcacttctgaattaatgtaagattggcgtatagttttcttctgtcatgtcgtcctcacttggttttggtttcaagcttttcatgttttccagtaagctccggaacatgaaaattacctgtttttttacaagttgtatagaatttgttcataaaactgtctaggccagggcagattctttttttttttaaactttattgaagcataatgtacacatagattcaatatgtatttcagtaagatacacagcataaatgtacagctcacttaattatcagaagctgaacactccctgaaagccagcactcagatcaagaaaaacagcattattaacagcacccttgaagccttcctttttcttccaggcaccgtccctctgtccagaagtgactattatcctgatttctaacagcatagatcagttttccctataaatggcagtcatataaaatggcgtcatacattgtgttctttttttgttgaggttttctccaggttgttagaagtagttataggttatttgtggatgtatgatattccctatgtaaatataccgtaaattaaaatattgatggtcatttttatagtttccagtatttgcctgttatgagtggttctcttaagaatgttttccaattcatgtctttcggtggatataaaaatcttctctgaatgtgattggcagaacagtagcattggcatcacctgggaacttgttagaaatgaagaatctcatactgcacccagaactactgcatcagaatgtgtgttttaatgagatcaccaggtaatttgtatgcacattactgttacactctgaagtctctatttggaagacttgacactgaattctaagtgttagtgtttcagctacttggggtaatgaaagggattagaagtcaggagagctggcagccctaagcaccactaaatagtttcaaaactctttgcccctaagtcttttctcatcttcctttaattttcctcactctggtttaggcaaatcactgtggagaaaggttggaagattatagagtcttagagcgcatactgaagtctcatacataattgggttcttttgcttggtggttttagtatatggaattttttttaagttcttgttcaatatttgagcctctttggatttggtccaagtgtaactatattgagagatattctttgtggtcagttgttggggattgtgtacactaacactaaattcattttaaatggacttcatttttatttcttttggtttattttggtggatttcatagcattcaagaagagcatctatactccatcatttattggtattagagtcttatttatttttattgctatgtataatatgtattgtggggattgccgtgatatatatcaatgacagcatatcattacattcatgaaagtgaatgtaaactttcacatttacatgtgaaagtactgtgagatttaaaactactaaaaaatggaaaggaaataattgtatattttccttaggattgtgtgctaataacaaggtaaactgggttaattctttcttagaaccttctactcttgtaccatcatttttatgtattttttatttacataggtttttggggaacaggtggtgtttgcttacatgagtaagttctttagtggagattcgtgagattttgtgaacccattacctgagcagtatgcactgtacccaatttgtagtcttttatccctcacccctcatcgcactcctttccccaagtccccaaagtccattgtatcattcttatgcctttgcatcctcatagcttagctcctgcttatgagtgagaatatctgctatttggttttccattcctgagttaattcactaagaataatggtctccaattccatccaggttgctgcaaatgccattatttcatttctttttctggctgaatagtattccatggtgtatatatacaccactcattgattgatgggcatttgggctggttccatatttttgaaattgcgaattgtgctgctataaacatgcgtttgcaagtatcttttcatataatgacttcttttccaactagtgagaggtaggattcccaagaataattgttaccctgtgactttattgtagaatctttattgaagaccttttcatgaaaaaaatctactgtattgaagtcttatgtaaaccataaagcttaatgttttgaaccaccactaattttaagaacattacccaccgggcgcggtggctcacgcctgtagtcccagcactatgggaggctgaggtgggtggattacttaaggccaggagttcgagacctgcttggccaatgtggtgaaaccctgtctctacaaaaaaataaaaaaattagctggatattgtggtacacgcctctagtccgagctactcaggaggctgaggcaggagaattgcttgaacctgggggtcagaggtcgcagtgagcggaaattgtgccactgcactccaacctgggtgacagagcaagactccatctcaaacaagacaaaacaaaaaaattctcatgcacatttgggttgtttccttttttgctgttatgaacaaactctcatcattccttagtttgctaagtatatgttaagtcatgaaaggtgttaaattatgtaatatactttatctggagagattagttattttttattaatgttgtgtgttacctttttttagatatggtagtgttaaatacccttgcatactgggataaacccaattagtcataatatattttatccattcagtttactgttgggtttggtttgctaatatttgtttttgagattttgtatctatgagtaaggtttataattttcttctgaactttcatatcaaggttatgttggtctgtagaatgagttggtgagtaatttctctgtttcctggaagagttgtatgacagttgaattatttgtcctttgagagtttggtagaactcacctgtaaaacccgatctctctgcatctttctgatgcagaaaattaagtactgatttaacttctgtaggagagttgggttttttattgattcttgagtcacttctggtgagtcaattttctaggaactttttcatttcttttaatttactagcataaagttgttcagagaagttctctagttgtctttctgttctttgagattctttttaaacacatttctaatactgttcacttgtgtctttgtatctgttctcccttcacccccattattagtcctctagtagttggttaccctggcaaattttataggtcttttcgaagaaccaagttttggcctttttgagctgctgtattacgtttgtttccttaaaaaaaaaaaaaaaaaaaaaaaaaaaaaagaggcagacagacaaggtctctttctgtttcccaggctggagtgcagtggtttaataataactcactgcagccttgaattcctgggctcaagtgatcctcctgccttaacctcctaaatagctgggtctacaggtgtgcaccaccacacccagctacttaaattttttttttggtagagatactgtcttgctatgttgcccaggctggtctcaaatttctgacctcaagcatctcttcccactttggtctcccaaagctgtttcctattttattaattttcgttctttatttcctttacttttgtgtgatttactttgtttttctaatattcttgttgagatggctattaagcttattgagttcttattttctagtataaatatttaaatactgataaagtcacatttttatcatataatttgaagtatttttaaacttccattgtgagttttttttttgagctgtgggttatatagaaatgtttttaaaaatacgtcaccaaatgggattttaaacaatttttttcatatttaatagcttttgatttgattgcattgtgataagagaatctcatgtatatgaattgattattgaactcttgttgaatttgcattatggcccttctacatggccagtttataaacactctccattgttgaagaatgtgagctctttaatgttgaatgctgtatatttctttggaatccttgtgcatactattgtatggatgaccataatttctttattccactttgatcatttatttggtattacagacagtgcttataaaaatttttttatgtctgtctggataaccatgtgattatatccagaggagaaattcatgttactgtactttcagagtatatgccttttaaattaggatcaagattgatctagtttataatctaaatacagtgtatgtttcgtgcctgtttccctgtgtccttgttctggctattagcaaatttaagactgttttccattttttaaaaatttatttattttgttattttctttcagggaatagaagggacttttccattcaattatgaggttaaaaattgctgtcttttgatttctagttctttatgaatcagatttagtcacaatttatttttctttaggagaactgtctattcatgtagccatttttttttttttttactgggctgtttgtcaccttttttactgctatataaaatttctcctttgccacatgtggcacagaaggcttaaggtttgcaagtactagatacttgtttttatttgacttacttcaaaatgttgtttgctttagaaatggatgatggaccttctcgaagagatcatttcatgaaaagtggatttgcctctgggcggaattttggaaacagaggtaagcatctttgtctttccttaatctcctgaactgttgaataattggatatatagaggctttcatggccatttggtacaaagctaagtctgttgtaagtcagtgtgtagtagacttggtgttgagataatgagttcatcatttttccaagttcattttcttttttctgttttacttctttgggatagtagggagtagtgttaagttgattagacagattggttggagggatggatgggttggatggatggatgattcacagagctgctgcttaatgtgtttgtgatattgatttccaacaattgatgtgggaagaatatttgtaaaagcttcagggattagaggtgagagggactctttcttgaattttatatttttcaagaaaaggcagtataggaaacatttgttagctcattagtattaattttttaagagtttattttgccattattggatttttaaattttacttttagaacaaccacctgatatgacagataatgacacagcaaaacacctttctacagtccatttttagacttaatattaacatgctagaaatatgtgctatattttattatagtgcaataacatattagaacttcaggttaaatttatttgaaaatccatacggtcatttttttatcttttaggggatgccatagcgagggctatttgttaaacatacttgacacttattcttgaatttatgagatgttattttttgaaaaactctattgagacttgcagatatttttgctgtggaaactaaaagatgcatgatgttttatttgacatttggaaaatttaatttctttagatacaataaacacaaatttgagttttatattttgacatgtttctgccactaatagaaatgatttattcaaatatacacatatatattggtttttaagcctgcatattaagatgcattgtttatttggacaatgtaattgtgctaagagattcagatgagattttgttagctactattaaaattagaaatattttaatattacatttaggagcatatttattatttacgtatcttttaaaattatattttagtagaggttatgtgatattttgatacaggcttctaaatattattgaataaaacctttttcagtgagaaaatcatcactgaggcagattttaccacaaattattttcatgttttaggttgaaatacacataaaatttccgatcagaactctcagttgttaatactttaaacaattagctttatattacctgggacattgtagacccatgagtataacttattttccatatgattcttctaacattttatatagtttccttttttttttctttttcttttttgagacagttttgctcttgttgcctaggctggagtacaatggcacaatctcggcttactgcaaccttcacctcccaggttcaagtgattctcctgcctcagccttccgagtagctgagattacaggtgtgcgccaccacgcccagctaattgttttttattagtagtagagacagggtttcaccatgttggccaggctagtcttgaactcctgacctcaggtgatccacctgcctcggcctcccagtgtgctgggattatagacgtgagccaccacgcctggactgtatagtttcaatcttgattttcttctcagtagaacttgcataactaataatgtggtttttgaagttgactcttcattgcttaaaatatcgactagcttgttatgtcctgtgaagtatgtctgagtagcttggacttcttgaatcacacatctttgaaatctgattaaaatacttttatagttgggcatacacaattttacaggtggtttcaggagttacacagatcccttttaactcccctctacaagggttttacagaggtaagtaagacagtatatagggatcacagggaatgctttaatttttttctcagtgatagtttaaagcatcattttatgctgttttggatgtctctcctgttctttttttaatgttttattttaaataatcgttcttgctatcacatctctgctctcgagatttttaatttagtggtagagaaacacatggaaagaaatactactttaaaaaggtacagatagtatgctgtgggaatgtggaagaaggataaattatgactggagggctaaaggaagacttcacataattggttttttgaagaatgaagtgaattttgataagacaaataagaaagtagggaatgccatgccaaaggaatagcatgtacaaagatacaaaatattagcagttgacagtgtggagtattggagttgtttggtgtgaattaaaatgttgggtgtttagaattacatagtgagaaacaaagctaagaaggttagtatggggaaatagtatggcgagatggggaggccaggaggggagtggtagtcttaggtttttcccttatgtagccccttgttttaattttaaaaatggaaaggatatgataaatataagaaatagaaaaataaaaaatagaacagttaaacaggacacgagtgtaagattttcaatagcagtgactttcacacagggcagagcgtaatagctggctctatcaggatgagaattcaacatatagaaaactatggagcagaattttcctgcttgaaggtctccaatataataccaactagtagaaagctgtgtttcaccggtagtagatttgtttttaccttggtatcataatttaagagtttttcttttaagttgcaggtatattaattaattttaggtttctgtgctactcttttcccatccttggaagtctctttacgccagaaattcatttaattcttagtttttgatgatgacacacttaattttatatgttaaagagtttaactgtccaccctttttcagatgctggtgagtgtaataagcgagataatacatccacaatgggtggttttggagttggaaagagttttggaaacagaggtaattacttggttatgatatcttacaatcaaaacttgagtgattttttaataattgagtttaaatactgattgacagacattccatattgacatttaatttcaaggtatatattctgtgagtgcctttgcactaaagattatcttattaaaacttattaaaaacattttttaattttatgaaagattactgatgaatgcttttaaaattaattctagagacatgtctgtatgcttcagagatgcataactcttagacataggtttttaggaaataagtttgaaagcaaaacttgacgactttttaaaaaagagtaaacaaaaagaagctaacaagattttcatgttattgaggagaaaatcattgagttattgggttataatttagttgtattgtccttagcagatgaagagattgagtttgtaaaattttgagaattttgatggttttaaatagaaaacatatagtggttacactgacatattcctctgttttgcccatgtgcatacagaggagtatatgacaattgaggtaatacagaattggctgaaaagaaagttgtttttaaccttaagagaatggagttgataaactgacacaaagcagaaattgttgtacagcctgagtgaatttgcatgtgatagctatgtatacaattgtgtatcgcttatcttagaaggcatcataactagtagttcctgtgtggttatcatttttaccacagaggtacaggaaattgtttcattttatattttgtataggtttttcaaacagcaggtttgaagatggtgatagctctggtttctggagaggtaaggttgatatttttgtgttttaaaatttaatgtcaagagtacatgctaaaaaagagaaattaagattaagtctcttagtccgggccaattctaacttatttaaaccagattttatgaagtagctatatccaaagccttaaccaaggatattactgctttgtacataaagaattcaggcatcctaatttggcctgttgccatctgccttaatccatgaggtacaacttttgaatgctctgaaacttaagaaaatggggatagataataaaaagaagtagtcaagaagtgaaacttcactctctatataaatacagtttgtgatgtatagggtcacatttagattcaaataaatctaagaaaaagtttcatgagaatgtaaatcagtgctgaaattaaagacaattccattgaaggtactgacactctacaggaatacagagaatgatgagaatgatgaaaataatgataccagaagatggactacgataaaccagtgcattcccaaatctgattgagtcgatttgggtgaggtcttagaacctgtatttaaaagcatccatggtgatcctgatacctcctgtgtttggtaatcattgatgtatgaaatctttataacatagaacactttagggtgccaaacttggcttcatgtctctgccttgctacctgctagttgaagtagaacaagttgcttaatttttctaagccagttttctgttccatagaatggaaggtattcattttataggtggttaggcaggctaagtgagaatgcgtgtaaaagcacacagctgaataccagacacattcatgacaaacactcagatgtcatccatctatcttcattaaatatttgaagctgatcttattaaacactttgattcccaaagtcaaaaccaagcctagacctgatcaccttaaaacacttttggtataaggccggattttaattatcaaatgagactgtttctccaaactattgccagtctctttctccctacttctctttttttctcctatcccgttcaaatgaaaacatatatgatgtagaactagtatttgtgagagaagaaaaataccatcatttttattcttttccatttctatgtgtttctgttctgatctcttttaactcatttaatattcaagatcatttctacttatacacagacctttctacctacttgacccctttgtagagatggtgggccagggagcttttgaatacaaattccagtttctcatggcacttgagagaacttctctccgaagtggcctgcttgctttgttttgatctactttcttcttttttcgtttttagttcccctaaaaaaaaaaaaaaaaaaatatatatatatatatatatatatggattgaattcattcattgtctcagttgttagcaagcccaagttctgagctcacggtagaagctttttactctggacacaaatggatagtatgtttttaaatttttttcccctgtcatctactttgcttaagctggtatattgtagtgataaggaactcagatactggatttgaacacgtaggtgtgagactcagatcctcctcctggcaattgtattatcttgaaaaagcctgtaactttctgcttttcattttctctatttgtataatgatgactatatctacttcacaaggtttttgtgaaactttagactaaagttaatacatgtgatacatttagaacacggccaggtacatactttatgtgttgttattattatttttcgagacggagtctcgcactgtcacctggcctggagtgcagtggtacagtcttggctcactgcaacctctgcgtccagggttcaagtgattctcctgcctcagcctcctgagtagctgggattacaggggcccgccatcacgcccgactaatttttttttttttttttttgtatttttagtagagacggggtttcgtcacgttggccaggctggtctcaaactcctgacctcacgatctgcctgcctcggcctcccacagtgctaggattacaggcatgagccactgcgccaggccatatgttatttttgtataattaataggttgtaactaatcttggtatcattatctcatttttgtttgtgcttagctttatttcctaactgtatagagatcacttattttttaaagtaattttttattttgaaatagttttattcataagaagttgcaaaaatagtacagaggtttttcatgtacccatcacccaacttctcttaatgttttctatttttattcccactgtgatcaaaataactgtaggtttattttagggaaataattggccaaagatattgtgagactctttcccttgccaggtcccagattagtagttttgttttttttttttttttctcgaaagcagtaaatattagttatcatcattgttattccagggccaacttttcaaaacttatttctttcctgcccttctacattgtattaagtcctgccttccagaaagttgtcttgttaatggctcttcaggattgtttgtcagttgtcagctgcagctgaaataggagactgcaacaagagctttgggtcactgtttattgtagaacattattagttgttaaatggattgggactttcacacaggaacttagctaataacctgcaagctgtttggtcacttgctgtcattattttgacttaatgttcccagatattaaatattaatgatatgtacaaagatcccttgaaaccatctttgtattcccaaatgtgactttttttggaatcttctggaaagcctgatgtcatagtaataacatagaacttttacatttcgaaaaatcattcctttcagaataaacatttctgggaatggggtctaggaatttatttttaaccaactctccaggtagttttcaggcagccttcagtatagtaatctctcatactactattttaaaactctgggaatgttacttactaatatcaaaaatggagaagctaggatatccccaaattatttcattagcatgaatgggggaaagtttgcatatatttaagaaagcacaaatgtcttgagtttattaagaatggtaaattggccgggtgtagtggctcacgcctgtaatcccagcactttgggaggccaaggtgggcgaatcacctgaggttcaggaattcaagaccagcctggccaacatggcaaaaccgcatctctcctaaaaatacaaaaattagccaggcatggtggcgcatgcctgtaatcccagctactcggtaggctgaggtggggataatcgcttgaacccgggaggcggaggttgcagtgagcagaggttgtgccagtgcactccagcctgggcaatacagcttgactccatctccaaaaataaagtaaattacagaaaagatatgacattataaatagaagagtctagtggtctatggaccttatgtgagaaccacttgattacttaatagcttagatgttcctgaaatcatttttggtcaaactgaaatttatgaaattcttattttttgttttgttttgctttgcgtagtataatgcttggcaaatagtaggttctcaatttcatataataaacatttaatatttagatacatgagatgatttgtatagggaatcgactctgagtaatgtctttatatatctgttaaaattatttgaagaaatatgtttatattttaacttatgaaaatattttgtcttcttactaatttatcttgtgacagtgctattctttatatattgcatcatttaagttaattaaatgctatttacatgttaaatttttattgaagagtctagtaatgactgcgaagataatccaacacggaacagagggttttccaagagaggcggtaaggaccacattttggaacaatttgtacttaacacagagacactaaactggtaaaactgattttgaaggagctggatgaaaaacactgatcgtgaaaacctttgaagaaaaatactttggtatatgttttctgcttttaatatttgagtgagtattcagtgggtgcccctcctttcactcttttattttatttttttaagtttttggttcaggggttcatgtgtaggtttgttatctaggtaaattgcatgccatggggttttggtgtacagattattttgtcacccagataataagcatagtccctgataggtagttttttgatcctgtacctcctcccactttctaccctaaagtaggccccagtgtctgttgttcccttctttgtgtccatgtgttctcagtgtttagctcccacttataagtgagaacattcagtatttggctttctgttcctgcattagtttgcttagaataatggagctccattcatgttcctgcaaaggactttatgtcattcttttttatggctgcctagtattccatggcgcatatataccacattacctttgtccagtctactgttggtgggcatttaggttgatttctgtgtttttgctattgtgaatagtgctgtggtgaacatatgtgtacatgtgactttatggtagaattatttatattcctttgggtatatacctaattatgggattgctggatcgaatggtagttctgttttacgttctttgagaaatcgccacactgttttccacaatggctgaactaatttacactcccaccagcagtgtataggcattcccttttctctgcaagcttgccagcatctgttattttttgattttttaataataaccattctgactggtgtgagatggtatctcattgtggttttgatttgcatttctctaacgattagtgatgctgagcattttttcatctgcctgttggctgtatattgtcttttgaaacgtgcccatgtccattgtccactttttaacggagttgtttgtttttctgcttgtacatttaatttccttatagattctggatattaggccttcgtcggatgcatagtttgcaaatattttctcccattctgtaggttgtctgtttactctgctgatagtttctttcgttgtgcagaagcttgttcatttaattaggtcccatttgtcaatttttgtttctgttgcggtggcttttggcatcttcatcacagaatcttccagggcctgtgtctagaatggtattttgtaggttatctccagggtttttatagttttaggttttacatgttattctttaatccgtctggagttgatttttgtatgcggtctaaggaaggggtccagtttcaatcttctgcatatggctagccagttatcctagcgccatttattgaataaggaatcctttccttattgcttgttgttgtcaaccctggcaaaaatcagatggttgtaggtgtgtggaattcctatttgcagatggtatgattttatacctagaaaaccctataatctctgccccaaagttccttgatctgataaattacttcagcagaatttcaggatacaaaatcaatgtacaaaaatcagtggcattcctatccactatattgttaaaatggccatactgcccaaagctatttacagatccaatctaccaataacattcttcacagaattagaaaaaaacaattttaaaattcatatggaaccaaaaaagagcatgaataggcaagacaatcccaagcacaaagaacaaagctggaaagcgtcacattacctgagttcaaactatactacaaggctgtaataaccaaaacagcgtggtactggtccaaaaccagatacctagaccagtggaacagaatagagagcacaaaaataatgccttcttttactttttttttttttttgagatggagtctcactctgtcacccaggctggagtgcagtggtgtgatcttggctcactgcaacctccacctcccaggttcaagtgattcttgtgcctttaccctctctagtagctgggactacaggcatgtgccagcatgcctggctaagttttgtatttttagtagagatggagtttcactatgttggccaggctggtctggaactcctgaccctcaggagctgtcacctcagcctcccaaagtgctgggattaccggcatgagccactgtgcctgtccttgttttactttctaatgtcactggatctgttggttgtggtttttttttcccccctatgatctccagaatgtgctatcaattacagaagagggacaatgtgaatcttggtcagttgcaatttagatgaactggggatgtctttgtctctgaatagagtcattggaaatttgaggggggaagaaattgtagattattttttgttcaagtctagctgtatttcaccatactctggtaattcagcttctattgaatttgagatgagattgtatcaaaaattaccatgcttaattcttgattatatatgggcagtcatgttaaaatagcaatgacaacaaaacgtatgaagaatatagtgaacttactataaaattgctgaggatgtgcaaatctatgataagaggttttattgtttggaactacatagtaatcagatacatcagtgtttttaccgcaccttggagacattcttttcctttgcccattaggtaggtagctggctgaattaggccctccctagtgaaggtaggacttgtggatttcataatgagggaagactgtctccttaattacttcttatgataattgtggagaggggtggtggtggggagaaagttaagctaagaaaaaacaagactcatcttttaccatattttttttaacaagcaatttttggcacttaatgttcctaaaacatagctcatatttgaaatttttttcttcagaccagtgaatatcttttgtactattaacatttactttaaatcaatttaattcatatttaaatgaggcagtcgaaaccatttgcagctctatgtgcttggtcctgacttacagattagtgtaggataattagcaggggcacagccattttgcagggtatccctgatttccattctctgtagatgtatacatttgaggataggaagtttgcatataggggtcactcagaaaatacacgtgtgtatatatgtttatattaaaatatgtagacaggtacacataccataagtgtatagttcaattatgtttcacaaactgaactcacttgagttcagtgtgttcaccagcattcaggtcatgaaatacaaattactggcacctcaaaagccccttttcatgttcattttttactcactaatgactcattacccccaaaacttctgttatgacttctaacagcatacgataatttcgtctatttttatacttggtataaatggaatcatatagtatgtagtgttttatgtttaccttcttagtgtgtttgttgcaattgtagatcattattactgtttagtattcttttgttttactgtttttctattagtgataggtatttggattacctccagtttggggccattgtgaaagtgcttctgtaaacattctagtattcttttggttgtcattagtacatactcagaagaagaattgctaggtcataggctatatatatttttggctttaatagtattgtcaaatgttttcagcgtttaaactaagatacactcacattctaaccaatgcttggtattttctttttctctccttttaaccattctgctggttgtgtggtggtgtactcattttgtattaaatttctatttttttggactaatggaatgtggagcacttcttatgtttattggccatttggacatctggacatcttttgtcaagtcgtttgcccatttttctgttgagtatctttacttttacctttttatttgtaaatgatttaaaacttaaaagttgcaagaatagtacatacagataggccggacgcggtggcttatgcctgtaatgccagcactttgggaggcgggcagatcacttaaggtcaggagttcgagaccagcctggccaatatggtgaaaccccgtctgtactaaaaatacaaaaattagctgggcgcatgcctgtagtcccacctactcggcaggctgaggcagaagaatcgcttgaacctgggaggcagaggttgcagtgagctgagattgcgccactgcactccagcctgggcgacagagagagactccgtctaaaacaaaaaaaagtaattgtcattaatctggagtttatttttgtatataatgtgggaatcaatatacattttttttccatatagatgttcagttgacctagtatcacttactgaaaagactgtcccttctgctttgcactacagggctgcctttgtcctaaattaggtggcttatatatgtgtatctgtttctctaggttttattccgttggtcagtttttctatttttgtaccattgccccataatctaattactgtggtttcataataggtcctgatatctggcattgtaagtctttcaagtgcttgtttttcaagtgctatggtttggatgtttgtccttctcatgttgaaatttgattcccagagttggaggtagggtctaatgggaggtatttgggtcatgggggcgcagatctctcatgaatagacctgtttccttgtggggctgttgagtgagttgcctactagttcccttgacagctagttgttaaaagggcctggtaccctctacttcctctgcatcatatgatctctgaacacaccagctccctttcaccttcagccatgggtggaagcagcctgaggctcttcccagatgcccagtcttgaacattttcagatatcaaatcttgagccaaataaaccttttttttcattaattatccagtctcaggtattcctttataacaacacaaaacaaatgaaaaacctcaagattgcctgttatttttagtcctttgcattcctgtgtgatttttagaatgagcttaatcaatttccagaagaaaaagctatcttaatttgcattgctataacaaaatgctataaactgggtagctttgtaaacaacagaaatttatttctcacagttctggagagtcagaagtctgagatcaaggcaccagcagattcagtgtctggtgagggcccatttcctggttcatagatggtgtcttctctctgtgtcctcacatggtggataaggccaggcagctctctggggcttcttttataagaacactaattccattcatgagggctctactgttgtgtggttacatcacatttgtttattcttcagctgatgaatgtttgagttgtttccacttttgggctatcatggctaatgctgccgtattcatttgtgtacaagtttttatgtgaacctgtgttttcatttttctggagtatatacttaggagtggaattgctgtgtcatgtgctaactcttaatgtttaactttttgaggaactgccaaattattttctatagtagctgtaccattttatattaccactctcaatgttatgagggttctgatttctccacatccaccgatactagttattactggtgtttttttaattatagccattctactgagtatgaagtggtatctcattgtgggttttttgtttttttatttttttgagacagggtcttactctcacccaggctggagggctctgtcacaatttcggctcactgcagcctcaacctcctaggctcaaataatccttccacctcagccctctgtgtagctgggactacaggcgtgtactaccatgccctgctaatttttgtatttttttagagatggggttccactacattgcgcaggctgatattgaactcctgagttcaagcaatctgcctgcctcagcctcccaaagtgctgggattacaagcatgtgtgccacagtgcccagcccttattgttgttttgattgcattttttgatgactgtgatgttgagcagcttttcatatgcttattgaccatttgtatatctttggagaaatgtctttcagatccttcactcattttaacaattgggttgtctttttatgttctaagatttatttatatattctcaatgtgagtatcatcagctacctgatttgcaaatgtttatttttttttaatttatctaatttttttttttttgtttttgagacagagtctcgctctgtcacccagactctggggtgcagtggcacagtcatggttcatgacagcttcaacttcctggtctcaagcagtcctcccacctcagcctcctgagtagctgggactataggcatgtgccaccatgcccagctaatttctttattttttgtagggatggggtctcactgtgttgtccaggcttgtctcaaactcctgggctcaagcagttctcccttcttggccttccaaagtgctcggattacaggtgtgagccactgcatctggcctgcaaatgtttaataacctcctgtgggttgtcttttccctttcttgatagtaccctttgaaacactaaaatttaacatttttatcaaacccagtttatctttttatgttcttttggtgttataactagaaaactgttgcctaatccagagtcatgcagactttttcctttgtttccttctaagaattttatagttttagttcttacacttaagtctttgatgcattttgaattcatttttatagatggtgtagggtgggggtccaaattcttttgcatatggatacccagttgttctagcaccatttgttgatgttttatattgatgtgtctagatgtggatctttttgggtttaccctccttggagttgagcttcttggatttatagattaatagttttcatgaaacttgggatattttgagcttttttgtggtaagatctctataacataaaattcccatattaactattcttaagtgtataatttttggcattaagtgcacagtattctgtcatcactatcatcacccagatagaaactttgtattccgttagacaacaattccctgtgtactcccttaaccctggtctttggtaacctctattccatgttctctatgaaatttgtctattttaggtatttcatacaagtggaatcgtacaatatttgtcctgtcgtatttggcttattttacttagcatcttgttttcagtgttcatccatgttgtagcatgcatcaaaactacatttcttttaatggttgaataatataatgtatttaccacattttgtttatccatgtgacggacacttggattgtttcttctttccgactattgtaagtccgctatgaacattcacctacagttatctgtttgagtccctgttttcaaatcttttggttatatacttacaagttgagttgccgggagatggaactaggtaagttaaaatgctgcgaaatttgctgtttaaaagaaaaaattccctgggttgcttcaagccttttattgatttctagagtttggaaaaagttaattctgacagttcttgcccatttttttccttgcctttttggagtagtggaatttagagttccttacttggccatttttgctgatatcagtgatacatatcattttagtgttttcattttattcattagtatgtagaaatataataactatctggtaagtatttttttaaaaagtaataaaagatgttccattttcttttatacaaaggttagaggatttataaggtaatttctttctgaagatattgtcaccaaacatctttaagagttagattgtcagctgtcccttatgaaatgcagactataccttctgggaggactcaggttactttaagaaatatattttgttggccgggcgcagtggctcacacctgtaatcccagcactttgggaggccgaagtgggtggatcacctaaggtcaggagtttgagaccaacctggccaacatgttaaaaccccgtctctactaaaaatacaaaaattaactgggcgtggtggtgcagccctgtagtcccagctacttggagtctgaggcaggagaatcacttgaacccaggaggtggaggttgcagtgagctgagatggcgccactgcactccagcctgggtgaccgaacgagactctgtctcaaaaaacaaaaaacaagaaaaggactcaatttgaatttttagaaacttacagaaaagaacagagtgattaaaggtaaagattaaacacagatgaagagaatgaattaattcaaagataaatctgtggaaattctctaaacttggaaatggaaaacacgagagtggttaataaataaggtatggaagatagactaagacctgtggttcaacatatgactgtctcctgaggagtggccagaaaatgggaggaggacaggaaagaagaatattcaaagagaatagatgagacttttccagagttagagaggcacaagagtcctcagcaaataaaattaaaaaattcatacccttatgcatgtattgaaattatagtattacaaagattttttaaaacctataaaactactagagaaaaaaggtagattcacctttagaagaacattatattcacaacagaattttcttcagtaaaggtagatttcagaatgtaatagcatagtatattcagaatgctgaaggagaatagctctgaatccaaataactatattcagataattaggtgccagggagaaataatgccattcagataaaaatggtgtttaatactctcatattgttgagtaagaactactaaattgtatacagtagtaagacaactgattgcaggaagaaaggcataggaaacaagaagcaatgaggagcgaaaaaaaagatatgtaaaacaggtaaacatattggtaaacttaaataagtattgactatataaactagcaataatgactattaatttaggggttccagaaacaaaagtgaattaaaatactagcaaatgaaaagactgaaattcttgccagctcagttgaaaggaaaaatatttcttaataagtaaaatgaagggtaatcagagaagggataagataaaatgtgtaacttgctgatggaggaaatccaatagaaggacagagctttgtaggaaggaaggtagattgaaaatagtttatttcctaaatattcgtggtgaaaattggtaaaaataaaatacatagctttaccatttggggaaaacaggacagaaaggagaacaaaaagcatcgaaaaaactctgtaaagagaaaacacaaagattgtagaaataaaagacctatgtatcagtaatcataatataggtaagcatatttcaatatggagttgaaagtaaagaggtcaggcatggtggctcatgcttgtaatcctagcattttggcaggccaacatgggagggatctcttgaggccaggaattcaaggccagcctgagcaactaaatcttgtctctacaaaaaaaaattttttttttaaattagaaaataggctatggccataccaccctgaacgtgtccgatctcgtctgatcttggaagctaagcagggttggacctggttagtacttggatgggagactgcctaggaatactaggtgctgtaggtgtcgggggagggcaggtgggggaagagagcattagggaaaagagctaacgcatgctgggcttaatacctaggtgatgggttgacaggtgcagcaaactaccatagcacacgtttacctatgtaacaaacctgcacatcctgcacacgtaccctgaaacttaaaagtaaagagaaaaaagtgttcagtaactcaaagctgaatagaaatagagacaaagtatactgtaaggtagaattattaaggataaattcatcaggaagacattatagttctgaacatggttctaatctaacaatatactaagatgcacaaaggaaaatagacataaggaaaaattcgcaaatcctagtaagttgagacagcagaacagagattaataagaatatagaagatctgaatgccacttactcagcttgatttaatatttgtttggaatcatatactctaaaattataaatcatatatttttccagcatgtatggaaaatatgtacaatttgatcatcttttaaggatgacctatgataaatatatcataggtcatgttctcttattaaaataaaagaaatcaataagtctaaccttcatgatttagaaactgaatttctcagtttatgaataacagttcatatggaaatcctgaaatatttagaatttaataacagtaagaacagagcacatgaaaactttgaggatatagttaaagcagctgcctcttagaggaaattttatagccttaaatgcatcagagaaaggataaaatgtaaaacttgctaatagaggaaatctagtaggacagaactttgtaggaagaagactagattaaaaatagtttaaatatttcttttctcagaaaaaataatgagttaagtgttcaagccaagtagttagaagggagaaaactcaaataaaaaaggtagtagacataaatgaaatagaaacagatacaatagagtgttcagcagtaaaagaaaatgaggtagtttcatatgtcaacaaagttgaataaaaggaaaaagacgtggggccaggcgctgtggctcacgcctgtaatcccagcactttgggaggccaaggtgggcagatcacctgaggtcaggagttccagaccagcctggccaacatggtgaaaccccgtctctactgaaaatacaaaaattagctgggcatgttggttcatgcctgtaatctcagctacttgggaggctgagacaggagaatcgcttggactctggaggcagaggttgcagtgagccgagatgatgccactgcactccaacctgggtgacagagtgagacttcgcctcaaaaaaaaaaaagatgtggaagacgataagttccatttagttcgtaaaactctaacataacactaatatgttgcttaaggctaagtacatagttgataaaattaagagcaaggaaatgaaaaactattcaggatattggcttgttggatgttagttggaaggagtgctcagggagaagagaagcatagggcaaaagaaaaacatgggctgcaaatatgttggaaacattttagtcttaatctgggcagtggagataagctttcattttattatatttttaacttacatatgtgttcttttactttcatgaaaatatacctttacagaaaaggttccagaagatacaatttttttgaagagttttgtttcatttttaaataggttttaaaatacatatactctaatattcagaaatagcatatatagaatttatctttattcatcattctctttaagtataaatagttgcaagtttacaaacggaacagtctttatttcctgcccagttggcactttggttttgcattaatctggttctgccctatgagtctgccctatgagtctgctctatgtgcaattaaattttacttgaactgcttctactaatcttttggtattcaattcaattaaaaattgttcttacctggaaatcagactttatatgtgcctgcatgtctgtgctttgagtaagatgtttactatattctatatggagcagatacaagcctaggatttatttaattcttttgtgcattgtggaaatccagttaatggtgcagttttggtgacttttagtgttttaattcaagtgctactttttcctttaggtgatttttagacttgattctcaaagcaagcagtgaggttttaaaaaattgtagccatatctatttatattagtaaaattgaacacttaataggtcaaaatgtcatttctttttgacaacaatgcctttaaacacttgtttaaagttactgaattattcaaggcttaaattaaatttgaccatgtccccaagatttctttgttgttgttttgtgttgttcttgtgtgtgttttaacattataggctatcgagatggaaataattcagaagcttcagggccatacagaagaggtggaagaggtagtttccgaggttgccgtggaggatttggtctaggaagtccaagttagtactggatttgcaaatgatgtgcttcattaactgttaaaaagaaaatgatttaaaaaaatacgtatcaaagaaggttgttatgaggattatatgagaatagcttagctcagtgactaatacacattaatcaccacattgtatataacattattttttagagagatttgattgcatattggttaagttaaaatatatgaatttaaaaaataagtttgagtgactcagtactttaatattacatactgttcattgttttagagctttgataatatggctgaccttataaacaggtgaccttctatgtggctttacctccccacataccttctttcaccagtgtggctttctaccttaaatttttccagccatcattttttagagataaggtactgacttcagaggtcactgttggaatgtatgtgcctcttaacagaggagaacagatttatggttttggaagctaaaaacataaatttgtaataatgatttaatagatgcgtagcagactagtgaattgtcactttcacagaagtttagggattttgaagggttaccatgcaggactggtaaggtttgatttggcaacagtgggagcaaggggtgctattttgaagaataagtagtgaaatgatgcaatgtgaagtttctcaggcaatttctagagatttaacttgcttgtatcatattttggcatagcactggccctaatttatttaacgaaatattttaaatacattttgaggaagtaatttatcattgaaggacattatttgtagagaattcctttgcacaatacttagtttaacttggtttaatagaatagtttaacttagtttaatagaatagtttaacttagtttaataggacagtatttttctattttaccctgcatcttttaacttctgataccataacttgatttttttctgtttactgaacgattaaaaaacttcttcaaagtaatgtaatctaattttactttctgcaaatcaagataatgacttagacccagacgaatgtatgcagcgcactggtggcctttttggttctagaagaccagtattaagtggcacaggtgagaaatagaacttattactgaatattagttactgatgtatgtttttagcactaggattagtaaacctaatatatatgttaaagtatactagtttggcttatgattttctctgcttttagatctgtaggtaaaaatatgtggacaattttgtctcccttataaaatttgtgcaatgtgaattatttattctgtgttatctaccagttaatttgaggtgtgaattattaactagaggaataaaggattctgagttaggggaaaaggatttgtgtgagttgaagtgaaaatgaaaacacaattgatgaaaaatgttcaaatgaggttaaggttaaagttaaacctagaggccgggcgtggtggctcatgcctgtaatcccagcagtttgggaggctgaggcaggtggatcacttgaggccaggagttcgacaccagcgtggccaacatggcaaaaccctatctctactaaaaatacagaaattagctgggcgtggtggtatgtgcctgtagtcccagctactcagatgcctgaggcatgagaattggttgaacccaggagatggaggttgcagagagccaagatcacgccactgcactccagccttggtgatagagtgagacttgaaaaaaaaaaaaaaaaagttaaatctaaaattaagagatggatgggttaaaggaccaggattcctaagtaataactttgttgaatagaaataacaacatggtttgtgtgcttgagcagcagctgtgttttatctaaatatgttgtgaaacaatgccttacaggtaatggtgatacttctcaaagcagaagtggcagtggaagtgaacgaggtaagttcttattttgtttacccgaaagaagttaaaatcattgtattccaaatttaatttttttctgtacttcactggttggaaacaaatttaatttttgaagttaaaggtaactgttattgcttttatacactgtgaggaccataaatttacacagcctgttttagatagttccttaataccctccaggttattgcctctctgatccagcaattccattataggaattatatactatagatgtatttggaaataaatgtacaaggatgttcactgagatgtcatttataataagtaaaaactgaaaatcacctaaaattcataaataaaaaactgtttaagtccgggtgcggtggctcatgcctgtaattctagcactttcggaggcctaggcaggcagatcagaaggtcaagatgagaccatcccggccaacatagtgaaacccccgtctctactaaaacaaaacttagctgggcatggtggtgtgtgcctgtagtgccagctactcaggaggctaaggcaggagaatcgcttgaatccgggaggcggaggttgcagtaagccgagatcataccactgcactccagcctggtgacagagcgagactgtcaccagttttttgtttgttaaacaaaaaaaaactgtttaataaaataataatcatgaaatgagatgctgtgtggaagttaaagacagatataatatgtacaaatccttattaaaacaatatgctttttcttatggaatagttgatttggtctgaaggataaagttagctcaatatataattttttactcttaaagttttttcttttctttttttttttttttgagacagagtctcactctgtcacccaggttggagtgcagtggtgtgatctcggctcactgcaactatcgcctccagagttcaagccattctcctgcctcagcctccctagcagctggattacaggcacctgccaccacacctggctaatttttgtatttttagtagagatggggtttcacctttgccaggctggtctcaaactcctgacctcaggtgatctgcccacctcagcctcccaaagtgctaggattacaggcatgagccactgcgcctgaccttaaagttttttcaaagtataaatacttcagtgtcatataaaagttaaaatgctctccagactagtaaatcaatgaagcttgctcgatgtatttggaagattctcagtaattattattagtctgagagaattcagagtgacatttcccccacccctgctgattcttggattcttcaatatagaaagagtttattaaagactagctaaaccaaatctcctacaaatattcacagcctatatgaaggaggatttcaagacctgtggacatacaagataagaaaattagagttcacatataaaaaatgttacatctcattagcttttgaatctaatgcagtcatagtacctaaaagtggaacaacagattactcgttatctaaaaaccagaaaggtaatatatagaaaggagttaacaggcctgattgttcatcaaaaattcatcagtaaacgaaattgaaaatcttacttaaaaggctgttccttggctagtgtatattagttagggttctccacaaagacagaccaaaaggaaggagggaggagatggatggatggatggatggatggatggatggatggatggatgaatggatggatgaatggatggatggatgagaaggaactaattaggggaattggctcgtgagattatggagcctgagaaagtcctatgataggctgtctgcaagctaagaaccagggaaaccagtagtattgttcaattcaagtccaaaggaaccagtaaagttttttttttttttttaatactttaagttctaggggacatgtgcacaatgtgcaagtttgttacataggtatacatgtaccatgttggtgtgctgcacccatcaactcatcatttacattaggtatttctcctaatggtatcccttcccctgtcccccaccttccaacaggccctggtatgtgatactcccctcctcgtgtccatgtgttcttattgttcatctcccacttatgagtgagaacatacagtgtttggttttctgtccttgtgatagtttgctgagaatgatggaaccagggaagttgatggtgtaactctcagttcaaggccaaagacctgagaacctcttggtggggcggagtcagggggcgggggattgctggtacaagtcctagagtccaaaggccagagaacctggagttctgatgtccaaggacaagagaagaagggtgtcccagctccagaagagagagaaaatttgcctttcctctgcctttttgttctgtctggcccctagcctattggatggtgcctgcccagattggatgagggtcgatcttcttactctgtccactgatacaaatgccagtctattctaaaacaccttcacagacatacccagaaataatggtttatcagctacctgggtatcccttaatctggtcaaattgacaccgcaaattaaccatcacagctagcatctgaaaacttggatttgggacgggttcccaccatcctgattggtaagagcaactcattgtgtgtaaaccatttgtgcattgtggtttttgctgaatatttgctttccttctgggaatctggaatttggtatgtgccaggcagaaggtgagtacattattagcccctaataaaaaccctgggtactgagtctctaatgagcttctgagtctctaatactcttctctggtagagtttacatgtgttgtcacagctcattgctgggagaactaagcacatcctgtgtgactgcagtagaagacacttggaaactggtgcctggttttctctgggttttgcctatgtgccttttcttctgctgatagtactccctattttttcactaataaatcataaccatgagtatgactatattctgagtctggtgagtcttcctagcaactactgaactgggaatggtcttggggacacccctccaacacaggttcttttagaaaatacattcctttgctgattaggaaagaaatataacagtttaaacaaagtgtagtaatatgtaatagtctcctctacgtaaaatcatcttgaatactacagaaactaaaaatgtacaaggttctatttaattgtttcaagtatttgtaagaagggaatttaaagttttttggaacttgttctctttgaagacaagcaacgaaaataaagatgtgcacagccttacatcttgaccgattgtcacttatgaatttctttaataggtggttacaaaggtttaaatgaagaagtaataacaggctctggaaagagtaagttttccttaaacaaggtgtttgatttttatagtgagagttcttttacctttcaattttaaaaaacatgtatctcttttttatttgatcctcttcaagattcttggaagtcagaagcagaaggaggagaaagtagtgatactcaaggtatattaacatttgtgtgactcacatagaagtatgttgtgttttaataatgcttaagtattttacttaaaaacaaagttatcttttaaaaatttgaacagtgaaaactttaaaggtaagcagtgggaagttccatagtatttaaaatttgatcttgtcaatttttgtctattttctcttatattttcttgtagtctctgtaacgtacattatgtttttaatttaaattccaaggaccaaaagtgacctacataccccctcctccacctgaggatgaggactccatctttgcacattatcagacaggcataaacttcgacaaatacgacactattcttgtggaagtgtctggacatgatgcaccaccagcaattctggtcagtgtattaattgtttctgtattagctatgtagcacactttgcctttaaaatacattatgtagtttgtaaagctgatatcaacacatagatttcacctttcgtatataaggtcttaggttggaaatttagaatgatgtcttaccatctataatagaattaattgctatgtcaaaagagagtaatagatttcatccccactccccataccaggatgagaattttatttaaacttacttaaaaaatgcttttcctagtgattcaagatgttttcccaagattgtgagaaagtgtgtcttagggcagtgatttttctgagagggggagccctctgtctcctattgataattatacttagaacaagccattactgagcagaattcttcatatctcataggttttaagggggcaggaaaaatgtttttaaagccaccatttgtggagaatacttcatgattctgtcaaatcatattataatatacaggctttgaatatttacttctgagtggaggcatgttactaaagtcactttagtatataaagtagaattaacagaacttggaaagtagctcgaatgaaatatgcttataaatgatctgcatatgatatatagaatgtaatcactgcttttttttaaattttcagacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgtaagtctttccccacatgtccaaactgttaggttttttgagctttggttcttccttagtaacttggtttcttcttttgagtagaaggtttgtagatggtttcagttacctgtcataagtattgatggttttgcttctgatttttattaggatttgtgtacttcggaagaaagaattctgaactattcctggggtggtgttgctgtccatagatgtttaatcttttctgtgtgcagctctttctgaaacatggtagtatcttaaacaaagtgactgaaagtcaaagcagagcttataaaacagagagggagaaagtaatttctgtattatagctggtacactcgaagtcaaaagattaaagaatgagaaacagttatgcattgtgcatgattccttagtattcagtgacctcaggttatgctaattataaaagaagtctgatgaaaccagttggttttaggactaatctgggagatttgtgtgttaattaacgactccataagatgagactcttatttctatgatcatagagtccatgaggtcataccattttagtcttaatcagccttcatagtagaattgtagggaaaaacaggtattgtatagcagctgatgagagtgttaaacgtggttttggaggtggattttagcaagtgtcttatttgcttaaatgagaaaactgtagcacaaaatttctgttgccagatgtaacttcaataagggtaatgtgttcagtaatacagatgatgatttctaagtttttactctgtgggccacttttgtcatccattctgaatgataattttatgacctcaaaaggactaacttagagtaattgttcactgtaatgatttgcagcgattacatctatcatattcctctataaatatgctaatgttgttgatctgtttagaattcgtgggtatgcttttgaaaatacactgaaaaactttgataggttagattaattttaccaaattttatattgtataataagagcataaagacataaatgttaagaacaccttgaaatgaaagttgttttcatttctcatcttaaatttaccagtaagatggaagtagagtctaaaggctataaggacatgaggattagctttccatagggataaaagtgttgtgctataagtttgtaaactaagcaacttaacttctaggcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggtaagtacatcagagtgctactcacaaaatagttttttctttagagatttttttcccctcacttttggaagaactcagtaataatgcactcatgtaatttttagcattacttaaagtatttttttattatcttgtttatggaatccttttcatttttgaaaagaaatatgcttattaaaaattaggttaataggttggacttggtggctcatgactataatcccagtgctttgtgaggcccaggcaggcagactgcttgaggccaggagttcgagaccagccagggtaacatggcaagaccccatctctacaaaaaataaaataactagccagcatgtggtgatgcacacctgttgtcctaggagtttaggaggttgaggcagaaggattgtttgagtccaggagtttgaggctgcagtgaactgtgattgcaccaccacactcagagcgagaccctgtctccaaaaaagtaaaattttaatttaaaaaacagataatactagaagtagaaaatagtgaacatactggtattatttcttggtagtttttaatgtatatttaaaaatgaactcagggtattctaataatttcctattcttttacataaaactttataacacagaaaattcttatttcataataagaactgatttttaatgacttttaaattgcccatgtgtatacattttatttctctgttctgaggtatttaggttctttctaacttggggctattgtaaacaaaattgcaatgtacatcttgctacatagtttttctgttttggccagatatgatgtcttacacctgtaatcctagcactttgggaggccaagatgggcagatagcttgagcccaggagttcaagaccagcctggaaaacatggtgaaaacccatctctacaaaaaagaacaaaaactagctaggtgcagtggtgcacccctgtagtcccagctacttgggagcctgagagattacctgagcctgggaggtcgaggctgcagtgagctgtgattgcgccactgcattccagcctagatgacagtgagaccttgacttatatataaaaaaaaccaacagttttctgttttaagtattttcttagaatagagttttatcaattttaatgttaaagagcaggaacttattttaaagcttgtaattaatgtatatttgtgcctgcagtctatcagaagtccaatttcagtataccctttgccaacatttagttatcgctgcctaacaaactcccttaaaacatagttgctttcaacaataaacatttactgtctcaccattttgggggcttaggaattggggaacagcttggcttagctgggtccttctgagttaagagtttcttatgagattgtaaacgagatgtcaaccaattctggttttattgtcaaccagacaagatgtcaaggcagtcatctgagggcttcattggatctctccatagggatgcatgattaaatggcactggcttcccctagattaagtgatcagtaagaacaaagaggaggctgtaatagcttttatgaaatagtcccagaagtcacacattgtccttctgccacattctctttgtaagaagcaagtcactaagtttgaccccactcaggagtggctatattataatttattggaactagtgcaaaattgaaagtgcagggtcctttgttgtaaaattattacaaatttcaaggcagcgacaacagagcattaaatgaaacacgggattcttctgaacttgggactctgtgtgactggacaggttgcacactcatgaggccagccttgcccacactgaagggggaaggtagaatccatatttgaaggaaggaatatattgaagaatttgtatatgtatgttaaaaccaccacaggtgattttattcttttccatgcttgaaatcactttaatatcaaacctgatagatcttttggaaaaacatgtggattgcttatttcagtgtttatatcttgctaatcctcatgtaacatgttgctttcaggcttttaaatcaagtaaaagatctcagaaatcaccactaaataacttatccatgtaacgaaataccacctgttcccccaaaagtattgtaattaaaaaaaaaaatcaagtaaaatatcaccttttttttttttttttttttttttaagatggagactcgctgtgttgcccaggctggagtagagtggtgggatctcggctcactgcaacctctgcctcctgggttcaagcgattctcctgcctcagccacctgagtagctgggattataggcgcatgctaccatgcctggccaattttttgcatttttagtagagactggattttaccatgttggccaggctggtctcaaactcctgacctcaggtgatttgcccgccctggcctcccaaagtgctgggattacaggcgtgagccactgcacccagccagaatttaatatttttttagatagttgaatgtttgtttttttctttttggattttgttttatatcttgttagaaacagatgcctaatttttaagtaactagaaaataacatttagttttcttgttaataggacttgtgtaagagctgttgttatatatgggggaacccagctgggacattcaattcgacaaatagtacaaggctgtaatatattatgtgctactcctggaagactgatggatatcataggcaaagaaaaggtacgccttataggaataatgaagttgtgagattgatactttttgtttggtatgggaaaaggaaagaatgaggtaaagacagatgtatttagtagagcactatttatgtgttagcctccatcacattctttgaatgcattcttatataattctcaagataatcgcagggaatagtgttttctaatttatacttgggaaaacaaactcaatgagattatgtaatttattttaaaaatccctgagttagctctagtaagtatagagctaatgttagaatctgggtctgattccagaatccatattctacatcccactacgctgggggaaaaatgtagttaataactttttatctggtttcatacatgtcttggggaaatagtttttctcctgtaagaaaccctttgtggcatcaataattctgtctcctatgtaagcatgggaatgatattaaccaggattgttaattttctaaatctttaaaaagattttagggccatgtacttatttaggaattcatatactatatttttgtatctctcaatcagtactttcagttcaccttaatgaaccagatttgctttttaaaaactctttaaagggtgcttctgagttaagagtcattttcatccctctgggttactcaaaaaaatgttatttctgcataaacacacctttcttagtatacttattaaaaggacccagagatatctaccttactttcttgctaaacatcttcatagtggtaccaaaatcactttgcaagtgtgttcttctgtttatagtaaaagatgttcatgcaaaggtaagaggttcctgattgttcccgagtgattagagaatggagaatttactaaggatttaaagaggttagaaaaaattttaccagttagaagatatttgaatatgtcatgctgttaggatattttctttcttacattagagtctaactttatcaaatactataatctagatctgtattgtccaatacagtaaccactagccacatgtaacaatttaaatttaagaatgataaaaattcagttccaagtcacagtagccacatttcaagcgcctaatagctagctacctttggctaatgactaacacgttaaacaatgcagataggctgggtgcagtggctcacgcctataatcccagcactttgggaagccgaggcaggcatatcacgaggtcaggagatagagaccatcctggttaacatggtgaaaccccgtctctactaaaaacacacacacacacacacaaaaattagccaggcatgggggcatgtgcctgtagccccagctacttgggaggctgaggcaggagaatcacttgaacccaggaggcagaggttgcagtgagctgagcttgtgccactgcactccagcctgggcaacacagcaagactccttctcaaaaaaaaaaaaaaaaaaaaaaaagcgcagttaatagaacttttaagtaattgcagaaagttttattgcacagtgttgatctagacatttggtttcttttagacttaattttaaaaatgctttataacagaaaattgaactgaaatatacagtaatattatctaagcatatcaattctcattttatacactaatttctagtcttttttcttaacagtattttatttttttttatttttatttttttcttttttttgagacggagtctcgctatgttgcccaggctggagtgcagtggcgcgatcttgctcactgcaagctctgcctcccgggttcacaccgttctcctgcctcagcctcccaggtagctgggactacaggcgtccgccaacacgcctggctaattttttgtatttttttttttttcttaacagtattttaacagttggaattgtagagaatagtttaatataaactaatatgcattttctgttttacctttgaaaatatccttaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttaagtttttttcttaaaaataatttaattatatatatatacatacttttatcaaagtggaagcactgtgaatatcctatttttagagatttgtcgttaagattttaatataggtagtttaaaaagtagatgtatttctaaaacgtttgccacattttccattgtttcttacctttattcctggctttgtgttaacatcacattttatttaaaaagtgtgtgtgtgtgtgtgtgtgtgtgtgtgtgtgtgtgtgtgtgttgttgttgttgttgcatagaatccagctagggtttaataagtgcttactaaattaagttatttttattattatgccttcttttcaaacctaaatctataggatttgggagaactgaggctttggtagaaaattcatataccaattattggcagatatttgaggatcatgttatataccatggggtctaatgaattcagagattagggtgacacatccctactggaatggtgactctttttcctgccagccccttgtctcaaggagccagaagtgcccaggcaacagcagaagcttatacagatgggtcctatggttcaacataagattttatgatttttttactttataatggtttatcataggtattaattgcatttttgacttaagatattttggacttaaaataggtttatcgggatgttaaccctgttgtaagttgggaaccatctgtaattcagcaggactcttgctattttctctagtggaactgcgttctctttgggaaccaagacgtcaaaacctgtagaacataaagttggaggacaagaagggatgggaagcatagatttccctagtgggtcattgagagtgatggtaggtgggccagtagtgcttgctctcctggattcccagactcatgcaccatatatggatatttgatttgaggaattaccgtgtcatgttggataatgccctgtcttcataaagagttgcctccaaactcacccttgaactgttttttctgcagacagttccaatgttccaatgttctctcaggttggcagcttctgagtggtgcagtatatatattacctgtgaatcctatggttatgggcctgtcccaacacctcttttgctttaaagttggtcccctggtttgatagaatgttacatgggatcctgtgctagtatatcaaacattcccaaacccttgaatagtggtgctggctattgatttattttttatatggtaaatctttgtgtaaagttaggaagagttctttattgggggaaaatagaactcataagacagcattaggtcaattggcaggatatttttctttcttagtggtacataaaacaatcatttcttaacaattgaatagtattttctttctttttttttttttttgtgatgaagtcttgctcttgctcttgtcccccaggctggagtgcaatggcgcgatcttggctcactgcaacctcaatctcccgggttcaagcgattctcctgcctcagcctcccaagtagctgggattacaggcgcctgccaccacgcctggttaatttttttttttttttttgtatttttagtagagacggggtttcaccatgttggccaggctggtcttgaactcctgacctcaggtgatctgcccacctcagcctcccagagtgctgggattacaggcatgagccaccacacccagccctatatagtattttcaggtggaaatggggtatttgcattcccaccatttgctttggtaactatctaattagcagcctgactctttttagattcaccctgaaatgggaaagtatttgtatgttggccacccaaaatggcaaacgtactattgtcagtcagtaatatttgtcgaggatcttttgtgaatcatatttgattataagctctggggatatatgttaaacaaaataagctcctatctgaccttgagttgtttacattctttgcttcctgactctccctcagttgcttcattttatctgttcttaaatgttaccagttgcccatcattctgtgcgaagtccttttctcaatgtgcatattccctgagttatgatatatccgttcccttggcttctacttatacctgtaactctcccaaatttcttccctgtattcctaatctctctctgtagccccagaccttttttttttttttttcttgagacagagtttcgctcttgttgcccaggctagagtacaatggcacgatctcggctcaccgcaacctccgcctccagggttcaagcgactctcctccctcagcctcctgagtggctgggattacaggcatgtaccaccacgtccggctaattttgtatttttagtagagatggggtttctccatgctggtcaggctggtcttgaactcctgacctcagctgatccgtccgcctcagcctcccagagtgctgggattgtaagcgtgagccaccgcacccggcccagacttttaaatttaacttcttggggtgtttgttctcccagatgaatgactagtaactcacgttcatgtccaaaatagaacgtaatttttcttcagttccctttttcccgttttctttattctggttattggcatcatgatcttttaaagccagaattgtttgaatcgtggtgattcttctctcacagtcttttaactccgcttttaaaaatactgaacttgggccaggcgcagtagctcatgcctataatcccaacactttgggaggctaaagagggagaagcatttgagcctagaagttcaggcccagcctgggcaacatagtgagaccctgtctctataaaaaacatttaaaaaattagctgggtgtggtgacacgcacctgtaggttcagctactcaggaggctaaagtgggaggatctcttgagcccaggaagttgaggctgcagtgagccatgattgtgtgcccctgtactctggcctgggcaacagactaagaccctgtctcagtacaacgtggcagtgatattagggttctccagaaggacagaaccaataatatatatgtagatataaaaggaagtttattagggaaaattggctcacacaatcacaaggtgaagtcccatgataggctgtctgcaagctggagaagagagaagccagtagtggctcagtccaagtctgaaagcctcaaaaccaaggaagctgatagattcccccaagaagctgctggtgcaagtcccagagtccaaagtccaaagaacctggagtatgatgtccaagggtagtaggagcagaagcaagcatccaacatgggaagaagaaagagagccagaagagtcagcaggcaaagttatcccaccttcttctgcctgcgttcttgtagctgcgctggtagccaactggatggtgtccacccacattgagggtgggccttcttctcccagtctaccaactgaaatgtcagtctcctctggtagcaccctcagagacacatccagaaacaatgtttcactggccatctaggcatccctcaatataatcaagttgacaccaaatattaaccattacggtagtaatctctaaaatatttcacatctgttagcttctctatttcccaccttaatttaggtccttatcaattttgccctgctcactggaagtggctttttaacctgtctccctgcttctagtgtcacttctgcattagtggcaatgccaaaataaagtctgattcttttaaacatttatttaaaataaaccttcccatatctttccatcttcatagactgatttttaaactctttaacacatgacagtctcaggctcacctgctactttcttacctggagtcgtgtgtttctagtctactagagctatttcctcttggctgagaaagctgaattttactttcctcattatttgtgcttgtttcttctttcctactgcttagaatgcctttccacaatcattagtgttccacattcttgcctgctgcttccctagatcaagcttcaaacttgaagacttttcttttctttttttctttctttcttttttttttttttttttttggagacaaggtctcactcttctcgcccaggctgaagttcagaggcacaatcatggttcactgccaccttgacctccctggctgaagcgatcctaggcccacctcagcctcctgggtagctggaactacaggcatgcgcatacacacctggctaattttttattttttgtagagatggggtttcaccatgttggccagaatggtctcaaactcctgggctcaggtgatccacatgccttggccttccaaagtgctaggattgtaggcatgagccactgtgccccgcctcaaactggaggatttttctaaatagacatcatttcatccatttcctgccagtgtatcttgtgaaagaaactgtttaagtcactttgcacatttcttggaacatagtgttcagtaaacattaactattctaacactaaactgtaatttttcttaatatatctttcctacttgaagtgaggatctcataggctaacaccatcatgttcatctttgtactcccagtaccttgtacacatgacacaaaacactcagtagttttagtgaatgaaaagggtgatggataatcatctgaagaatttcagatgatttcaagatttgtgcctgggtgagagagtgactctaaaagaaggtataaaaaagcttttcttttatgataagagatcaagtaaggagaaagaagaagcagtgatttattaagagtctggatatgctgaatttgagctgttttcatgaaggactcagctggtaaataagggactgctacataggagggagaggcattgaagagagatttgggcctccccatttatccctaaaaactcatctttctcattagcaactttgtccactcccctatatttctatgtgatctaaagcaagacttctcaattgcagctgatagtgagttaactgtgtgtcaagatattgatacccttaacctttggggcaggcacacctatcctgattccgctatgtccctgggcctttcatctcgtctcacttgttttgcccaattgtgctatgcaaatactactttctatgtgtgtcgtgacagacagagcactgacctaagatctggtttgcttgaaatcattcatttgaagtagagtaatttaataggtaatattttcagaaaacaactaataatagcataaataaaagcaatgagtggagaacagaatttgtgtctcaggcttacatttcaggttttactaaaaaataattcctgcttattgcagtttatttcttttagttcatgcttttttttaagtgttatacacatattttatatagttttgcgtggatagcaaatccacttgtaattaccatatccatactttgacaaactttttttctagtagttatgtattttgcaaaatcctaatattttatactgatctttcacaatagtacttgggtgatataagtaaccaaccatcttatagctgttataatctgctgtctgattaatattgagataacacctacaggaattcagtggatattatggatactgatggagaggaggataagttaaagaataatcttttgtttttcaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggtatcttacgttgatacatttttttgtcatgattttgattttttttaatgaataatttaaaaaatcactaaagaattgtttggtctgacttttcataagtttgttttaagtctctctccctctaaagctcttttataaaaaattttatgattcagttttctgggtaaattatataaaaatatggtcgtttctccaccattaagtttgaaaataggaaggatttgagacttcattttaactattccaccagaaatgtatctattttttgttttaggaaactagaaaggcttagtagtgacacatatttacatcacactattactccatcaaaagcagattgtttttctgtttctggttcctagctcttgcttcctaaggcttcccaaattcatagatttgaataatttttttagctaaaaggggcttaagatctagttctcttccttcacaatatctgtgggaatttttttttctcctctactcccccaatcaatttttatttttattatctttttagagataaggtctcactttgttgctcggcctgaaataattgtgtagtcatagcttatggcagcctcaaactcctggcctcaagcgatcctcccacctcagcttcccaagtagctgggactataggcatgcgctaccatgcctagctaattctattattttttgtagagataggggtctcactattgaccaggctggccttgaactgttggcctcaatcctcccaccttgtccttccaaagtgctgaggttacagccatgagccactgtactcaccccaattttactttttattatttttaattttttgagacggggccttgctttattgccaaggctggagtgcagtagcatgaccatggctcactgcagcctcaagctcccaggctcaagcagttcttccacgtcagtcccctgagtagccgggactacaggcgtgcaccaccatgcccaaccagttttttagtttttgtagagatggggtttttaccatgttgcccaggctggtcttgaactcctgggctcgagtgatccactcacattggcctcccaaactgctgggattacaggtgtaagccaccattcctggcccaatttttatttttgaagtcattttttttagttcggttgtttagccttattttgagactggaagcaaaaattttaaatatgttcattttaataccttctcattacctcataggctaggtctacttacatgttacactttctccatccacaccctccattttagtacttgcgtttcagcttgaatgtcagtgttgagagagaaatgcgaaggtggttcatcagctaatttccaataatgagcaaaaagaaaaaatggaaaggtgacttaaaaagcacttacaggcttctggtctttaatttgtcctaagttttataaaaacttttaaaaaccaaatactcatcttgagtttgagaaattttattggttggcttcatcaaatgtttcataatatacactaatagcatataaaaataataatagctatgggccacatactgttctaattattggacatgtgttagctcatttaattcccaaaacaaccttatgaagtagattttgtcattatccccattttagggatgaagaaacaaatatagagaggtcaaataacttgtccaccataaattgatgctgctaatgccgaagagatgagcactatatggttttgctgaagttagaacatatttctaatatagtcaccttaagtttttttttttttttttgagatggagtcttgctctgtcacccaggctggagtacagtggcacaatctcggctcactgcaacctctgcctcccgggttcacgccattctcctgcctcagcctcctgagtagctgggactagaggcacgtgccaccatacccggctaatttttttgtatttttagtaaagacagggtttcaccgtgttagccaggatggtcttgatctcctgaccttgtgatctgcctgcctcggcctcccaaagtgctgggattacaggcatgagccactgtgcccggccaagattttttttatatatgagcttgtgggataaagtttattttgcaagtaatccaaaaggagagagtttttcagaagagctggtttgcccttgagaaaaggtcaatgtattatatatgagcactattgatatacttctgtattatttaagctgtgaaatattttttttggtttagtgttcatagttgatacctttttaactttgcatgtaatatccatccagtatatcctcaaattatataaattttgttcatatgatttatctccttttctactctttcacttaattatgctatttttttccttttgcctttaaatatataagtttatttcggagtggcatagcccaactgcctttttcataattttaattttaagtcaacagagatcaaagagtttattgagctctttagttacgaaaggaaccagtaagatgttacagctagtcaaaaggagaattaaaaaaatacatgtatatttaggccaagcttgtccaacccacagctcacaggccacatgcatccctttgatgtggatagctttgaatgtggctcaacgcaaattcgtaacctttcttaaaacatgatggggtgttttttttttttttttttgcgattaaaaaaacatttttttaaagctcatcagctatcagtagtgttacggtattttatgtgtggcccaagacaattctcctaatgtggcccaaggaagccaaaagattggacacccctggtttaggcaattaggaatgctaaaattaatttagaggtagatgtaaaactggtcattattcaaatgcaataatcacatttcaggggaaaactttatttgcatttttactgagaatcattggcattgctatccattgcaacagttatgaaaaagaatatagaaggcacaaagagtgtgctagacagtaatcttttttgcttacttcaaattcttccataattttttctgacagcctgtgtctacctcatgaccataataatctcagagatagtcttgatgacaagaagtttggtcttatgtttggcttgcttattggcatgggtgcagcaagattgttcattaacaataaatgggcctccttaagtttgctgaacagtattgacttactaaagtcacaaaattaacttttgtctggaagttttcataaggaatgtcagattgaactttaaaaatcctttattatttgctatctaagggataggaaactaagtctcagaaactctctctactaggtttcacctgcagtacctataaattggagtgaatctcactctacgaaaggtcccccatatttcctgtggttcctgtcctgtcaggaagtgtatgaccttccttaaaatctccaaggctgggccatgtaagccaagcaccaggtcagcttatatgggaggtctttgtaggcattggttccataaggaaagccaacctttgttccttaaaaaaaagtatctggtcctacctaccattccattttcaaatacgaaatccaggtgagatgttagttggacaggtaacttgtccacttatatcttggttaaaggaggcagacagattcttatttaactgttgcaggtaactaccatgaaaactaaggagacttagttaagaaatctgaatttgggttgggatggggtgtcagtgagatgcgagatcagatatgattttagaatgtttgattttagtttacaaaagcagagtctactaaaatgtgtaaatgacagctagcttaagaggaaaaaagccttcttcatatatccagaaaatagaatattaaaataatattaacagtattgcaaacaaatggccacagagagatattctccataagctcattcagtccttatgtaattcttatttcattgtatatgttagggatcagcttgcatgattctgtctgtttctagaaggactagtcctggaaatctcactcagtccagtgatagggtctaaaagttgtcaaagcagtcaactttagaaccttctacccaagactctattctttgaagtattaatagttcttcacaaggcttggagtctgtcctttaggacatagactctgatctatagcttacagcacagcctttgggcaagcatctaaagaaaacaaaagctgtctgaagatgacagatttaatgatcatggtaaatttgttaccggtaattgttaaatattgagggtctgaggaaggttcatgataagaataatgctactgataaatttttttctatgacatgcaaaataaaggtaataaagccatttaaaaaatactaggcaaaaaatctgattaagcttattttctttctttttttttacagtaaaccctttttttattatatacttttttagggtacatgtgcacaacatgcaggtttgttacgtatgtatacatgtgccatgttggtgtgctgcacccattaactagtcatttacattaggtatatctcctaatgccatccctcccgcctccccccaccccacgacaggccccagtgtgtgatgtcccccttcctgtgtccaagtgttctcattgttcaattcccaccgatgagtgagaacatgtggtgtttgtttttttgtccttgcaatagtttgctgagaatgatggtttccagcttcatccatgtccctacaaaggacatgaactcatcattttttaaggctgcatagtattccatggtgtatatgtgccacatttttattattattatactttaagttttagggtacatgtgcacaatgtgcaggttagttacatatgtatacatgtgccatgctggtgagctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgtgatagtttacttgagaatgatgatttccaatttcatccatgtccctacaaaggacatgaactcatcattttttatggatgcacagtattccatggtgtatatgtgccacattttcttaatccagtctatcattgttggacatttgggttggttccaagtctttgctattgtgaatagtgcctcaataaacatacgtgtgcatgtgtctttatagcagcatgatttatagtcctttgggtatgtacccagtaatgggatggctgggtcaaatggtatttctagttctagatccctgaggaatcgccacactgacttccacaatgactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatggtgagcattttttcatgtggtttttggctgcataaatgtcttcttttgagaagtgtctgttcatgtcctttgcccactttttgatgggattgtttgtttttttcttgtaaatttgtttgagttcattgtagattctggatattagccctttgtcagatgagtaggttgcgaaaattttctcccgttttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggtttctggtctaacgtttaagtctttaatccatcttgaattgatttttgtataaggtgtaaagaagggatccagtttcagctttctttttatggctagccagttttcccagcaccatttattaaatagggaatcctttccccattgcttgtttttctcaggtttgtcaaagatcagatagttgtagatatgctgcgttatttctgagggctctgttctgttccattgatctatatctctgttttggtaccagtaccatgctgttttggttactgtggccttgtagtatagtttgaagtcaggtagtgtgatgcctccagctttgttcttttggcttaggattgacttggcgatgcgggctcttttttggttccatatgaactttaaagttggtttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttcgttgagcagtgatttgtagttctccttgaagaggtccttcacatcccttgtaagatggattcctaggtattttattttctttgaagcaattgtgaatgggagttcactcatgatttggctctctgtttgtctgttattggtgtataagaatgcttgtgatttttgtacattgattttgtatcctgagactttgctgaagttgcctatcagcttaaggagattttgggctgagacgatggggttttctagatatacagtcatgtcatctgcaaacagagacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagagttgttgaattttgtcaaaggccttttctgcatctgttgagatgatcatgtggtttttgtctttggctctgtttctatgctggattacatttattgatttgcatacattgaaccagccttgcatcccagggatgaagcccacttgatcatggtggataagcttcttgatgtgctgctggattcggtttgccagtattttcttgaggatttttgcatcaatgttcatcagggatattggtctaaaattctctttttttgttgtatctctgcccggctttggtatcaggaagatgctggcctcataaaatgagttagggaggattccctctttttctattgattggaatagtttcagaaggaatggtaccagctcctccttgtacctctggtagaattcagctgtgaatccatctggtcctggactttttttggttggtaagctattaattattacctcaatttcagagcctgttattcgtctattcagagattcaacttcttcctgatttagttttgggagggtgtatgtgtccatgaatttatccatttcttctagattttctagtttatttgcgtagaggtgtttgtagcattctctgatggtagtttgtatttctgtgggattggtggtgatatcccctttatcattttttatgcatctatttgattcttctctcttttcttctttattagtcttgctagcagtctgtcaattttgttgatcttttcaaaaaaccagctcctggattcattgattttttgaagggttttttttgtctcttatttccttcagttctgctctgatcttagttatttcttgccatctgctagcttttgaatgtgtttgctcttgcttctctagttcttttaattgtgatattagggtgtcagttttagatctttcctgctttctcttgtgggcatttagtgctgtaaatttccctctacacactgctttgaatgtctcccagaaattctggtatgttgtgtctttgttctcattggtttcaaagaacatctttatttctgccttcattttgttatgtacccagtagtcattcaggagcaggttgttcaggttccatgtagttgagtggttttgagtgagtttcttaatcctgagttctagtttgattgcactgtggtctgagagacagtttgttataatttctgttctttaacatttgctgaggagtgctttacttccaactatgtgatcaattttggaataagtgcggtgtggtgctgagaagactgtatattctgttgatttgggttggagagttctatagatgtctgttaggtccacttggtgcagagctgagttcaattcctggatatccttgttaactttctgtctcgatctgtctaatgttgacagtggggtgttaaagtgtcccattattattgtgtgagagtctaagtctctttgtaggtctctaaggacttgctttatgaatctgggtgctcctgtattgggtgcatatatatttaggatagttagctcttcttgttgtattgatccctttaccattatgtaatggccttctttgtctcttttgttcttttttggtttaaagtctgttttatcagagactaggattgcaacccctgcctttttttgttttccatttgcttggtagatcttcctccatccctttattttgagcctatgtgtggctctgcacatgagctgggtctcctgaatacagcacactgatgggtcttgactctttatccagtttgccagtctttgtcttttaattggagcatttagcccatttacatttaaggttaatattgttatgtgtgaatttgatcctgtcattatgatgttggctggttattttgctcgttagttgatgcagtttcttcctagccttgatggtctttacaatttggcatgtttttgcagtggctggtaccggttattcctttccatgtttattgcttccttcaggagctcttttagggaaggcctggtggtgacaaaatgtctcagcatttgcttgtctgtaaagtattttatttctccttcacttttgaagcttagtttggctggatatgaaattctgggttgcagattcttttctttaagaatgttgaatattggcccccactctcttctgacttgtagagtttctgccgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctctttcctgaatttgaatgttggcctgccttgctagattgaagttctcatggataatatcctgcagagtgttttccaactttcttccattctccctgtcactttcaggtacaccaatcagatgtagatatggtcttttcacatagtcccatatttcttggaggctttgttcgtttctttttattcttttttctcgaaacttctcttcacatttcatttcattcatttcatcttccatcagtgataccctttcttccagttgattgaatcggctactgaggcttgtgcattcatcctgtagttctcatgccttggttttcagctccatcaggtcctttaaggacttctctgcattggttattctagttagccattcgtctaattttttttcaaggtttttaacttctttgccatggctttgtattcctcctttagctctgagtagtttgatcatctgatgccttcttctctcaactcgtcaaagtcattctccgtccagctttgttccattgctggtgaggagctgcgttcctttggacgaggagtggcactctgatttttagagtttccagtatttctgccctgttttttccccatttttgtggttttatctacctttggtctttgatgatggtgacgtacagatggggttttggtgtggatgtcctttatgtttgttagttttccttctaacagtcagcaccctcagctgcaggtctgttggagtttgctggaggtccactccagaccttgtttgcctgggtatcagcagcggaggccgaggaacagcagatattggtgaacagcagatattgctacctgatcgttcctctggaagttttgtctcagaggagtacctggctgtgtgaggtgtcagtctgcccctactgggggtgcctcccagttaggctccttgggggtcagggacccgcttgaggaggcagtctgtcccttctcagatgtctggctgcgtgctgggagaaccactactctcttcaaggctgtcagacagggacatttaagtctgcagaggattctgctgccttttgtttgtctgtgccctgcccccagaggtggagtctacagaggcaggcaggcctccctgagatgcggtgggctccacccagttcgagcttcctggccgctttgtttacctaagcaagcctaggcaatggcaggtgcccctcccctagcttcgctgctgccttgcagtttgatctcagactgctgtgctagcaatgagcgaggctccatgggggtaggaccctttgagccaggtgtgggatataatctcctggtgtgccctttgctaagaccattggaaaagtgcagtattatggtgggagtgacccgattttccaggtgccgtctgtcacccctttctttgactaggaaagggaattccctgaccccttgcgcttcccaggtgaggcgatgcctggccgtgcttcagctcacgctcagtgtgctgcaccaagtgtcctgcacccagtttctgacactccccagtgagatgaacccggcacctcagttggaaatgcagaaatcagccgtcttctgcgtcacttatgctgggagctgtagactggagctgttcctatttggccatcttggctccacccctgattaagcttattttcaaagaagaaacctgatttatgaaaatgagcagatataatttttcatatcaagaatataaagtaaatagatttagcagtataattatgaaatcattgtttttacctctcagacctctttagaggatcttggagactctgggaaagacttactttgtcataaagtgtcagtttgttccagaacattgaaaaagcacaatgaaagacaaaatgggaactgagttcacctgtagatgtagaatagggtccagacatttatatttttacagaatgccatgtgtaagtctgatgtacatccctagtgaagaaccactgaagaagatgttagattcaagttaggaaagaggtaaggttagagacgttttaaaaagtgaaattatgactggcaacactgtactattgcatcaggcagcataccttcaagactttgataaatatagggaaactctatagaattactttatagaattttgagcagtgtttctcctgagggtaaaagtatactttggatggtgagagaacttacaaatcatgagggactcccgtaaagcatacacacacacacacaaaaaatagaggccgagtatcacttatccaaaatacttgagaccagaagtgcttcatattttttttttctttttttggagacggagtttcgctcttgtcgcccaggctagagtgtgactgcgtgatcttggctcactgcagcctctgtctcctgggttcaagcgattctcctccctcagcctccccagtagctgggatttcaggcacctgccatcacgcctggctaatttttgtatttttagtagagatggggtttcaccacattggccaggctggtctagaactcctgacctcaggtgatccgcccgccttggcctcccaaagtgctggaattacaggtatgagccaccatgcctagccatgtttcggattttttttaattaacttttggaatatttgcagtacgtttatcacttgatcatccctaatccaaaactctgaaatgctccagtgagcatttcctttgagcatcatgtcagtactcaaagagtttgggattttggattttcaaattaggaatgctcaacgtgtattaacattttatctattctctttaatcttggaaaagtgtagtcttttctggtttgacaactcttaccatacaactcttaaatagtaatacatctaaaaaaaataatttctagaatcccttcctttataatgaaataataaacctttgtgcttttcctggggctctctctgagaaatctcaaaagttttctgggtgaatttcttcttctaaatttttaatttgatcttaaaaagacaaaaggagttgtcagaggagagttgaatatttgattagtgtaggattcgtgggtatcagaaaaactatttggttatcaatttaattgaagtgacaaaacatttagaagtaaacatagaaagtgacatggttgtaaataaccacagctctttcataaatagggaaccttttctctttagtctttttttcttctttttttcccttctttagtctttttttttttttaaacagacctaataaagtcaacagaatctctgctgtctaggctgattacaaggaaggtaaagaataactttttatccagtgtaatggctctgaggaaaaaaaactctcataagcgaaagcattaaacagtaaattaagaaagtaattccatacaaactgagtgacctttgctagaatattaacaccttttatagcttattttaacccaagtgttttaaatcaaagcagataaaattcagtttccaagttttatctttcattgtgctttttcagttttctggaacaaactgacattttaggacaaaatgtgtctcccccaggttctctaagatcccctaattgggtctgcaaggtaaaaataattttcatgattatactaagaattatttattttaatatgcaaatattgttcaaataaagattatcttggtgttaatttttaatatggtaaatatcaaaacacacaagaaaaactccaggattgtcagtgttttatgagtttaaaggtaacactgaccaaaatgtttgaaagccactaaactactttttttccttgaagcaaaagcaattacagtttttatttctgtcactgttattcctagtgtagttgcaaccacttatgttaattatatcttttaatcatagtaacttctatttcataaaggaaattgggagcagggagatgggaaactgggagatgtcatacacaagcattgtctactgttttcagttacctgaagattttggaaattatcttcaagatgatgtttttcaaaacataaatactgttgaataaatgactaaatttagttgaacacagatttccgttttcatactcttaaacatcatgaaggaataatactagcttatttggctagtaaacctctatacattaggaaaaacaaacccaagtagagtaagtgtattaagctttacactgataatagggagaagatgttttggttttttttaaactaaaggtattagtctcatttaccaaagatttcacttaattatgtaaacttggattcttaaaatgattctgattcttgtaatacgttttttcaaaagtttaatatagtttaaagtatatttttcaaaagtgcaagttcaatttctttactttctgagattttaggaatatttaccttgataacatttctcttttattcatctttataaacaaatttgaatagaattcctttaagagactttgtaatttaatgtgttaatacttccgtaggggccgggcgcggtggttcacgcctgtaatcccagcactttgggaggccgaggcgggcggatcacgaggttaggagattgagaccatcctggctaacacggtgaaaccccgtctctactaaaaatacaaaaaaaaattagctgggtgtggtggcaggtgcctgtagtcccagctactcaggaggctgaggcaggagaatggcgtgaacccgggaggcggaggttgcagtgagccgagattgtgccactgcactccagcaagccgagattgcgccactgcactccagcctgggcaacagagcgagactgcgtctcaaaaaaaaaaaaatgcatttctcagaggcttagacttgtctttcactcttccttaagctcttttcctagatacctgcacagttcactatctttatatctttactaagataccatctaattggggtatctaaagtaggcctgtctaataagcctgtcttaaagtatctaaagtaatcatctctggaccctttatcttgctgattttttcctttttagtactaaatgcgtaatatttatttgcctccccatagtgaaagcaggggcttttatttccgcatttccaacagaaacatgacaggcatctagtaggcactaaatgtttgctgaataaatgaatgaagtgagattacagagaaatggggagagagattatgaacagtaatacatttttatatgctttaaagctataaattatctttcttctccaacattttatagggaaattccctgtgtgggaaaatctccggcccatgcttgaatttctaccggttaaatattttaaggagtaaatattccttaacaagttaagaccctgggataaggttgtcatttaattttttaatatgtaagatattttgggaatgaagggatttgaattagagataatgtttggaacactaattatatagagttaagcagccccaggtcagatgccactattgtaaacacctcaggcaatcatgggagaatgaaagattggattatcttgagaggtagacagcaaaaaacatttatagagcgagggaaatggaggggaggaaaggactgagacaattttatattactaagagttggcaggcagatatgatttacctttccctaaggttctacttcttgtgttggcctgggaggaggaaagagaagctaattttttaaatccctcaactaggaaaacagtcctgtgtctttgacatccattctggaattagagtccctcttatgtaccaggcttggctgtggtgctggtagtaaatacagtggtggacaaagtttcatattcaagcactgcctcctatccctgctttatttttcatttcctgattttgaagtttgaatattaataatttcattgtcttgtaggggatgaaagaactatggtctttgttgaaactaagaaaaaagcagattttattgcaacttttctttgtcaagaaaaaatatcaactacaagtattcatgggtgagtagatgaatataattacctattaggggaatgacttctatttggtatttaagaaacatcagtttatataactaatatgatataatcctaggattgggattcagaattctctcagatctaaactgttattctcctttatatgaggaaaaggataatacccaggagtactaaactattatttttcatcctcattcttagtttttagaactaagtggttgtggtgggtaagataaaggtctgccttactctcaaaataaggagtggaaatttctcaagagatctcacttaaggatctctggccccttatcaaattttcctttgctaaatctaatctttcttagagctttttaaaattggagtgctttaaaatgtcatattaataccgttttatgggcacttcattagtagatcctaaaatatcacgtagtatatagtgttgtgaaattatactttaaaaatatgtttttaagcaagcattctaatcaagtagttgtatattttatgtcaagactataaagcatagagattataataggatttgatttttgtcagacttgagattgtagtctgtctctacatattagctgttactttacctcatttgcaaatggggataatttttgcaactcaaagtattatattgaggattaaataaaatggtagcttggaaggaattagtatagtacctggtatgtaagaagtgaacattaatgttaaatgctgctattcttttttttttttgagaaagtcttgcccagtcatccaggctggagtgcaatggcacgatctcagctcacctctgcttccccggttcaagtgattctcctacttcagcctccctagtagctggaattacaggtgcatgccaccatgcccagctaattttttgtatctttaatagagatggtgtttcatcatgttggccagactggtctcgatctcctcaccttgtgatccacctgcttcagcctcccaaagtgctggggttacaggtgtgagccactgcgcccagccaaatgctgctattcatactattattaaaaagaaatttgtatgttgaactttaatgattcactttaatgattttaagagtggttctaataacatgctttcttttctttcaagtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgtaagttaaacttttatgatggaatggatagttttcttactttgttgttgaaagtagacattttatgcatgtgtatataacaagtaaacttttccaatatttaatactttatgttgcatatgaagtcaattttttttaaaggctcaacaggatgttcctgcatggttggaagaaattgcctttagtacatacattcctggcttcagtggtagtacaagaggaaacgtgtttgcatcagttgataccagaaaggttagtagaaaggaaaacttgagaacttgtcttctagttactctttgtaaatgttgtgcttaatattgtgaagtaactataatatttaataatcaagccattgttttcgtgcctggaaggtagctactttattatttcattaacattttatgtatatacatatttttggttttaaaggtcaggaattaactttgagatttatgcctaaacagtctcctttcccagattttaaattttaatttggaatcttttaaacttctgatggaattatttaatttttgaattctgacaacattaattaatataaaatacaggacctgttggggttacaagtcttttctttttcttttctttttttttttttttgagatagtgtctggctctgttgtccaggctggagtgcagtggcatgatcttggctcactgcaacctccgcctcccaggttcaaacaattctcatgcctcagcctccagtgtatctgggattacaggcatgtgccaccatcttagctggttttttttttttttttttttgtatttttaatagagacagggtttcaccatgttggccaggctggtctcaaactcctggcctcaagtgatccacctgcttcaacctcccaaagtgctgagattacaggcgtgagccactgcgcccagccacgaggctacaagtcttttctggtatgtcaggtttttataggctgaacaccgcctttattcagaaacaatgagcatgttaattaaatatttatgctgattcattgagtgtagtgcattaagttttccccacttgtcaaaactattgacttaaaaaatatttttcttgaaacattttgtgcaatttagatttcctcatttgacaggagccttttttcaggtgaatcagatttagtgagaataaagttctttgattatttggggaagacatggtagatactttgagtccttgctctcagtctgagtgatgtaactttaaagctgtcataaaattaaatgtttgtttgtttctttttttttttttttaaataattaccagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtctttcttatttctggtatattctttagggggcttagacatgtttaatgtttaaatgccaagtcttactatagtgtttattgatcttataaaacaagcaaataggatatgatacacttttggttaaaaattactgggtctcatttttacttgagtctttaaaacagtagtgtgtcactataatgtgataatctttaagagaaagtagaatacttaagcctttcaaagtgattttgatttttagatcatcagatgtatgatgaaaatggttaaatgtttgtgatgggagctctgtactcaatggcataacaatgtttatttttataatatacaatctttccttgaaataaaggatgaaacacttttcccttaagttttccatcagcactttaaatttttctttgttgcatatcctagcccaaactcctatatttttgaaactgtttttttgtgtcttgcgtaaccagtgcagtgaacaaagtcttacataaattaaatattaatgtataaacattactgcacagatgtggcaatgaaaatcaatcttagaactcaaacccgtttatcaacaaaaaacaatgctgcttactctttccataagtttttgattcatattttaagattgatgaaagaaccctgtctttcttcattttccattatatatcttgaacttactatgcctagaataatgaagttctttttttttttgagacggagtcttgctcttgttgctaaggctggagtgtaatggcgtgatcttggctcactgcaacctctgcctcccgggttcaagcagttctcctgcctcagcctctcccgagtagctgggattacagacacgcgccacaatgcccagctaatttttagtagagacgggtttcactatgttggccagcctggtctcgaactcctgacctcgtgatccgcccgcctccacctctcaaagtgctgggattacacgcgtgagccaccgcacccagcccgaagttattaattaattgttaaatgaacgaacccaaatatttaagacccagtgaggtgtaaatactggggagacaaaaatgattggtattaagtgttactgttcacctaaacaatccaaagtgacatgtccctgatgtatatcttgttataggaatttagttaataaatgaggcatcacatatgaaaaaggaaggcatatcaacagatagtgttagaataactgggtagatgcctacctcatgccatatttaaaattaacttcatgtgaattataaaatattaaagctaatagttaaatattaaccctttgaagggttgactttaagctaaggaacagaaatcaaaaaagaaacaacagatttgatcactcaaggaaagattagttgcctacataaaaaatagtgaaaagtagacaaggaaaaatattactgtgaccacagtggttatcagtgttctttatatgtggatatactaatagaagaatacaaagaacatagaaactcaaaaagggcaccagcatggcacatgtatacatatgtaacaaacctgcatgttgtgcacatgtactctagaacttcgagtataataataaaaagaaaaaatgttgacaacaagaaaaactcaaaaagggaagttcaattaataaaaatatgggacatatttcacttttcttctgttatctcacttctgggaaaggctaaatgaatgaaggtgtttggattgttatttgtaatatctgtatgtcttaattttctagtttcgtttaggaagagtataggccagtcttgtctcatttttttcattgctttttttttttttaacagattgctccctctgaactgattccttttaagcttttgcttgatttgtcagattaccatagtagcattactgaatcaaatataaaaaaggaaaggaaatgtatcatacatctaccaccattacagatgaactgtaaatgtccctatgtttaattactctcctcatttctaggtataggtttgaatcatctctttaaa

SEQ ID NO: 16662 - DNA, 81819 bp, Human; identical to SEQ ID NO: 16661

SEQ ID NO: 16663 - DNA, 40577 bp, Human
aaatacttttagtttttcacatccagtttttcctttcacattgagttggctatgctatctaaggcatcctggtgataacatgtccaactgtcacatggataaagtggtcattcatttgttcatttcatccaacataaacttattgagcgtctatccagtgctgggcatctatgccaaggattcaatggtgattgaaacagagtgcctgctctcctgagttttcagtctaatggggacaatgggaaacaaatattaatgaaatagcaatacggctgtgacattacaacctcataaatgctgtaaagaagaaatgcatgcagggcttctgaggaagtaatgtttgggctaagagatgaaagatgcattaactaggagagttaactaaattaacttgctcaggagtgagcagggttccagttaacaaatttatggttgtcataaggattaggggaaggacagagtagggctagagaagaactttctaggaaaagggactacagccaggcgcagtggcttatgcctataatcctagcactttgggagcctgaggcgggtggatcacctgaggtcaggagtttgagaccagcctggccaagatggcgaaatgccgtctctactaaaaatacaaaaattagccagccatggtggcatacacctgtattcccagctattcaggaggctgaggcaggagaatcacttgaatccaggaggcagaggttgcagtgagccaagatcacgccactgcacttcagcctggatgacagagtgagactctgtctcaaaataataataataataataataaaaagaaaaagggactactaacatgggcttgtattatggtgatcaggtggatgttgatggtgtaggaggcggggtggggggagtttatggctgcctaaaataggatggagacaaaaatatgtggataaaagaaaataatgtggaagttatttaggaggtaaaatggcaggaccaggacttggctagtccttcaaggctcatctggtgactggggcattcttttgggctgggatctgtggggccctccccggctagcaacttggctttcagaagtagatgcagccactgatgcagtccgcgtgccaaacagggatggcaggtaggggcagggctgggcaggggggcacaggtgagcacatgcctccgctggcagcagcatttcaaaacctggatttatgactcaagtcaggaggattcctggaacccaggcatagatttctgtgggcagtcagttgtttacaggagattaagatcatgcctattaaagagatcaattgtgtccacaagaacccacacttaataggtaattgctgcttgacagaactctacctgcaaccagcatagctaaataaggaacataggaaacaattgtcctgaaatatgaacaccatgttttttttcctccgcttgatcaaagaaagactccagcaaaaggggaaaaaataattaaaaagtaaaagtcttacctaatgaggtttaaaacaaaacttttgaagccaacaagcaactgtgggcaacacttcaaagggcccagaatcaatgtttgtcaatagcagttttgcatcctttaatttatgtctcatgaatataaagtgtgatgttattaggagcccatccatgccttaattctgtttgagatttgatgaaccagaagtctattaacattctgtacaaatcagcactggcagaggcctgtggcacaggcttcacctgatcttttatcctgaggctgggatgctagtcacgctgtcaggcttcctgctcggaacacccagcagctgtcatgtgcaccgtggagccagggggctatgtcagctactttctttggagagtttctccccagaagagaaaccacttcatgactcagcccagccccaaagttgccatttgtttaatcaagatagttagtttgcaaaacattaaacattaaacagtatttgatgcctagttaataatttgcatcctcttcatttgttcctgaatccttggagactgacatttttcccccctaaaggcatagacaacaaaagaaattttattgagaggaaaacacaagtccttaaactgcaaagatgtttgccaggatgtctgatctccatgttctgctgttaatggctctggtgggaaagacagcctgtggggtaagtgttcttttctaatatttgtagttgagagactccgaagtttactaggaggaccaagctaggctgggagtgatgagaaactttagagtgaaaggctggagttgccaagttggagatgttctaactacaagaaccaatgcaggcctgtggcttggtttcttttgagcagccactcccatgggaacaggtgtctgacttgagccatcttggagcggagcctccatgaatgcattccagcaaaggagactggggcaagaaaatgtgccccagggcatggattgtaatctgtcatggatctcatagacccctttgagaagccatggaaagctataaactctctccccaggaaaatatacctatctattggtgctgacacacacagttttccagcgatttgtggctgacactagggtaagaagcaatgtgctatggccttagaggggaagcctgctgactgcaaaagatcctggcagtgggtctgcataaatagtttggatttggggagaagctttgtgtttagtactttgtctccttttccctgtgacagcagcagatgaggcagagaaggtgagcaggggcccaagggaggttgcagtgcgcagggaagggaagtcccatcagagagtcttgaacgggggactcaggaccttccggagcagatgacttgtcaagatgttagttccttctgtgtgccatggtccaagagtgtcagatggatctctgtgggcatggaaagaggaccttgcacagaaatagagtctccttggagttccgtgctggttgtggtctgaggcatgaatgtgggctttggagccagggttcgaatctcagctttgccacattctagctgtggaatgttgggcaaggaacataatctctctgagcctcagtgttgtcttctgcaaatcaagtgctaacctctcagatttggggagggccacaagtaaacgaggtcatgtatgtggcttgcaaataaatgtgagctctactcccttaaaatgtcaagaatgaacacaacttctccataaaaatcagagaatgctccgccttgttcgggaggggtggtagaaagtgggcagaggataagaactaaaataacagtcataacctctctgtcttattaagtacctttgcattttgttccccatttcactccatagagcgtttcctgaatgaagcagattaagttacagttttctgattagcatgtttttaaaacaatagcttctcctttcttttccgtcaactgtgctcagacacctatcttagctctgtattaagttgccaagtgactcacttctgaaagggttttcttttcaaatcatgacttgtgtgtgtgtggtggttgtaattacaaattgttgtcaagcccctacatcatttgatggcttgttggtgtctgaggccgagacacagcagaaataccacaggtctagagaaaggcaggagaaatcatcggaggcccacgcggggcccagagaacataccagtcggaaagaattagatcctaaactttgcgggcaaggagaaacgttgacacggtatgtttgaagttcacaaaaggataatggtcccgaaaaatcccttttttgcaaaccccagtgaatttttagggttagcaatgaaattataagtcaataatggataaaagagaaaatatgagagttagccttcaggcaatgagcttagtcaattccaaagagaggattcggggctttggaatgctttcttaccccagatgtgtgccagacaggtggtcgggaaggcggcttgtgttccacaggctggcatacagacatcaggggaaagtggccaagtcgttcagatgctttggagagtttggggcgtcatgggggtaaagaagccacatagccagctgggctgggtggcctctccagccccacacagctaaaagtcataactaactgctaccatttaatgagaagtcctgagtgctagcccctgaactttccatgaattggttcatctctggaaggaccccaagaagtaattcctactatgctcccattttacagaaacgaagctggaaaactgggcctgtcccaagtcatacagctgatgagtggcagagctgagctctggattacagactggtttccgtgtagccagtctcctgtctggggccctgggtgaggatgagatttctttggttcgtacagcttcagggacatggcttttcctgtagggaaaggcctcttagaccaggcacatgtttgctgggtggagtgtaatggactccacgtgtctctgaaactccaaagaaaggcagctataggatctgtggtcactattcattggaaagacacccaggtactctcccatgaattcagatcatgtagcaaatgaggactgttctttgggatcatctgtcatggagatttttattctgatatccactagcccaagagatatgggtcaaaaatcattgctgtgaactccagggcatcattcattgtgccttgctgttctactcgaggtttggttttcctaacatatcatttttgagcacctgtccagcacaacctcatatcattatccctgttttatggatgagatacaaacccagagatgttaaaatgactttctggccaggattggggccaggtctgtctgactccacattcatcacaggaggcctgcttaactgtaaataaggcgtggactgtcttagaaatctcttcttgctaggattcttagagtgatttggggcccagctgggctcagccataatggaatttggcctctccaagcccagaaaccagaggacaatgtttgtcaagcttgcctgcttatctcagcccatccctagaaagaagaaagacaaaggcttctcctctcccctgcaaaggaggtgctttcaattaaaacaatgtttacatttctgggcttttaaaaccctagaactctagaatcttcccagggatagagccacaaaacagtttgcataggtcagaagttgcaaattggcagcttgaaatacactctgctcacagctcaagtttaacttggtggatagaagattgactccaagagtattttagttttattttaattgcttggccacatttgaaaatcggaacacagaacatttcccattaaagatacagattcccagcttttcttgaaaatcagacatttgagtagcattgggttcacattcttggctggcaccatggagaggggtagccaccgctgctgttattagatgaagtttgaggccaggcatggtagctcatgcctgtaatcccagcactttgggagtccaaggtgggaggattgcttgaggccaggagtttgagactagcaacatagcaagaccctgtctctatcaaaaaaaattttttttaaattaagcgggtgtggtggtacatgtctgtagtctcagctacttgggaggctgaggcagaagcgtcacttgaacccaggaggtagagattgcaatgagcagagaaggtgccattgcatcctgccttggcaacagagcaagactccatctcaaaaaaagtttaaaaaaaaaaagaaagaaagaaaaaagaagcttgagtttcccagatcctgctcctctctctttctttgattcttttattctttttttttttttttttttgtagagactggtttttgctattttgcacaaagctggtgttgaactcctgaccttaagtgatcctctagccttggcctctcaaagtgctgagatgacaggtgtgaagcatcatgcctggcccccatactatctagaactcttcctcttgaccaatgtgcattgtctgcctggttctgccttactgcacttctctggttattgctcagaaatgctgtggatattgacttatcggaccaagtttgggatgggcaagtgaccaggctcagcatccgattaattcaagcatccacacctgcatgggctccaggaccaaacaaggtcttggacaggaagatgggagccactcttttcaaagcctccagaatgccagtctctttcgggcctaggagagactgaagaggcattcctccctcttactgccatctacacggtcttagggaaaggggagggactgattttcactgcaaattctcatagatttttttttaactgatctgaagcacaaatccaactcattacctttagcggtgtacactggtatttagggaaatcaggtcgcaggaaatcacatgtgtatacaggcacgggtatatttatattttaaattcattagagtttcctaaatgcaagagcaattctgctgtcacagagaaacagcatggcagaatatttggcagccgggattttaaataaaacatgctttttcttcataattaatataacaaggtttcctggcttaggacttggcaacgatcccaggaaaaatggttgggggggagggggttggtgcgccatgcctgtgacccgcaaacaagttccaggaaaagttgatgctgagtaagttctccttagtcggctcttccggcactctgagaaaacagaacaaactcactgacaacagtggctattaataataggagtagtaagagtaatcgtaataattaatagtagcagcaaccacgtatgaagtctttacatttgccagatgtggcatgctttatgtttattatctcatttaagcttctctcaaaccctatgagttagggaccaatgtcattctcattttacagacaagaaactaagcatagagcagttaaatcatctactcaagatggcacctctgggaggttacagctctgggattcaaggtctgcccaacgcctagttctatgctcacaagcactgtggttgagatcatcatgcctggcactgcccaaagacaaacaagaccgttttgtgtggtatcaaaggtgtcaaaatgggcagcagcctgagactccagcttccagcaggagacaaagtcgctcccatctggacgttccctcaatagccccgaagctttgctttccctttgctttccgacaccacaaggatcgagtcttgccggctagcaaaccagttcgttcagtgttttcaaaacttcagtcatgaatgaagccatcttcagaaattctgccaaagcccaaattagtttcttaatacttttgttaaagactcaccttttctctacctaaattgatttagttctaaaggaaattgtcattactacaaagaaagcgaagtgatgtcattgaattctagctggctgctgttgacatgctaaagctctgagcctgaagcggctttatcctccttagaggaaagatcagcaggaggcagaggatagagacaccagcaccccccagtccttccccctggtgggattggaaggcttgacagtcaacctgagaaaagaaagactttctcacgctgtgttttctgttttattctaatgctgttacttcacgtcctggctaggcaccatctcaatcaactcagatacccgcagtggctcacgtctgatgccacggaaagcgcaggagtgagcacagcttcagcagaggtggtgctgatgcctagcgggggagttaccttcctgaagccctgggctatttgctggggctgactgaccaaaaagggaaacatgggggcttgtgcttatgaggcggccccacgctcagctgtgctttggttttgtccacttgcttgtcttaattttttttttttcttagacggagtctcgctctgttgcccaggctggagtgcaatggcgcaatcttggctcaatgcaacctctgcctgccaggttaaagcgattctcctgactcagcctcctgagtagctgggattacaggcaactgccaccacgcccagctaatttttgtattcttagcagagacagggtttcaccatcctggccaggctggtgtcaaactcctgaccttaagtgatccacccgccctggcctcccaaagtgctgggattaccggcgtgagccaccgtgcccagccttcgcttgccttttaaaagggcttccaagagcattatcatatgcagaatttttacccagtctccttgtcttggatggcctcactccctaaccttcaaagctcccctccaccaccatctgtttgcaccaagtccctgggatgagccatttgtacagatatttctcaccaagtctcacctgcggagtaatcattgcaaatgccatattcttcctgagcagccaaagttccttgaataaaacattggaattgggaaagggaattcttacttttataattggggaaactgaggcacagagagactcaacaaattgcacaggagcaaagataggccctgagtctcctcagccagaagcttcacacccaagagagcttggtataaccaaagcgtggccaagggcagagtcgcctgggcactggaggaagatgtgtgttgtgttcccagcccacctcagacccatggacgccaaacctctgcgggtgggccccagggatctgtatttttatcaagttccccagacaattcttatgcacattgaggtttaagaaccaatgtctttaaaatggaaattctccggatgtaacaaatgggactcttctctttctgcccattgcccctgtcccatctctgcctgccactgtcacacgaagctgcagctcagcccttagctgggtagggtctgagtggccagctctgggctttagagcagggaagctgcacagaatccctctgagccaggcataggtgatcggcgtcagagccaggagacttgagcctgagtccctcccctgccccaatgtgtccatgtccttacacaagccacttcaccatgctgggcctcatcttcctcctctgcagatgaagggtctgagccagttcctctctacagtggctcctggctcatcactgtggtctggtgaacagcttcacccaggtgtccaggaaggaaaccacccacaggcactgctggccagcaccttcacctttggcttccacattctcccttgagagttttgcccccttcccctgagcttcaggtgaaagcaaagctgcagtgaacctgccagtcttgagacagcattgagcaatgtgtgcaaaagccagaagggcaagattcctgtgcctacgaagggatggagttgcaccacttcacacctattaggatggctcacttcatacctattaggatggctatcattttcgagaatggggaataacaagtgtgggtgagaatgtggagtaattggaaccctcaggcctcgctggtaggtatgtaaaatggtgcagccactgtggaaaacagtatggcggtccctgacaaagttaatcgtagaactaccctaggacccagcaattccacatctaagtacatatctgaaagaactgaaagcagagacttgaacagaaatctgtacaccaatgttcatagcagtattattcacaatagccaaaaggtgtaaatgacccatgtccatcaagagatgaatgcataaacaacatgtgattagatagagacaatggaatactatttagctgtaaaaaggaaggaaagtttgatacatgctacctagaagaccttggaaacatgatgcacagtgaaataaaggcagtcccagaaggacaaatattgtaggattccgcttccatgagatacttagaattgccaaatgcacagagacagaaagtaggctagagattagcagggctgagggagaataagaaggaggcgtttctgttcaacgagtacagtccatgctggggatgacgaaaaagtttggggattagagagtggtgatgggtacacagcattgtgaatgtaattagtatcactgaaaggtacacttacaaatggtcaaaacgataaatgtgatgttctgtatatgttaccacaattttcaaataaaaggactgagtggcttggcacaactgctcatcttagtgtcttctaggataaagttggttagacagaaagtcaaggaggggcagagagagaaggagcccgtgtctctgaatcctactgatttacagtgtaatcttcttgggggtggggagtgtatacgtctagtctattttgtcctatctttaatccagtgatgatttcaactcaggctgaaatgacatcgcttatctttgtagcaggagccagagaagaacaacatgagggaggatttggcctgggcactggcagccactgccctctgccacctccactactcgctctggccttgagctctttgcccagcaaggggactggccctgctgaactgtgcacacttgtccctgtccaccttccagtccagaggttgcagcctcaaccatggccatggtacagaggtctctcctccccagctgcccttgggagtaacgcacctccctggtggttggcaacatgtggcctaccaccaggcatagggtagaacatgcaaggaagaagagatggtgtgattagagtcccaaccttttatccagcaagcagaagatttctctgctcttagttcattctgagctgagcctctgtccccaaaagacaaatctggccctatctcccccatcactgcctcctaatccctctgagaacattttctaccaacgaatttctggaacacatcaactcagactgttaggctttttgttttgtcttccagaagttttggaattctggaaggcagaggaagaatcttagttgaaataatcactggattaaatataggacaaaatagacttgatgtatgtgcaccccacccacaaggagattacactgtaaatcagtaagactcagagacacgggatccttttctccctgccttcctcactaaccaaccttaacctgggaggacaccagactttgagactctggtggcttagggagtttaacattgctaagggcctgctcctaaccttgaagtcagtgtcctgagccagggatccattgagaaagcccaagtgcggagtagaataaacagtcgttggatctagaatggtcttgctaaatatactacaaagcagctaccttaccatgtgcagaagcagcagcgtccaccctttaagagaagacgggtcagctgggaccatgtgctattttagccctgttgaaactaggaatggatgtggtgggagaagtgggcagtggcttacgtgccttttgatctgagtgaagatgtttgttaagatgtgtttaccgcagtaggctggccaaggctcaatctgacttttgtactttctccagctgtcactggggccaagtaggccctctctgtggcctgccaggcctaggccagattggataagctttttttttttttttttttttaagacagagtctcattctttcacccaagctggagtgcagtggcacgatctctgctcactgcagcctccacttctcaggttcaagcgattcttgtgcctcagccacccgagtagctgggactacaggctcctgccatcacgcctggctaatttttgtatttttagtagagatggggttttgccatgttggccaagctggtctccaactcctggcctcaagtgatctgcccacctcggcctcccaaagtgttgggattacaggcgtgagccactgcgcccggcccacaaataagcctttttataaagcattccaagaacagtgcccctgattttgaacctagctcaacacctgcctctcaaggttaatgagcttttctgtttctttctcctccatccttgctttattactgtgtacacgtggcagcttcctggtccctcacaatggtgactaagagcaaggactctgatgtgagactgacagtctcctgttctggctccagcatttcctagttaagttattttagacaacttaatatctgaaaacctcagttttgtcacctctaaattggatataatcataatacctaaattatgaagtattgtgtgcaacaaacaagacaaaatgtccgtaaaatatttaacacagttgatggcacattgtcagctctaaaggaatgtgaactgagataacagttttctccctagttatctcttcctcctactcttccatcgatctttctctttgaatgtgcaagtctcaggagtaagggttcttctatcattttcttgtctctgggagaagagataatggaatgatggaatgaaaggaggcaaatactgtgtccacccttcccacctaccatcatccaggttagtttcagggatccggatataggcataagtaattgactatcagcctggactttcccatacggtccctaaatatccagccaggtgttcggactaccagtttccacattgcaccacggcccctctctgtgggtggacactgtgagtcacaaaatgagtgacttgcttcagattccggcgaccccctgacaggcagcccaagctgcacatcggcttcaggctccccgagagcccagcccaggaagtctcggctttctttttgtttggtttccctccgagcgccagctcctaggaagggcacgtctgccacctgctggctgtaggcagcatggcacccggctgtccctcaggctccagctggagccaggatgcgcaatgctggcccaggtgcaggtcctggagggcccttccttgctggaccccgaggaaggatgtccctcaaagtcttctgcccacttcttaggacatggcccaccctgttcggctcaaagagaagaattcgtagggaatctccaaaggactgggtggagacaggtctagacagacaggccctgccctgagaaaggcaaggcagggagcaaagaccaggaccaaggcccagatgactgggggtgatgagggcgagattgaagaaggggtaacctttgtccttgaagtcttagtgtattagtccattctcatgctgctaataaagacatacccaagactgggtaatttataaagaaaaagaggtttaatagactcacagttccacatggctggggaggcctcacaatcatggcagaaggtgaaagacacgtcttacatggtggcaggcaaaacagtgtatgcaggggaactgcgcattataaaaccatcagatctcctgagacttaatcactatcatgagaacagcacaggaaaaacacacccccatgattcaattacctcccacatggtccctcctatgacacatgggaattatgggagctacaattcaagatgagatttgggtagggacacagccaaaccatattagggtcccctcatggcacctctctggcactcaaccccagaggtacccatttctggcaatccttcaccctaagcccaggagcacccctaaggcctaagctgcccttcctctgccaggcctccccactgccaacccccaccctcagccccaaacagaacacctgtcccatctcactgcctgcagaaacagggtgtgggggaggtggttagccaggaagtcattagacagaggcacagtccccgataacaaatgacctctcttcctttttttgcattcctttcccctcaccaacatgttattttgtaattttttaaacctacagaaaagtgggaagaataatgcaatgaatattcttcatccagatagatgccacaattgttaacatgtcgttatggttgctgtgtctctcattctcctgtgtgtatagttgttttgtttgtttgtttgctgaatcatttgcaagtaaattgtagacatcactctacctcaccacgcatctctctcttttgtttttttcttagatggagtctcgctctgtagcccaggctggagtgcagtggcacaatcttggctcgctgcaagctctgcctcctgggctcaccccattctcctgcctcagcctcccgagtagctaggactacaggcccccgctgccacatccagctaattttttgtacttttagtggagacggggtttcactgttagccaggatggtcttgatctcctgaccttgtgatccacccacctcggcctcccaaagtgctgggattacaggcgtgagccaccacgcccagccagcgtctcttaagaataagtacattttcctacagaactacaataccattgtttactctcaagaaagtcaacattgacacaataatattgtctaatatgtctatattcaaatttcccacttgtttcagtatcttagtccattttgtgttgctacaaaggaatacctgaggctgggtgatgtattttttttaaaaaagaggtttatttggcttggatttctgaggactggaaagtccaggattgggcagctgcttttggcaagggcctcaagctgcctccactcatggcaaaagggaaaggggagccaatgtacagagatcacatggcaagaggggaagcaagagggagggatggaagtgccaggctctttttaacaaccagctctcctaggaactaatagagtgaaaccttgcttaccctgagggtgagtactaatccatttgtaatggatccacccctatgccccaacattgaggccccacctccaacattggggatcaaatttcagcatgaggtttggagaggacaaatatccaagtcagcccaaaccacagcactcaatgtcctttttgccattgtttttaaatccaggatccaattaagagtcacacactgcatttcgttgccatgtcctttactaaaaatacagtcctcccatctttttttgtcttttatggtgttgatgtttttctggaggctaggctaggtgttttgtagaatgccctgcaatttgaatctcacaatttggatctgtcatgttcctcatgagtaaattcagggtaactatttttgccaagagtactatctgttgatattttacatcctcagtacatcatatcaggatgcattatttctttttatttttctttcctaatttatcatctacctaattcccaaaatcatgtaaggaagcctacagtaaaacagaaaattagaaattctgcagagggtagaagcagcaaatataccaaactgcctagcttgatgtatctcattgatctcagctttctggcggccaagacccaaagggaaagctgtctagtggtagaactcgcatttctttaaatcagggttcagcaaactttgtaaaatgtcagatagtaaatgtttggggttatactttctctctacaaaagcagccataaacaaacaggcatggttgttttccaataaaactttatttacaaaaacaaaactgctaggcttggcccaagggcccttatttgctgacccctgattaaagtggaagagagcatactccagttattaaatgagtaatactttctttttcaggttgagtactgcatattaaaggaaatatttatgtcattatttatttattcagcaaatctttttgaggaatgccatgtgccaagctctatgctaggtattgggtaatacatcaatgacaaaacagacaaaatccctgcctttctggaggacagagtctgatgtgagagacaggtgacatgcaaataaacaaatgtaaatctatgcactgcagtaaggatcatggagggaataagcgggtgcagtgacaaaacagtggggatagggaaatgtcatattgatgggatatttcagggaagatgacacttaaactgagacctagcgaaggtcatagaggggggcttccaggcagaggcaacaataattgccaaggccctgaggtgggaggaatttatcttgcgccattttgaagccaggtgtggctgaagcttagtaaaggggcaatgggagggaggagtatgggaggagatttgtaggtcatggcaggtgtttgcattttattctaagaacaacgagaagccactgaagggttttaagcatctgtccatccccaatccccaggaactgtcacctgaagaaatcacctagatttcagcatgaattccgaatcctatcacagctatgtgacctccgagtccaaattttctcatctgtaaacaaggctgatgcaagcctcttcatagggctgttataagtatgaaatgcagcaatgtgtgatcaggcagggagtagatgaaactcactgcacctgacgagcacaccagtacctgggcagccgtgttccaaagcaaggacaggtgcagacaactgacacgaacccctgctgtggagaaggacaatgcttcagtactcagcgcgcacaggtggtggtggtggagggggtgtatcttcaaatagaccccattgcccctcccttcaacctctagcccagccacaaccatcagaaagcacgcagtgcacctgcaccccatacgatctcctctggctgacagctaaggagcacgcccggcagagctccatctcaacgctgatctgctgtgttgttttgtttttcagttctccctgatgtctttattggaaagcctggacccaggtaagtgtgctgatctccctggggcttcccaccaatcccaggctggttctgggctggtgaaaaggaggcctaagtatggaagtgttggagggacctcagggttcaactggttccgggttgtcacaggcacctttgagaacttgccctcaaaatttgtgcacccacaatgctttacacaattttgagtttcctgtggacactgctgagcccaggctcaggatcccaagggaaatactgcctacgtacttaaaacccttgattttataaagaactgaggcctagaggggaagcaatttactcctggccacacagcgaattggaggctgagatgaggtgaaaggctgaggcaaagtgagggcgagatgaaaaatgcatggctccaggcaggccgctccacctttttctgtgcgagggcggcctccgggctgacctgccctggtgataccctcacaccagcacctctgctgttgtcttctctgcccaaatggtttgcttcctcaggctcgacgcgtctaccaccaggtgggtcctgtatcttcacaagggctctctgtctcacagactcgctctcttattgtctccctttcctgtgtcctcggccttgtgcccacagcgtgcgcaagctaagcagggccaccccttccacatcatgcactcctagtcctttggctctgggttcgagtctccctttgcagctctgagccgcagtggagaaaattctgctcgccactccatctggccagaggccaacaaccccactggtagagatctatgctggtcacccacagagcgccatagccaggcagacaacacatggagactgtggccacatctgaaccttgaatcaaggatttatttggcacaaagatggcagtaactgggccaaagtcagtttgacagtcaatattgtccagcagcaaaccctggatgggcagaaagatgaggccaggtcttcattctgtcccaggtgctcagaggatatttgtggagttgaagagaaatatatattggcatggtgtgtggggttttgagaaaatccgtgtctttccccaacacgaaggatattcaacgacacatagttcagttcctctgaaggcgcgtatttcagagagttatcccctagctgatgaacacaccaccacccacacgtggagtccagggaggagccaagaccaaggggctggaagggtggcctcttccccagccttaagcccaaattgctcaggcaccgctgaaggggatccctgggtctgattttcagagatacagggctgtgggagctatggggtgacacagtggaagaaaaagaagtgcggaagactcaagggcccttgactttactgccagctgccagaaagttgtaagagacatctacagtgagttcatgacaccctggaattgtgcagtgaacaacttgagcaactgtaagcagtggccctactgaacagagaccatggaaagggagtggagttagccaatgtgcccatagatttatagctttaatcaaacagactgggagctacagggtcagatttgatctgcaaacaggaagaactttctcactatcagagttgttcaaaaatctgaatgggccactgggctctcaggaggtaatgagtttcccatcactggaggctttttaagcacaggctgaaaaacctcttatagggagtgaagagtatttaatttaaccctcaagaaactaccttcagacagtttggtatataaatgaagggaccctgaagcagacttctcctgggatccagagtccatctcgaggtgtcatagcctccagggagtgggctgagttgtagagattgggcctttttgcaaagagtagattcagtttaaaaacatccctgttcagtgtccgacttaacctctcacaggggttgtgctttgatggtatttgtcagctccctgctggctctagacaacagcatggcgaaagagaccccgtgctcgtgcccgtgggcaagttgcttctttggttgatcttgctggagacagcgcacggtgagggccttgctggagcagaaggtgcgcattccacagtccccaatgggtggtggaggaggtagccagcaaacagcacagactctgccaatctccccaaagcaggtgccacgacagccagcaggcctgtggaaatgcctcttcaaagctggcttggctctgcccagcaatgcaggctgagcccatccatcagctgtcctactgcctgccagcgagagtgtctgctgggcttgccccgccagccagattggaagtgtcaaatgcaggccgacagggctggggtttggaggaggccctcagaggagccgtctgtgccacagtgatggatgacaccaacagggacgacattccggggattttgattctgttccacacatctggcaagctccttaaccagagcagctgcaaagctcccatcgcaggaactctgagcattttctgagagaccccaaacatggactgagttaatcctggtcaagggacctggagcatgtgcttaagaaggtttcccaatgcatgctacttcctgaaagctaaaacccaaggactttcatgaaacccaaacctataagagattccaggatcgtaaaaaggcaaataaaacttggagttaggtagacctgggttatgatgtcatctcatttggccttcatttttccttatctgcaaaataggaataataatacctatgctatagggttgctttaaggtgaagtaagattgtgggcaaccacatttatttagtttagtgtctgatacatagaaaatactcaacacattataacctattattaggataatttggcttaactcaggatactctcatgatccttcctgataatttctagaaacagactgaaaactagacaaactcacaagaatttctttttattcctgatagaaaattcttgaacagctgcccctttctttcccaaagctcctcccttttctatagcctagagaaagtcacaaataatctatgtttaaacctgaactgtttttctacaatctaccagtggaaccaaaatttatggcaggctactgtgcctctctacccaggaaaatatgtggacgagtttctagatcgctacagagctcatcaggtattttctttgccaagtacatttgacccatttcttacacagtttcttactgaaattccctatttgctctgctttaagcagacaccatttttttagccagcaaagctgcatgcaggccaatcagaaagcagaaaggcttagccactaagggaaaaataaatccgtcaatcacatacattaactacaggtagggctttgtgctgggcactctggggttaaaagaggaatggaaatggcccttcctcttaagaaactaactatcaagttggaggaaacaaataagatagaccaaatacccaagagaggtgccatctgaggtctagctatgacacttaaaactctccagccaactgggccacagaggaatgctcttgaaactaaaattcttatcccattagcaatctaatatcaatcaagccctgtgtgtcggtttgttattattgcataatacgctaccccaaacttagtagcttaaaccactgaccatgtatttaggtcacaattctttgggttgacaattttggctgggttcagctgggcagttcttctgggctgcatcgggctcagttgatcttgactgggcttgctcatgtgtctgcagaagctggcagattggctggcctcttatcttgctgaatattggctgggctttcttatatgtctgaggcctcagctaggaccactaggccagccgttgtccacatgttctcatatgctcttgcagaataggccaaactgttcacatggcagtcatgtgggtccaggagtgggagagatacagagtcgagagagaacaagacttcttaaggcccaggctctgagctggcacaccgtccttccatcacacatgctattggccaaagcatgtcctaaggccaacccagaaccaaggggcagggaaactgactccatctcttggtgggagaaactgaaaagtcacattgcaaagggtgtgggtgcagggaggggtggagaatcaagggctatttttgtcatcagattggctcatactgaagcagagtttcactgtggaacttgagggcgccaggcctagacttggtcacttctagctccctcacctcttcactactctttaatctccttccttagctggctttcatcccccacccaaccttggctggaggcttccttgaggacaaggccacatcctactcttatttgtataactctgcaccattcccaatgccatcctgcacctggcataacacttggtccattgtaggttcacaagacaagttacatatgcagacaataggattaagtgccaacataatgggaaagacaaaataaggtttaatcctagaagtggagaaaccctcccagatgatactcctgtaaagcaccttcaaatcacatggcagcccatcccaaatggaaaggatctttgtgactttccttgcacagccaccagctggatggcttcttccaccctggctacctggggccactgagctctgctcgttctatccatcttgactgaggcccatgggccctagagaataggaagcctttcttagcagcaatatgattcaaagcctatgtattttatttcttctttggcttcactgagaggtaagcagaccttgttaataggtctggattcaagtcaaaatcctctaacagacatttcattcatccctcgtcacctggaaaagtcacaccataccatctacatcagaatcttccccatttctaaatatctgcaaaagaagtaattcttaatggccttgccaagattagctggtctgactgccaacctgtgggagagatgggagaaattacagaagcaacctgaagggcatttatctataaacatctgttggaaaaacaaaaataaattcttcaaagaacaagaaataactaagcaatgcaatcagctccttatcaaaccccattgtctctcctaaatgtcagtttgaaatctttcatgtcaaactcagaaaaacatttttttcctcattttctccctctctttctctgctttatcacgctagatggaggaaaactttatttgctccaggaagacaatggccttatcttcaacctggatcctcagccctaaaaaggtggcctcccctgggagcattttcatagtggggaaaagcacttcgggagaaataatgagcaagccaagggagtcttgacttgacactgtgataaatgaggtgaaactttggcaagaaaccagagttggcgtattcaaaaaagaaataaaaagctagttccattttaatgggaaatataaaacagccattgtgcaaaagtcgatttttcaaaagccagagagataaagactctaacagaatgactgagagacgagtaagataatgtggttgataatcaggcttaggtaaagtgccatcctccaagccatcagctggctccgtaggagtgccttttcaagtcagctatctgcatttgctcgcgcctcattatcatatgcatctctggacagcttccttgcagcttcaacttgccgacttgccatactccagccggctggagagagcaaagtcaacctgactttcttcaaatcccaaacttccacagacctaccagccacagagctaccaggatctccccgccaaggccccagagagcaaagagcttgagtccagccaaccttacacatacctgttttttttcccaatgaccagtctagtgtgaggtttacaactgtaggcaagatccatgaacttttataaggttatccttgggaaattcctaatgagcaggctggatagtcaatggggatggtgggacacattttcccaagggtaagtgtgggagtacccaaggcaatgtaagaccccagttgaaacagttgagtgctacagttgagctagtgagatttaggggttgtacggagacaaactgccatagttcatatcctgccctttagtaactatgtgtccttggccaagttactcaatctctgtcagcctcaggtttctcaacttagagtgaacaatacacctcctagatttttatgaagatgaagttagatggtgcatgtaaagtgcttagcacagggcatggtacataataaaggctcaaaaaatgttatctgttaaaatgactctgtagataatgcttgaccatgaccaaaagaaaaatgatgagttttctttgatttcattcagcttggtgactaatgaagtcccatcaagaaatattatccacaggatgaggcaaccaggcactcaagtatagtgtgatctgaccccgggcagaccccatgtaggaccctgtagacgtgctaggtcccaatcctcttcctgctgttcaaagatgagaaaatcaagacttgataatacagttggctttcctaagttcaagggagtagaaagctggacttcgcttcatctcttcacttccaatcaggtgctcatgaccctgctaaatgtcaacactaccttgccgggtcatagcgtcccccaagtgaaaagatgcaaagcctgagccctcctttccactcccctcactgtgcagagctggagagacacatgattcctcctgcaggactttgaattctttggggaaaaggtgtccaactaaataaaatgctggcctatttgagtgtaatgattaggatttcttctgtcctgttaccatccctgcagactggacccctgaccagtatgattacagctacgaggattataatcaggaagagaacaccagtagcacacttacccacgctgagaatcctgactggtactacactgaggaccaagctggtaggtaccaaatctctttcagggactctcctgggagaaggtcagagcggagtgtatgtgggaccacatgcaagggcctctctctccgcctctctggccagtattgtgaaatagctatggaagaaattatttggactggcttttttttctgttagattcatatgctatgaggactggggaagttcttagagaccatctcccctaccctcaaatgacagatgaggtaagtgaggctaagagaggagctgacttggccaaggtcatgcagcaagttaatgcagcattgtccaggtttcctgatgctgtgaatagcagctgtattcaaaatcactcccatagcttagattacaggtcagaccctaaggatgcaggaagtccatgtcagccttgagtaccagactgtagcatgtacacattcagctttgggactttccttccctcatgcctttgccagaacttttccttcccttccactttttctttctcccttcactctttagaagctttccacaattgttagattgtgtgtgtgtgtgtgtgcatatgtgtgtgtgtgtattcatacacatgtgctcctaccacacttgtttttgtttttgtggcttcttaacccaagcagtgggacagaaaagaaaataagaagctgggtccaagcaatgccatgtgactaaaccaggagaaggaatggaaagcacttagcagctggaataaaagctgtgtaactgtgcaaagtggcctggaaggcagggccaagatacagggcatgggggaacatcagaagggaccatcaaaacaagagcagggcccagggatcctagttcctgaaccaaagaacaatgtgtgtgaacagaaggataaagaattccccaagggaagatccattcagacaaccatgaaaagccacaggcacagatgaaatatgacaaaatctaactgaacaagtagttgaagaaagatgaaggccactgggtcatttcctccttgccgccaattcttctgtcaccctcttgcctttggtcttctctcctgatgttcagaaagcttgcgtttcattaggggtgggttttctttccccactcctgacctccacccctgggcactggaagtaggggaggtcttcaggcttgtgaaataccttcagcatcagagacagaccctgtggcactcccagcaagactgggaggagaaaaacactgatgagggaaaaggggagtttctcaatgagaaaggccccgtccaaagccaggccgaggggagacagtcgtggttccttctcgcctctcctctcactaacctgaatccctctctctggtcaggtgactgcagttttccttgctgtttagggacaacatatgttttcctcctttccccagtttctggctcagtagttactctctcatttggggcaggagactgaaatttgatgaaaaatttggaggggggcgcttctcacctgcctttccttaccaacattgccttcttcctgtgtgtcttagatccatgccagcccaacccctgtgaacacggtggggactgcctcgtccatgggagcaccttcacatgcagctgcctggctcctttctctgggaataagtgtcagaaaggtgagtccgtcatcactagtccactcttccctctgagttaaacaagaggcagtcctttctgtgtgagaaagcactgcgcgatgccatggaaaggattataactgcaatactgtatcatgcatagtgtattcctctgcagggtcccaggcagcctctcactggatcctcacccctgcactgtgagatggaactagtacatccattctccagatgggaagattgaggctgagaggggataagggctggactctaaccaagatatatcccaaactcaggactttgtgcttagagtttagtctaactgcaacagagccatgttgtcctcaaatgggagagcagggaggatctcagggcacatgagacccaacccagttagagaaagggaacccagagagtgggggcatttgatcaaggtcacacagctagctagatgtagagcagaaattagagccctcgtgcctgacttctggcccatgctcattcattctaccatactcactgtgtctgctgccagtgaactcttgtgggcataacatgaggcagtggaataaagcatcaggaataggactcctaggggctaattttacccctagagaaaagctggattcgggctgctctagcaaccatcttacttcgtggagggaagtggggccttaggtatatgtacagctttgtggttgacttcttccctcggtgccctcttcacttattcttttcattttcaatcctgcaatttcttcagtaaatttttcaggatggttgagaatatcgagtataaacacagtgtctgggctcactcctcaacttctcagaaaagtgacaaaactgtaaatgcattctgaagttagctagaaaatggagagactaaaattgcagctctgtttggtgaaggtgtaacaattatcaaagtttttttattaagatataaaaattaagactatgggcatgggaagcaatgtgggagacaatcctccatgacccaaaaattagacagaagccttgtcctggcatagcccagtgtttcaggaccacggacaaggctacagacactgtcagtcaccccaccctcaaacattgttttatacatgtatccctctaaggaaaatgtgccccaaataatgtcttatgttatggatctcctacagtgcaaaatacgtgcaaggacaacccatgtggccggggccaatgtctcattacccagagtcctccctactaccgctgtgtctgtaaacacccttacacaggtcccagctgctcccaaggtaagtggtggaggccccttcgacgctagactttctgtgccctatcttgtacctgcacccttctgcatggaaggccagatgcatctgatgtttttgtggcaggcacccaagatggtccttttccctaggctttctaaagattcattatccctggattgactccacccagtgggaattgactggtctgtgtcccttcccacccaaaaagaatcatcttgaaactcacttcttccaggaagtagaccctgatctattcctgagagggaccaagtaggggaatgaatacatatcgagtccctgctgtgaggcaggcattgtctcaggaaatttacgttctcttttgctttctccaaagacacctcaaggaagagctttacagatgaagaacctgaaatgtagacagattaactcatttgctcatggccacatgggtatcagcaggcagagctctacctagctcagacagggcccaccactcctgctccgtccatgcttctttgtttccttactgagtgacccatctacttatgcacttaggcatggcctccagccagattgcttcatccacatttgcttatgttcttaaggcttctgtgtacacttactagagtgtcagtggatctgtctttcccatctggtgacccatctttcgcgaaaggatggacaccagtagaatgccaccaatgtctccttgtcatctcagacatgggctgcaactccttctgaagagccttcctggccccattcctgtgttcacagtggttcctgtatgcaggccaaacccctgccagaatggggctacctgctcccggcataagcggagatccaagttcacctgtgcctgtcccgaccagttcaaggggaaattctgtgaaataggtatgggtctctgccaccatcagggccacaagtgaggcctctggaaccctttcctctctgggttttgttgccagaatgtggttcaaatcaagtttcccaaactcgactattgcctcagccttctcacctaaagggatagggcgtgtctggcttcctgtaaagaaagtaataaactggggtgtagtgcaggcaagtcaaaccacttgggcatccctaggccctagcccaccttccatcagttcttgtgtgagccagaattaaagaactaagctcccacaccctacaaccactatatttcatgttttaagcaggattaaatgtgggacattcaacacttttttttctgaaattcgtggtgaaatctcagggcgataaatatgcaggtccagttctctcaccatgtcacatacccaccaagccctttttgggagtggcatgccaatggctgttggttctcacattgctacctgctctctcggaggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcaggtaacatttaccttatttatgctcagttgattttggtcacttattttaaaacagatcattgaaattcatcagcctcctttctaggaagattttcttactcagcaaggcaatgttatgctgctgtagtaaacaactgccaaatgtcagtggctcaaatacatcaaagtctatttctgggctggttgctgtggttcatgcctgtaatcctagcactttcagaggctgatgcaggcagattgcttgagcccaggagtttgaggccagcctgagcaaaatggcaaaaccccgtctctaccaaaaaaaaaaaaaaaatagctgaatgtggtggtcagcacctgtagccccagctaatcaggaggctgagatgggaggatcatctgaacccaggaggtcgaggctgtagtgagccactgcactccagcctgggtgacagagtgagaccctgtctcaaaaaaagaaaaaaaaaaaagaaaaaatgtctatttcttactaatgttccatgtgtcatgtgggttggtggtgatgatggcaggggattcagctccacaggcttactcaaatattcaggatcagcaagaagagactgggaaatgaagcatgagtttttctctacctcaacctagaagggacacatcctcttcccacacatactttgttggtcagaaataatcacatgagcccacgtaacttctaggcagagatggagaagagcaagtggaaggtctgttgaaggtgatggtctctggcccaaggatgttcaggctttcccatgtgaggctaatgccaccaccctccctggtggtgatctagtttccttcttccttttctgctgcctccaggccactctgttggcttcctgccactaccctttgtctggccaaggccaatgagtcagatgagttgcaggtgagggggtctttgtatggctttgaactggcttcataaatgaggattttttcttgttttttttttttgtttgtttgtttttgtttttgtttttttgagatggagtctcactctgtcacccaggctagagtgcagtggcaccatctcagctcactgcaacctctgcctctcaggttcaagcaattctcctgcctcagccttccaagtagctgggattacaggtgcgcaccaccacacccggctaatttttgtatttttagtagagatgggtttcaccatcttggccagcctggtctcgaactcttgacctcatgatccacctgccttggcctcccaaagtgctgggattacaggcatgagccactgcacccggccatgaagatttttttttttcacaaaacactagtactttccacttgcactcaccttgagctgttccctttgtggagctgtcttcgggggcggggggagggggggcctcttggcagcctttctcagaggattcccatgcatagaattcaaagcctcaggcagaggaacccaactctcaccatgtttatgtgatgattttactctcctgatatagaaaggtcttcatcagggatctcatttcttttcctacaaataatttggtatgtcctgtggatctggcatgagacttgggaccgctttcttgtccttgagattttcctctagaagaaaagattttgccagaaaaaatactataaacacccttctgttctaaggttttgtaacctgatggaggattcaaagaaatgtggtcccagggggagcacaagagtctagcaccttcttatccaaaggttctttaataagatccagtgtgttcatcaagccttgactctgagttgttttgttttgtattttagaaacccagatgcggacgaaaagccctggtgctttattaaagttaccaatgacaaggtgaaatgggaatactgtgatgtctcagcctgctcagcccagggtaaaggccatggctgttcagaagcccagggggtgggggggatggagatttgtagggagatgtccctggcacctggtccctccctcaccctgttcttcctccacacctgctttaccaattcccatcccagtgccagcccaactgcccaactgtctgcacccaccaggatgccaagcaggtctggatacctttgtgggtttaggtcaggtagtccaactctaaactcatggtttctgactccaaatcagtgccctcaacagatatttacccatctcttgctgtttgccagccactatgctgggcactgggtgtgcaatggtgatcaaactggctgggctcccatagcctcttaggatgcaaagcattcaaattccagcctcacagtcttcctggccatctgtcctggccccgctctgtgcccacatctagaatgatgtgcccttccaccctgaccagtgggattccttccctgagcagtttcacatatgtgcctttgatcttatggttacttctgtctataacataccatcccatatctgttcttgtccatatacaactattctttgagaaccaactcaaatatcccctcctccaggaagtcctccttgatttctcaagtaaaatgttatctctgcctccttacaaaccctaaggaacaggacaaggcaccacctatacaacatttactgctctctccttttgtgtcacagtcatctgtgcaaatgtcttatctcacctattctagttcatctgaatatcctcccctctaccctgaaaaagcctccacaattgtaagtgtgcactaataatgaaaggtgcattgatgatgcacatttataattgtgggggctttgtcaaggtgaagtacatacccagtgagggatttgtatatttacataaacataatgtgtgtgtgtacatgtcaatcttaggagtcacatactttgaaatggacaagaaaaaactacattgttaattctatagacttgctttatgttacgcaatgtattcaacaaatatcaactgtgcacctactgcatgcccaccctgtctgcaccagtgcagtctctcagctctggacccctgctcagctgttgggctcagagtcatacctctgcctgagccctgctgaggaactggagggaggctgaatagcacaatttatctttcttgtgtcccacagacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgagtaggtgccgctgggagcagggaccagggtggcttgagtggctgggggtgctctccccttcccctctgagcagcatctttgtagctctgtcaggattagggggtctgatctgttcaagggcaaaagaagggctcctgaaagccagagggaaaatagctaccatgtctggaatgtttaccatgggcactgcatttattatatgacatttaatccttaaagctgtctgctggaagacaagctgaggaaggtcagggatttttatctgttttattaactgtaggatctccagtgtcttgagcaggcctttgtacatagcaagtgctgagtaaatatttgtggaggaaaagagtttattgttattccctttttgtaagtgaggatcttgaatcccgggattcttcctttaccttgcctgaagttgtatggaaagttaagtggacaagtaagatggaaaccccattctatctgcttctttgacttcttttgtcctgccctgaatagaggaaagcatgctcctttgtctgataccatcaccaatgacccttctgagtcaggtgtcttcatccatgcctcctgtgtgccttagagaagcaagtaacttctggggagctgaagagtcaccccctcttctgagctccctgtgctcatggtcaaggctggtccaacaaagtctgggttttggaggtggccatgaaggtcttccagttcaccttatagtaaatgatttctctgggattctaggaggtgctcctcaagagaggtcaagcaggcaaacattagcacctgccaatggattttagaagattggttcaagatggcaatggctgtttctttggaaggcctagggagaatgggaggtctcccatgagaagtgggtaaaagttatagcttatatttggagcttgcttctgttaataaagcacttcccttacataatcttatttggaccctaccacagcagagttctgtgagtgagacgagggttacaaatgaggaggctgagtctgcagaaggtcagatttgccaaaggccacacagctgagcagaaacagtgccttcctgaccatctcattttcccttgcagcataaaaaccagacatctaaaggtggtgctaggggaccaggacctgaagaaagaagaatttcatgagcagagctttagggtggagaagatattcaagtacagccactacaatgaaagagatgagattccccacaatgatattggcaagttcctctttcatggctttcctgagggtcttgtcctgggtggatttctctatgaccagaaagctgaagtttggttctagaaggtgctcttgattgtttttggtccctgtggaccctgtgcggtagggaatgtattccagggatttttagtttttgagggtatgtgcaaatgtagataaatgggcatatgctcttaaactgaggggaagcaatgctaggaacattgtgctatggaataggcttggcctggaatcccagcttcccaactttatcaccaggagacagctcacctcctgagccctcttttctcttctatgaaatggaaacactgatgcacaactctcagcttcctatgtgtcaggagacacaatgtgcttgcaggcatgcctggcccctagcccctggcaggtgctccagtgcaaatgcaatgacgttcctagctaccagctgctcagttctgtatcccgtttcccttttcatgagacacccccccacctctctctccttcctcaatagcttttttcccctctaatggcctgtttcttaaaaaatggattagaaatgatttcaaagtcaattgtcatttcttgacatgactctcgccctgaagtgttactccttcctgggtggaagttcaaaatatgaaatgaccacggaagaagattttcaggcatggtgggggcaggtggggctttgctgtggccaccttcatgagcaagttggagctggtgcttctctgacaaagaggtgacatcgcatccattttctacctctctctccacctagcattgctcaagttaaagccagtggatggtcactgtgctctagaatccaaatacgtgaagactgtgtgcttgcctgatgggtcctttccctctgggagtgagtgccacatctctggctggggtgttacagaaacaggtgagtcggccatgcactctcccatgacttaggtgaactacatcaaccagagaagaaaggccaaactcaactgcccttttgaagttgaaatgagtgtcatattcaaaatgcatcaaccaaagaaagcatccacctcattgatcaagctctggttaaattcctccacctgcagggagccttccctgagtttctctgatctccatatctgtccctggccctacccctaaatacttgaattttaccaagcattgaccctgcatttatggagctcttgctcccttcctagttagattggaaagaggaaagatcatggatttttgagtcagacagactggtattcaattcttgactttgtcacttgaacaactgagttttagtttctcaataatcatacttacttcccgggtttgcaagcatgatcacaggggatgatagaattctacagagacattcattaagtcagcccttagaagatgggggtcaggtcccattcatctctgtctgtctcacagtactttgctcggggttctccacacagtagacattctataaaattgtgttaaatccagctgttgatttgtctttaggatttggtctaatttttaaaagtaaccaaaggattactttcctcatagtactggcaacattatacccactactacaaaaaaaattcagaaaggtatttcatgtcttttccaaatactcaaaatatatttctcttccttcgcaaatcctgtccttaataatgaatagcgagaatcacgataaataagtctgcagaaattccacatatctgaacaaagtgaaatgtaatatacaactttgagtcttttgagaaagatgtctggctaattggatttagggtcagccagtaaactcattttacagccattttcattgtagtccatctgaacttgtcaacctctattctgctcaatatggtctggtcagcatggtgatgtctcagttgggaatcttttggagcctcaggttagaattattttgcttttcataaacaggcttctaagactttatgttcaaagcctttatgttctctaagactttatgttcaaaacatgttttgattgatgtcattatctttacaggggaaaatgcctgctctaggaagcaggtagcctactgcgcagggcacttcatccatccatccatccattcattcactaagaattgtgccagcccttttgttaggccttgggaattttaaaatggttaagagagcatctatttcctcctgaacctcatggcctacctggggaaagagaggagggaatatactatctggtccatgtatcatgaccagcacaggattgcaggtctgcactggcatggtgaaggctaaagatgaggcttttctgcccatatcctggaaaaacccttcccttctgagctaagagttggtgggcttctccctgacaatctggtttctggtggggttggtgccaccctggtccccacagtagtgactcttttctctgcaccttccccacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccaggtcagagactccaagtggtgcttgtggtaggagaggctagcaggatgtttcactaggcagaggacccttagagccctgggctgggagctaggttcagaggtccacctgtggtaaagctaagacacaggtgagctgtgtctgccccctggccctctggtgcatctgcatccgcatcaacccaggatgactcagcataatgaccacagaggtcacattgcctgcactgtctaatttaactctcacaacacactggtgaaggtgatgtcatgatcaccattttacagatgcttagagaagttatcttggcctatagcaattgggtggccagtggcagggctgggatttgaacaatacagtctgcaggacaccaaaggggcttgtggcctcagtgtagggcagcctttctgagaatcccagtaaacagggaactgtccagaagaccagtggctagaaggagaaagaagaaggcctagagctagagatttcacagtaatattaactcatgattaggactcatgtgtgcgtgtgtgtgtgtgtggggggggggggggtgttttagccctagaaaactaagtatatctgtagcctagggcctttcagaactccaagttgctgaggcttgtgactcagagacactgttgcagagagagaaggtggtggctccatcaaccaatgctaaagtgacttcaggccctgccccaagtcaaagcccattccccatagtccctttatctgtagggatcacatcacacagggtcctttctagaatcccaggaacacctccatttagaattttctgactgttgtccccataagccttctaaatgtcctggaaaacagcatgccaacattcaaatcccaactccttcagggagcctccccgtacaaaggaacccacaatgatttgctggccttgaactcactttgggatgggacatcaaggttcctctctccagggtttgtggctctcctgtgactatctgtctcttcccagtgagccaaggatgttcacctactcagaggaggggcagatgggtgcaatttgccctaaactccttcccagaagatggttaagaaaacagctcattcaggctgggcatgcgtggtggctcaagcctgtaatcccagcactttgggaggctgaggcgggcagatcacctgaggtcaggagttcaagatcagcctagccaacatggtgaaaccctgtctctactaaaagaaaaatacaaaaattaggtggacatggtggcacatgcctgtagtcccagctactggggctgaggcaggagaatcgcttggacgtgggaaacggaggttgcagtgagccaagagggtgccactgcactccagcctgggcaacaaagcgagaccctgtctcaaaaaaacaaaaacaaacaaacaaaaaaaaacctcattcaattccctagataattgaaggctttcacttgcaggctttggaaacaaatagttgtgaattgaaacctgtttctgtctcttactgtatggcttttatcagtgatgaaagcaattcttcaatctcagatgcctaaactataaaatggaaatctatctataagatcacaaggtcgtggctaagtttaaaatagagaattcattttttaaaaacctgtcagttgtagtgtttaagcagtattaagtttttgagagctatcaccctcaatgtcttcttctcctcaccatcatcatcctcgccaccttccgtgagggtttaatatgaaccaggcactgttctatatactttacaaacaatcttcacaagaaccctgggggatggggatctattgctatctatggtttacagtgtgagaaactgaggcctaaggtcacatgcctggcaggtggtagggcctggcttaaaacccaggagatctaaccccatagaccatgctgagcacctaggccacgctgccttggagtccccaacctcctcccctatgtgtgctgagggcccccgagaactcacagtcataacatctgcatcactgagagttgggaagtgcagctgtgcggctcctctgttaagcccgcgtggactcagggacggaggacactgttatcttctctcccttagagtcttgtatcatgtgagatgtggggagagccttgtcactgctttccagagaagcccacggaggctggcaagggactccaccccatccctccctgacaccccctggagagaggtgggggcatctccagatgtctctggttcacgaggatgagcttatgcctctgtttcccttagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggacatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaagaaacaatgagtttgtctttccccatggccttgcaagccagggtggctttgcagcttgctactcacgtaagctccctggagacccaggccccttgcgttggccagttccgcagcccgccgagccatttccactttgtaggagccaggaggggtccagccaacacctctggtcaggttcaagtctgatttatacttgaccttgagggtaagagggaagcaagaggaatatgtcagcagggtttggagcggtttgaccattaagtaaagaagattaaaaaggcagccacagtatgagactatgttgtctgtcatcagtaaagccagaacaaggggaacaaatttatcataagcagcatctccctggcacaggggccgcaatgtgctgtgagtccagccggcatgttgctgtctcttgcatcttcccattcaagtgacaaaagttacagttgggagtgggtggggtagtgacacctgctccacacactctgtggccttagggaagccacttcccttctctgggcttcagtttcttcccagagaaagtgcaaaggctgggttaatagctaagatcccttggaaacagtttagcatagccatcgagagcttgggccctcacagcaaaccaaaaggggttggtatcccaggtctgccacttatttgttatgggatcttgagtaagtcactgaacctctctgagcctcaagttcctcatctgtaaaatgaagcagccctggggttggcataagtgccaatggcaggaggcttggaaagcatttgacacagagcctggcccacaggagacactcgagaagtggtggttattattgttattctttctggcactaaagtgttaggtgtcttggattctctctcagcccagctcccccagaagctaacaatggaacgtggcattatggccatctcttaggaagaggcaccaggggaagggcctcaagggagtgggtggaggtggctcacatcactctgcagctggtgggccttctgagcatgcctgaggcccagctgctccgggtcgcaggtgggctggggcaggggctgcctgtagtgcacatcactggccagctgctggctcctcttggcctgaaggaggccgggctggtctgtgctgctgtgaaactgggaccgactcttggcaaagtccttcttgtactcattgtcactctggagcctgccaacgttgaggaaatgcttcatccttgggtcatcgtcgacactgcggtacccgatctgcaggcctcggtcccgcaggaaagcctctttgtaccggaactgcaagtcagaggagcagaggcagatcatgggtgcctacctcccccaggaccagcctcacatatggggccatcccagggcattctcagcaggaggctcaagagtgggttagaggcacaggctttggattcaaatagacctatctgtgtggccatgggcctgttactgagtttctccatgagcctcagtttccccatctgataaaattggagaatgatctacaccccataggaggttgcgaggattcaaccagataaggactgagcttcatgtctggcatcagctctggcccactgagtggtggctactggtattgtcactattgtaattaatactccaacaggaagataaatgtgcccattctcacataggccactctgcctttgattctttccagcttttagggacctagtccagtgctcctcaaaccatctacagtgaagggccagtcccattttgatttgctttttacatttccaatgcatcaaagacccatgtatggtcctattgcatgtggctagtatgtagcagtaccacttgtatttggtaacacccaacctggccttcacccttttcaatgagatgagtccagtgatcacatgcttggatgttacaacgtctaattgctaaaaaatatttcaaaaatcccatgctcttaatttctgtacttatccaattgtggaccagcaggaaactgttcccaggtgcgcct

SEQ ID NO: 16664 - DNA, 130298 bp, Human
tgggttacagatggagactggaaatatttactttagtggttctcaacttgagatgatactgctcccagagaaggtatttggaagtgatgagatggtaaggataaccaagggggttcctgttggtatttactgtctgggggcttggagtcctacaagtccttcagtgtttggggcagactccccacctaataccctgtcgcagataggacaactcattcagtacacagatgaaaaaaacagagatcactgaagcaaggggagtcgatgcagggtcttgtggcaagatgcagacacaaccggactaataactaggttgctcaccacgggaggcctctaggtgaaagctctgaatttgtagcagacacacccacctcgtatagatcctagacgtcatgggaaaatcgactgtgtactttggcaagtagttcttgggcaatgatcttccagctttaggtataaccaaatttggtttgaatttgccaagcagtcgtatcttcgaggaactccgtcggctggcttgtggatggctttggcacttctgtctctcgtgggatttgtgcaaacccttctttctgtattatcctttcctgtcttttttctttctattgaaattgttctgaccatcaagacctaactctgtgcagccttccccagtctattgtcccagaaattctgtcatctttcttggcatttcctgagtccctgagtctctgtcacagtgtcaccatgttctgtcttgatttacctgtgtctgtaaggctcctcatgctggcaaaactccccgagagcggacatctttgtctctcctagtgcttgtcacagcctgtacacaaagcaagtagtactcagtgttcattgagtaaagttttctatagaattaatattaaaaccagccatttattttgcttgaggaggtctccgaaatgaccaaggtgtctccttatatcttatatcccctccaagcattcattaactgatggattagtgagttggccttgagaagcataaaggctcgtctccatgtgcttctaagcattgtgtctaagttctgtttggtttcctgagtgaaactgtcttaatgttaccaacagaagttaaatgcctaagagtttcttatacatgggctgagtacctctgtgactgggcaagccacctcacctcattttaccttgtctgcaaaatgaggaactgggtcaactcatcgttcaaatctcactgaaagctaattgatcgcttttgacagaagtagctcccttgggccgtatatttatttcctagcttggaggaaggtggggacagacagaattgatgtacacctttatttttatctctatggtaaacctgtgcatactaaagcattcctctggtcttttgagatgagtgtatacattgtgtctggccctgtgcattttttaccaagaagtaagttttgttgagtaaacttgggttgtatgaagaactgcatgctcaccgtactcaagtagcttttgctacctaaaggacagctgctcatatgtacttgacttcctttaaagtgaaggatgatgacatttgaaaaacggaggttgaaaaggagcagatttggaattgatggtttcctaggacacttctggcttgagatttgtgttttactttcttcctttggaatagctctatattctttcctctccctccccacctctcccactcccctccagcccccaccaagttaaggtagtagtaatgaaatcattttttctgaagctaccctgtactttgaatgcaaagacaaaaaatacagttgctagtaacattaatcttctatatgtgtacttactgaacttgagctctgaggaagaccctattggaattgcatgcttttttatttttttaatgattatttgcatgcttgtatgtttttcagtttctgacccatgtcacagttatttcttgggctagttgttctgcatttactttctgaattcattgtttttcatttcacttttgtttcctctcgccagtatctccagatgaaatggccactgcttgatgtccaggcagggagcctccagagtagacaagccctcaaggatgcccggtccccatcaccggcacacattgtcgtaagtaacctcccagagatgatggcttcctttattgagggggtgaaaaagaaaatgcttttttgatgataacaggccttatttgtcatttttttctttctttaaacacattttctttggaaatattgttgggtatagtttatatctataaggtattcattttctgctattggaccttaatgattgtaacctacctggaaattttacaaacctttcctccactcttttccatgtatttggttaaaatctagccttgtgggctctagtttataggacacaatcaccatggtatggaggagactagaggtggtatcaaagcagttataaaaatacattcagggcaggtgaagtgaagaagagggaattagaaaactcaaaagggggtcctggatttgaaacttgcctattatcctctcccccaatttatcttaatatttgttggcaacattctacactaacattagaaaaatttcatctgggctggctgacttgtaaacctagagtagaaatgaactttgaaaggctaaaatggaatttaatctatacatccatggctttgaaagtatgtaggtttgatagagaaagcatttgtttttagtactaagagactacaagtgtgtgtctacatatatttttaatgtattttcttagggttttgtaggctctaagagtggaatttataaattaacctcttgagaagatagctcagccttatttgaagattcccttctatgtatttatatcatgagctggacttcatacttttgaaataattaatggaaggcatatttttataatgaatccatccatgacaggtagaattatgcaaagcatgaatcaatcatgggtttttcatttgagtatcacaaaatgttaatcataaatacattttgcctctatattgtaatttctaaaaattgcaaaataagtttcttaagtagaaaaatcttaagatgcattctgccattttgggctaactgcctccttattttggagcttgctgtaattgagcatgtgttatttaatgagttatacctctgtcatatgtgtgtgtttatatcacaaaataacttatttttataaaaccatattttgagtcatcatttgtgacaatgtcttcttttctctggtataaatgaggcatgtagaaagaagattgacatttgctagaagcttcccctttcctctaactccacaataaaatggatgctcataattacatctgctcctataaggtcaagatttcagggctggaagtgaccttagatcatttaggcccaacttgccctcaggaaaggaaactgaggcccagagatgccttaagtgaattgcccaatgtcacacgctgagtcagtggccagagcaaggcttggatccagttctctgctccctttccagagccttgtgatgtcttctctcctacaggaggtgaaaataactgctgtggctggttctgttttgctgactgtaaattgggtcatggtcagggacagtgcataggtgtaaagaagttgctggttgggggttctaatgcaggtttctccaaaagtgaatgccctgttaaaaaaaaattcttaacaaatatacagagattttttttttaaaaaagtgtgacagttctagacacctagagagtaaagtgaagaagcctgttttcaggtttcccgcctccctgaatttcccagcatggtccaggctttgaaatttatttatctgcttttggcaatggttgatgggaatttcccacatttattttttagctacagagaaaggacattatctttaaaatctcttcgttgttctctctctttgagtgaggagagaagatgtgaatcctggcagtggttcagagtggacacagcccctgtgtttgtggcataggctctgtgggccccatgccagggagcagtacccccgtgtaaaggagtgggggtttgtccatttggatagagcaaagatcctccacctcaaatcccacaagaacagttgccacaacctgggccctaagcatctcattttcctatgtagaaattaatgatctggaggagatggcaaaacattccttccagagcctgtgtggattttggccaggggtgcagcaagggggcttaggcacctttttcctctgctgtgtcttagcaggcgtgttgaccatagcaactcccctggggcatacacaccctcttgtagatggagacctttgtccaaagcagccacagctggcaactgtctacaatcttttgggctttctgctgtgctcaaggggatctgggaatggccattgcctagaggggatgggctggtggaggaaggtgggctctgggagccggggagaagggaaaagccatgaatttggacaaaaggacaaatgtggtttacatttgtgaaatacttgaatgcttgtcatgaatggtgactttggttctatgagtcagccctgtgatggggtatttctgcagtcttcacctgacaccaggggtgagaaggaggatttctggggaggaggaaagagttgagggagataggaaagtagagtggaagaaaggccttgcgttgttgacctctatccacctggtcacctatagtttttgggattgaggatgcatacaccttgagactacaaatttatgattatatttttgctgaacataaggcaatgtgccaaccaaaaccagctgttctttggctggtacagtgtgtctttgtttgtaaagggtgcattctgaatggtggctgatacatcatttgggtctttgtacagttaaacattggccagagggtctggttcgtgtttagagtcgccgatgaagggctaacttttctccagacacttggggctcttgttcacactttgcttttcactcttttaagtaagacatagtcacatcacagtgtttcatcagacatgtttcaaaataattgtctaaggattgcttcttaatttccccgaaatttggaattgttgtaacttttgggccaagctatttcataattatttctaatgtctcgcttgaagaatagggatgtattcagtgttgattattaatcattcgaaactacaactttacagattgctaagaagaataacttcttccagtacccatatggggcagaatcttcacgtgggaattcagagcattttgttggactattttaatctgattggattattttcatgtggtatgtgggttaccacattagaaacgattgatgtgtagaataaatgttcttaacaagtggaggtcaacttatcaaatgatatttacattaagaatagactccacaaattttagttcctgtagctgatatagcatctcatttgttatataatccagtgattcctaatctgtgttcagaggagagaggaaatcgattgcaacagggacgatgccttcattggctggcccaaaactgggagtttatacaaggcgtcagtctttgccttcctcctccctgccttccctcttccttcttccttccccatactccccaacaaattcatggacttcttaacaactcagagacattagccacaagttccaagacacccccaccccccagcctccccagtcctattttcgcattcatataactaaactctttttctttcttggtggagttttgaaatttatatttttaattctttgctcccttttttcctcttacaaaatgagtgccaagcagctaagttgtgctgagtggtagagtttgagtcagtcttggctggtaagctgtggggttaggagccgctccctggataccacctctggtgtctttgctatacaaagactttcatttagcctcctttgtatccagcaaaaaaagattcagtacccaaaatggtggtattttggtatagtatgtatcttacaaaacggcaaaagacttcaaaagttcctacaattttatcttgggggtttccttttgaagtcgatgtagaattttaccttggggtggattttttgtacttcttggtctggtgtgttttgttgtgtaatgagcatggaggtgtgggataagaaagcagactgaatcccgaggaacaaagcctgccagactgtggtggtgtacttttcttgttgttattgcttaaatgctgcaagagagtggaaaactcttacgaaataatgcacgatgggtagaacttcagagaaaatctctgccgtctaccctgtgcattttcgaggaagctcagagggcatgctgaacctttgctttttgtttctgaagagttcaggggaacctacccataattaattttttaaaacactacctagagagcaccctcttggttattaaacacatgcgctgtttcgatgggatgtttgacctggattgtggatgcttgctgggacgtggcatgtgttgggaggctctgtgctgcctgctgagcaccagcaaagccacagtggcccctacctctgtgggaggccctgtgccaggtgccctcaaagagtagggggcccatgagggtatgaccagggggacctgatttcggctgagaagttggcggggattacaggcctgggcggctccctgaggaaattgcattaaaaatgagatctgaaggcttgattggggttggcccaatgaagggataggagaagggatggggagtgggcagaaggaaacacatgtgtgaaggtcctcaagggaaaagtgcttggcttggacagaggcaggaaatcaggtaggaggctagaggtcgggcagggctccgggagagtgacttggggtgcagcatatggtgaggatctgacactggggagtcatttgagcaggttggctgtttctgtaggagcgtgtgttaagctgctggcagtggggatggtgaaaatagagatgtggaggaaacagcagcggaacttgctgacaggttagatattggcattgagggagaaaggagagtcaaaggtaggtagatggagatgcttcactgagtggggagtattggaggaggagcaggtttggggtggaagcgttgtccttttagagagattgtatttgccattgattgattcattcattgtttctgcaaatatttagtgtgggaaaaagcatgctagacaccaagagagagtggagtcaatgaagaacgataacagcaacaaagactgtagcgcttcctatgcgaggcttgttccagttgcttcagaggctgtgttacccctgttctagagaggaggaactaggcccagggaggtggggatttgcccagtcgtgggagtcaggatgtgaaacaaggcaccctggctccagagcacaccgtcctctcaaccactgcagagaagctgggaaagagacaaataagtgggtgcttagagcacaatgtgtgtggtgtgccaagagcagctgggagccctgggacccccagggaaccccagccccacctgggcatggtgggcatggctggaggaggcctgctggctttgctggagagtgggacatgcatcaaggtggccagagactgggcttctgggtgtcgtgctgtgactgctgcaaagggctcattgacatatggtggggagggccagcgtattttctgcgggcaggacatttgggggatatggggtgtgaccctgtactatctaaaatcttttacttctggattatctccactttctctactgcatatatactttgtttttatttattttattcatttatctatgactcagccagactctctaaaagagttgacttgtgtttcctagcagccactgagtcagaactttcccatttcgcagtcagggctgtggtcagggtgtctgtgttgtctaaggatataaagcaagccttcgggcactaccaaaacattattttataaggagaactatgagtacctaataggaagaaccaggcaatcaggttatcttttggtgaggaagaagtggtagatgggatcattggtgctttgaagggagtgggtggtgtagactccaaagtgtacatggggccatgatagagtctatgtcagatgtccaaagcttccttctctcctcccagaaactctgtcctctggtgaagagttttgaagtttcctgaggtttgggttcatggtgtggcaggtgataccatggcaatagaaaatatcccatcaagaaggattgtgtgacctcagttgtagcccctgcatgttggaatcacaacaatttgcagggccttaaaatcaaatgccatttcaccaactgccctcccccgtttttttcagcactgtttggtagctatctgtttcccctgatattcttggacacttccagagatgggggctctatctcctggtggtagactgtttctttttggtacaatatgaactcttaagagagttctacctttagggagctgcagtctctctcctggaaatgctcaactccttaattcatgttttgctgttaaattctgctaatgcctcaccttacatgtcttgacaatttgaaggtagctattgtattccccgcaaccccaagtcttctcttcaaaatgattattaattgtaattcaaatcatcagtgactggtatcttagactacttaaggatgggaattgctaattttgtatttaaaagttgtacctctaaagtaagtgaaatttatttttaaacgtagctttcttcattcataaagtttatgttcattgtaggcagtttggaaaacagcccataatctcaccactcggagattacattgtgaataatttggtatatttccttttagaaatataccaaattatccttttttcctctgagtgtatgaatatttatatttgtttttaacatacttgagctcatagtgctcagtatttccaacgttctgtttatttaagatgaaaattgctgtagttaataagcacttccccatgtcattaaaatgcttaaggatttttaatgaccacataacagtccataatatgattaaaccccaatttactgaatcaatgccatattgttgggtctttagattgtctccttttgtttctgctactgtgaatgatcctgtgatgatcatctttgtgtgtaaatctttgtcccctcgccccctccccttttattattttcttgggatagaccccaggacaaaaggtagaaaagaacaaagtgttaaaaaatttcttgatacatagccacagattattttcctgaaagttctcaacatttataactacgagcagtatgtaagagagttatggttggaatgattttaatgtctctggggaatttaacaacaaaaaaactttaggcttctttggagagagacatgcccttaactccaccccgccctagaacagagacccagcccatccaagtcagcctccccaggtcctccaccttcaaaacaggcaaacgaaatcatttcttgaataattggtaggcttcaaggtcagatgtttattttagataattcacagcataaatttatatgttttaggtaccttagcccctgaatatactcagttcatttaggactattttagaggtcttgagtttactcttataacctcacatttttttgtgaatttttagttctattatctttgttttcatggcatattattgggcaaagatactatttattcgatgctatgtgtgagctgggtcaggattatgaccctgagttatgtttctgggaaaatgtacccacttgtcaaagatgccgttggctcctgtgattaaggtcagcccacaatgaatgtggggagggctggcagcctctcaaatcagctcttgaccatttctcaagctggggcctgttgtgcttgggggaagagtctttggcagctcagctcggggctagcgtttcctgacatttgtttcgctgaatgttaacaaggttactggaaaaaagggttctctcctaaaataggtttagggaagcactgggatatgcgaagtgaatgagtttctttagggcaggatcttgactctgcagggggcttggaggccttccctagagtggggcttcctaacactgcagagctcttcccaggacgaggggcaagattgggacctactttggaaggttgtttttgtttcggcacctgctctgtttacgaagcgtgggagcctgttttaaattaatgtgcgcctacttagagctacactcatggttttgactatgtttatctttccagtaaataaaacaaaattgttcatttggcacccagcctgtcctgcttgtcatttcttgtcttgctgattaactctatggatggggcatgtttctccaaccagattgtaagtttcttgaagccaaggagccctgtggttgatttcttcacatgtggctctctctcctcccacaatggtgcttcgttaattaagcagaaaacccatctctggttagggactggagttgatttcgtttggaatgagtgtgacttcatcatgacctgaaagtgttcagaaccatcttggttagcacaagggcgtggacgtgtgtctactttctacctgatgggatagcatgtttaatttggggttatgacactgaatggtttgccagtaacttgctaatccaaccttatacattccagctcacagtggagcgtgtctaattgccacagcagcatttatgtggaacgtggttgcacaaaagctccagaaagtcaggctgagggctcctatctctcctcaatcttggtttacgatgtctgtttctgaggaatcctgggatggggccactggctctttaagagagagcccgatttggaaatctaggacttgattgttgattatgggcaatagatacattttaagaatgatgttgtaggctgtatgaagtcatttgatgattgttttgttaatggcttgcaggtcagattttcatctttttaaattaattatcatagaaggagaaaacaactggatttcagaattgtcccttgaggtgtactggaaactaaggcgtgagggactcataggggtctggcttggaaagtgtattgctatgtccagtttacacataaggatgtgcaaatccagcaggttagctgagctgcccaggaatatccaggcaagaatgaccatattctgataattactcaggcctctgcctcatctccgctgcccccccgccccctgactctcttctgagtgccagattcagcctccatttgaatgccaaatagacaggaaattagcatgcccagaatccacgtctttagtgcactctctccccagctccaaacctgttactgcttgtgttcaacatctcagtaaagctcaacaacatcgacccattacttaggcctcaaaccttgggtggcatcgtcgattgctcttttctttcataccccacattcaacccatcagcccatcccacaggcccaagtgtgtcctctctaccttcaaagcgtgtgtggcatccaccgcttatcaccacctctgccattaccactggagtccagtgccatcatctctcacttggatgtggccagagtgtctttgctggtctccttcttgcttcctacctttgtaacagcctatcatctatctctggtctccatagctcactcccatactttgagagggcctttgaaagccttagacagatcatatcacagacctctatactgaaagtcgggataaattttatctctggaaagagtcccaaagcagcgatgaacagatattttgtcctgtcacttgatgaagaggtggggctttgagacccaagagcttagaatggagagcctagatgccactaagcccaggcactggccatgcttcgagtggagcttttgtgctggtggaggagagatggctgggggacacctgtaggctgagcaagtccccgttcatcagaccctggctcatccagcagggcgtggctgatgttttcaatgttgtatcctgagtgggacccagatgcttcccaactgtgccacatctgagccctgcatgccatctgtccagttgcagcctgactgcaatgtgaggctgctgaagagctctggatggtgtgaagcaatctgttttctagcccgagcctgcatagctggtggatcctggaccgtgattaagtgcatcacctaggcttcaatgagatggagtcactgtgtgtccaaacagtgggataaaggctttactctttgtcttcctgctctgagggcacaagctgcttgtttctctcacaaggacaccgtctgtgttgctcaggtgctggggtgaaaaaaacagcaagcatttgaaaaggctgaagaaggaaagaaagctgagagcggtacagccttggggactgagccatcccattgtcccagaggtgggggtgttatcaagacctgtttttgagccatacctctgactcttcctggaaagttagacccaactcaagaacacactaagagaagtgtttccccctagccctttcagattgaaaggagacgccaaccttgatgggtggaggtagaaaataaagtcccaaaacagtgtcttgtaagcgaaggggaacatggctgggcagagggcttctggtgaaacttttgggagtattcagttggaactcaggaaaaaaaaattgtttttttggaaagaggtagcagcccccttcagccaaagctcataaatgaaggaatgtctgagactcagaattacagtgaccaaggcaagacattgtcaaaggctgaataagtgagtttgactgacagaggccatctccatttttagtatatggccaagcatctttcccacagtcttccttgagccccttcccatcccacttctgaaaagcactgagttggccattattatgcttttttcttaaattatgaagttgttttcaggtattgagaataacacccaggtgctgaactcccagcataagaaatcaaacattcaaaatggagtaaggttctgaagctgacatctgtctctacacatttttttttttctgataatggcatttcctatctccaccctcactctttttgttgtggtgaactacacttcccttgttccactcggttctgttgcacatgtgattaggcaaggggcagatatgtgatatttattatgagtcttttccacgcagagaggatctaaatctggctctttgcaattgccttcatacatgtgcatacacaccacacacacacacacacacacacacacacacacacacacacagacacatacatatgcacacaccccgactcaatggaggaccctcatttgtagaagggtaaaatgggtgaggcggaaatgcctgtatggcaccatggagttctgtgtagccagttctaatcctgggctatttggtaaggaatgaagttggagatagtcttctgtcccttacaaccaaaggaattctaactaatagtttgccaagttttatgtttataataaaaaatgacatgctttttcttttggatttttaatgcttttgaattaaaaatgctagaacatgaactgattcttctatcgctatttagatagagccttgcaagagcagagcacgcatgctttctttaagaacaggttggtttgtggtcgtctgaggactgttttaaggagacttattatacacaatcatcccccacaaatgatttctaaagagaggctggtatgaaagaaggagtttccatgattctgtcctgtggttctggggaattctgaaaatgaactttagatatttttgtgaaattcttattttcatatttttggtatctcagagttttcttttctggcttctgtttaacatactcttctttgccctaaatctctcttatttttgctccttgggacaactgaagaatccttagataattaatagtatgaaatactgcccttttagttgaaaaatgtcacaataatgtaataagataaataaggaggtgtcgctttaacctgtatcgtgtagtctcctctacttactaacacttacttgtattactagaagcattattttttaaatcatggaaaattggtggcaagctgagcatacagttgtttatttctgtttgactgattattacaacttcattatttgatgaaggttctgtacgttttcctttaagacacatagaaattgtgagaagatcctgcagccccgaaaggctacagtgttgatccaaggactctgagccgagtgcagggtttgtacttggacctgcaggctgggtggcgtctgtgggagcagtgtgttgagagagattctgaggctgtatgtgtcagggcctccaggggaaggatgcattgatggattaatttctgccaaggctgaaagaggagagagtaagaggctgtagaggtgtcacagctgtcattgctgttttaggcagtcaagcttttgggaaagtgtcagaaattgagccccctactggatctatcggagccctgtcaaatgtccatttagatgtcctggtgaacaaaagttctctgactcaccatttaaaaacttgttccaaatgaaattatgggagaaaggaacatttttcatccgaacccagaatgaggatgtacccaaggaaaaggacgtaggctcaggagctggactgtggctcagctggcctgatgtatcccactttgttcctcccatggctgggatgtctctttgctctccatgacccatgtatcttgaggacatgacacatggaccaagcttgaactgcggattcatttttatgcattctacctgtgaatgattgcagcggatctagtcgtatttctgagagttactcaaactggacttcagcagtgaactctacagttctcttttcctcccacctttctattagacattgcatgatacaaaaatcaagatatttctaagagggtgataacttcaatgttatctaaacttttaatttggaagaagaggggttctttgttctttttaaaaagatacaaacgaacttctttatctgattctttttttggtgcaaacccatgatgccttcttcctgattcatctgctacactgtgagttcaagcctggcgtgggacacaggcacagctctcatgccaacgatctcatggttaagttttggaacataatttgaaaaatgtaacccattgagaggcagtaaggacatacggtgagctagtgcgtgtttggacgtctgtgtggaataagtgagtgggtagagaggacatttgtcaaggagcgggagggcgggccattggcttgggggaaatgggctgagactctaggggtggccagcactgcatatggaggccagcagggttgggcttggctaagtgctgtggtgtctggatgcctatgtgagtttcctccagaagttttcagttggcaaagtagaacctgctggatatgtagcaagggtgtggattgtcgggatcctgctgggcgcaggcgtgtgataccagaggtcagaacagaagctgagggatgaggctttgggagctttttgtcatgcactgtcctggagcctcagttactacaaagtctgcaaatgatagaccggagctttggttctgcctgatgctagctcccctgttcctgatttttcttttcaatattagacttaatcccagaattcacatgttgaaagaaaacttagaggtctagtgacataaaagcctcattttgatcgttacagaactgatgccttgagaaatggagagagaagtacacgatcatggtaatactggatgttcactgagcactcactagctccaggccttttctaagtaatttatgaagttgtcaggtttaatcctcacaacgcccttatgaatgagctattgttattatcccgatttggcagatgaggaaactgaggcttgaggggaggatgacgtactcaaggtcacacagctgggaggcggcaagctggaagttgaacccaaggagtctcacatcggagccaggactctcacccttcagtgttatgctgccttaatcaggcacacatacaggcggggagaggcaggtttccggacaccagactaggctggtgccggtcaggctacaccagggaacctggaggcctgtcattcttttgtgatgctgttagttcctgttgaggaagtgaggctttgtgggttcccaggaggaaaaggtatgaactcatggcaaaagaaaggaaccaaaaaagggagatttgcatcacaatgagccttctattcatcccaaattatacctccttttataccatgtgtgtctgcaaacttgtgggtaaatcacaaatctttctggtaagttacaatggatggaaggtttttgcatttctctcaaatcaccaaccatttaatgctatgtgtagtcactccctaatctatcttttgtataaatttggatctttgagtattggggttttccatgatgtttggcagttccccttagggtgtctatctcaaagtttgtcacactgacaagctttggggagagaagttagaggtgggcttccctgtttttagtggctgtgtctgattgttctgtctgttctccaggacaggagagattgattgctttctagctttttttaaaattaaaacaacaacaacaaaaaaatacagaaaggtacaaaggataacaaacacattcatgtacctgccacctaaaataacaattactaatcttttcaccctcctagcccatgatcttccctcccaggctgttattaatatgaaaaccgagttcaggtttttatacttttcgacatctatttatattaacgtatgtattataaataatcttagtagtttttaactttgacataagtggcttcacattccacataacattctgcagcatgttttcttttatttttatttttttctttatttttaaatttttattttgcagcatgcttttcttattcaacattacatttgaattttttcaacattgtacattgaaatttagctcattctttttaactgctctgtagtatttattgtatgcatatactacagctttctatttctgtattgatggttaattaggttgcttacagttttttaagattacagattctgctgtaataaccatcctttgggcaagtgtatgtaggtacctatatatgagtttctctaggattcataccaaagtagaggaattggtagggcattggtttgctggttttaattttaattcacatgctattgtcaagctctccagaacaactggatgagttgattggatcaatgagtatttccatcaccagcatataaactctttcctcataatcacaccaatgcttgatcctgttggacttaaaatttttgccaatttgctgggtatgcaacggcatcttacctaatttgcctttatttgatgactcctgaggttgaacatctggtcatatgtttattttctcctctgtggcttgcctggtttaatgccttcttcattttaaagaatcagatagttttctgttattgatttataggaactctttatataagttgaaaacttgattatatgtgttggaaatactttttctaggctgtgatgttttaaaatattgctttagatgggttttcatttttaccttttattttagagatggagtctcactgcattgcccaggctggattgcagtggctattcacaggaaagagcatagtatgttacagcctccacctcctggtaccaagaggtcctcctgccccagcctcctgaataggtgggaccacaggtgcacatcactgtgcctagctttggatgggttttgaaagaaagaagttttaaattttaatgccctcaaattcatctgtattttcctctgtgcttttattttgtacccactctaagtagctccgaattctgcagatagttggtgcaggaattctgattttgagtggacatctgctctctaacagtcacattgaaggaaattaggtttttttggtaggaatctaagcaaggggttgatttgtaaactaggctttaaatatgattttaagcaactcacttagaacaagatacaaaaattgtggactggacctatatctggaaaacttgaaagtgctagggcaataaataattcttggtcacatacagccgagatcctgggctcctgactctgggacagaagctttctatattttatctcatcagtctttgcaacaggctccttgaagcaattttatccccattttagagataagaaaaccagagcttaaagcagttagataatttatgaagtaagtggcagagccaagattcaaatccagacctttctgaccacaaagctcgttgctgaataccgcgcctcattgccttcttgcgaattacttgggatttgtttgaatcccaaaatctttatatgttattttaaatttgaatctaattggaagtggggcagtgagggtagaggacagaaagaaggggaagagcttgagactcaataatagaaacaaaaaacccgtctccaggagggcggttcaaaaggaagaattccatatttcatgtaactgaaacgttaaaagcccaaataattgcatcatgcaagtctgatgctgagtaatcaccctcccccatattattggggagagggggcaagaagtctgggaagctgtttttgcctaaggaattacattccaggggactctgaggatttaggtaaccacaaaagccatttatttcgagtacactgagatttctaccactttgatccctaatccatagcataattaataaatgaaatgtgctgtagcatgggttttttacaaagtgtacttttaaaatggcttttggtctgacatgattcatttgccacttggaaaagcgtcatcgcctcagatgggcaggctgggagaggctgcctggtgggtagctgagggcggtttcctggggcacagttcctgccttgggcctctacagagcggtctcatccaaacatctcccagactctgcgttttccaggaagcgtgcagaaataggaggccagtactgaaatgctatctgctctgtgtatgtcagaagaccacaaaccacttataacaaatgaagatctttttatttgttcttatccctttatgtcacttgaggaaagttgctgtgagtaggtgatgatcattacagtgatcactggttgcccaaactgagaagccagacatttggcttggtttctctcccttcctcttgtctctcctaccctgtaaacacatacttggtgattacccatggggagacaagacaggctgggaatatatacttctgcaacttcagcctcctgggttccagcgattctcctgcctcagtctccagaagagctcggattacaggtgtgcaccaccaggcccagctaactttttgtatttttagtaaagatggggtttcatcatgttggccaggctggtctcgaactcctgacctcaggtgatctgcccttctcggcctcccgaagtggtgggattataggcgtgagtcaccgagcctggccccaggcaataatataccagtgggcaagaaaatattcttgctctcatgggacttctgttgggggtcagggtatagggaggaaggcatagagatgaaaaccagtaaataagtaacaggggaaaacattttaaatacattaataactaataaaatagaaataaatctgttggctacttaacaggatgtgccacattccagatacattacgttaatccttatgatctttgggggctaagtattagtattccattttacggatgaagagactgaggctcagagggaagggaggtggcttttctcaggtggaaagccagaccttttcagtggtcattcagttcatagctaaggtcttattttctgtgctctctgtcggctgaaaatgggcaaggtaatttcacatagtgacaggagccatgtcagagaaagagcaggacagtgggacagagagggaccaggctgggggctgtttgagatggagggtcaggaagaaccaaactaagatgtgaacagtgggaggtgttggagctgtggtgcttgcctagaaggaccctcatcgagcaaatagaagcttctggcaggaagaagttaatgtcttgcgtgtgccctatgtaggttcattagggcctttaaagggggaagaaggtggtggctataaatgttacaatcttacctttggcccctagggattctgtctttcaaccttggttcagtaacaacttgtgactgcccaacagggcttcctttcgggagagaatggcttgttacattcaaatatgccatgaaagtatcaccatttatttcagtgtctgatgccccagcttgggcagcctgagcaggctctgaatgggtctgaagaggccctttagagtagagatgaagagggggtggggaatcctcaattctaaacaaagagtctgcaatgggaagatggccaaatgctgtttttggagtgggtgagagggaaaagaaaggtatagatggttcgttggaaaatgtggttttataccgggttttggtgtcaggtccccgagggcaacatggactccacactgtgatcctccgggcagctcatagccccagccccttccttttgcttcctggtcagtttgtgagaaggaggggttgtgtctccaatctgagcaataaggggtctgaggggggttggatccatgtggctttcctgtgtcttgttccttgtaaaagttccaggttttgggtcgtgagctgtgtgtgtgtgtgtgcgtgtgtgtgcgctgtacgttaatatggagagatgggcttgggccagtgggaaatagagagacccgcaagcacagagtgacagggtttgatagtaagcagcaggccagcgttgctgcttttattcctcggtaaatccttgcacaatgccatatgctcttgcattccgtagctgctgcatagggtgtgatttagttaatgcccgctctgcaaacaggaaacggtgctcactgctgtgtatgcttttcatggagataaagtgtcaggagcaagaccccaaacctgcgaaatcactaatgcaaccgccccccatgccccaaaaggtgggagtgggggataaaaagagtaggaaagtggtgtggggaggggaagctttagggccataactcagacaatttgtcaggcagtggcatcggttgggaggaaaatattgatgtacactttttgtttttgaacctgaagtttgggttttttcggatgcattggaggacttttaaatgttttcggagtgccagagtttggactgttaggtcaccgtaggtaccggcttgcatatcatttcagaggaatattttcaaaactccataaaaacatgcggctttcaaggctggaccacttgttcaggtcctcctcccaccccccaccctttttggcaaaaccatgcaaacattggtattcaaaaatattttgttacttttcttggcaaagtgttccaagaaggaattgcaacacagtctcagagttaggaggcaactttctggggaaaaggcgggggttggggaggtttggagtttgaatcaaaaacagacaccgaagctttaataaaataaatgaagcggagccctttcagctcacggtggactgtgttggtgcgcgggtcaggctttaacgtgcctagtggaaattgacagtctgagaactgggacataaacaaaaatgtcagtccctgggagtcttgttcactggacaatgtctcaattgttcctttggttttcaaggcagcagggagagtggaatattaactgtttactgcccaaagctggctcggaaattgcttggagaaggggagaaaaaagacagaaaatcacattttttatttagaaactattaaacatgtcagtaagagataggaaaagagcagattgttttctccttaattatctgccattcacttccatatttctgcataccatttttggggtgtgtgtgtgtgaaggaacagcagggtgtttctttttaaatttgaatgttagccttgcatattgtcagtttttaaagcttgctggcatgtagattatccgcccccggtggatatgacagtgggctttaggaaaggaagtgtgatttctgataacatttacatcttagctgttcagcggataccctgttagtgtttgttcttcagaatgctcagatagaacaaaaatcaagtggttggaattttaaaaaacaaaatgtatttggctctccataaaaatgcatttagtgataaaggggggcagcaagtaactatgtctgagagaaggaattgcaggcacagaggagatccagaattctgttcacacttgaatttacttgattcgagaaacaaacagcaaagcctggtgtattggcctttatctgggcaaagttcaaaactcaactggtaattatgtccttagaagccttaaaaggactgtgttgttacaaaagcagtgactgagcttacttcttcaggaccgaatgcactcgagttgtttgttagataaacttgttttaataaatgggggggtcaggggagaggtttctgttcttggaagattccctgataagtagctttcttctcttggagaacttcaggctttctctccaagcgaggggtttgcaggcagctaaagtcagcttcggcttctgcttcctgtcagtcaggaagtcacttccttaacccaaattacaagctagagcacaactccccagccataccgaaaagagcaggtttttcccagaagactgtgtttctagatgcggaagtgtaaattggtacgctgtgtgatcatggaatgcccaaaatacatagggaacagtgttgttggaaagaggcgctgtgtccccaaggagaagacgccgcccagaatggctggatcgcctgttgtggctgagtgcgaggcagctgtggctggctgctgtgtgacgatgacctagtagccacccatgtggagtcctggctgcctcagaaccctatcacatctaggcaaaatcttgcattttttatctgggaggcctgaggacttcagggctggtggatagtaagctccttggttatctcacagatacaagaggtcttgggaatccacgatcaaacttgatgtgtgcgtttaccctcctccctttgaatctgttattcaaatatttaagcctccaaccttgtggcccctacctgcaccacccctcacccccccgacaaaaatcaagctcttgacctcatggcttctttcagtgacccttgggggacagagtttcccaaggctggttgccagctggcatggtcccccgttggtgaagtggagacctgtgtttttttggtcattttgcaaagagcttatggatgacagcagttctctgtgcctcgctgggacagagtgtattctgaggtccagcgtctgcatggagatctgcctatccttcacttggggtgctcagtagataacgcggccactttcctatacatttccttaatttaagggaacagcgtaaactcagcccaggtggattaatctctccagtgacttttgaaacttcaatctccaatttccctcttatgtctaggtgtgagtgaggatacgtgtagtaattgtcgcaggtattagtgagaaagggtgcagatcacacaaatatttcacacgttattagttggaccagactttggaggcaagggagggccgtgtcacctaggaaatttgctcttccgtggagatgaaagggcagtgaattaagtgcctgctttttctccctttttccctctgacggttattgatcctcccctggaactgtacagttcacgttctgatctttttcttgacaaagggaattcccagtttgttcgctggtgaacgcactagcaggtgaggagttaaaagttggcaacgcctgccctctcgagagtgtcaggatttttagtctcttccttgagagctagaagatgtttctaaaagaatctctttggtgacttagaagtggagagagctttagaagcatggcacaaataaaaggaaagaggcaaacaccgtcattctacatctgtttattttgttattaacaaaaggcaaggcgattttcattaaagttttgctggggttgggggtgagggtgtagagagcaaaagtgtgagttgtacaccatgactggaatcgcttggacatactcttcagcagacatcgtgtgactgtggaagaaatgagtttcatgaagatgactgatagaaggaagccactgaaccagtcctttatcacctcttccaaggctaaagtttggagccacttgcagaaggctctcctcaaacccctgtgttctttgcctacccctgctgttgccacatcatcttggagagctggctgcttccctcctcaactagaagttcctagtgcctgcttagttcttgtctcttgcttcccaagtgctcacaaaatacatccatgttcgctacgaggaaatggaccacataaggtttccgtgaaaaccttagcccttaggtctaacacagtaggaacagaagttaatgttttcctgacgtagaagtttctcttgctgcttctggtcacatttctttcttgtgtggttcttctatggctactgcacttttttttttttcttactgtctcccccttcccccacacaccaccttttggggatagggtggcaggtgagaatataaacagataatggttaagagatagtttagtctttctaggccagattatttagtttttgccatctaggtaaaattcggtccaattaagcgtccattaagtgttttaatataagctggagaaggagttgaacctggaggtcagggctctgtggtctattacagtccccctggggtctctagcccaagggagactccagggtcttaataaatgactgggggtttcattttgaggcctttactaccaaagactgaataatacattgggcatgatggttttgtcctaaacattaacagccacaaaaggtagagagtgtgtctgtttatagatacacatgtatcatgaataattagttggggactgtgcgtcaggtctctcattttacattcgaggaagcaatgcacggaatgaattctggacctgcgaactctgaatttcaattctctgtctcctacttttactggagtgcttgcaaacagtacagtgtttttgttgtgaagttataccgtgcctgtaatctctctgcgggtggccctcctaagccctacttcaagaaatagctctaagctcatgacacccgccccacccgatgcctacatatgtcttatatccttggagtagtgtttggggttgcaaatttgactttagggagacatactctctgatgataggctaatgcttatatttactgataaacttcctttttgacggtcatgggcttcgggggccacccaaccaaactgtgtggctgcttttatgttgggccaaaagacaggctccttgtgtcctcccagtttcttaaacaatgaagtcatggcattttacagtgctggtgaatggattgagattgtggtggccctggaatgtggcactgctctggctggagggaagatgagagtgagggatggagaggagaggagagcgggagatgggaacctggtggacacaggagggagtgtgagttctgagggccaaaggaaacttgacaccggatgggacattaatctgattctgttatctgaggctgtcaccagtcctccctgtcctcctggcgtgcttctgttgaaacccccacacccgggtgattccttgcctctcccaaggagccggagggtggagaaagcaacaagaaaaaggagccaagaaaagagcaatgaaagagttctttaggaaaaggggaaggtcccgagagatctggtaaatgttaaactgaagggccaggcatgaggaagagtaggcagtaggagaagagtgtatgtgtgtgtgcacatggatgtggcgtgtgtgtgtgtgtgtgtgtgtgtgtgtgtgtttcgttggatggatggatgatgtgtcgtcatccaagcagattcaaggaggttcctaaaaggcagtgaggttcctgaaatagacaagtctagggaactcctgcgaggaaggggaggcgtttattggtatttggagagattgttaagagcttgctggagtcaggtggagtccctgccattttgcctctcatctcctgaagaaggactgtttcttttgggatatgtaacaggcttccaatcaggcatcacaattttcttgcttgaggtgtttattctttcactcaagctagccggaaggagcctaatacctgtcaggaactgcctcctctgggagagggaggggccaggcccaaatggtggctgcagaggtatttaccagctggttccgtgctctgcagaaggttggtgaacatgtaaatgcgggtagtaggctcacatctgcttctgtttttcctttttctgtaggccaggctgaaagcttaataaattgtacgaaacccaagtaagcatggatgttaaagaacattaaataaattatataagtatgcctacctgtaacacttttataaggcaaatgcacatgggttattttgccataaacgtgcacatggaccaagatttattctaaagccctcttgtttcagccttgctgctggtgaaggtactactgttcatcagcttttcccttttttacctggcatgcactgtagctggtcttggaaaatgcgataatgatgccataagtacccttgtgcaaaagttgttttttgttccaaaacattgccagttcacagcatataaaactaccacggatgcttcagccgggtttctttttctccaaataaggcaagcattaatgaagcagctgagggcttgggaaaatattttgtcattcccaaaatgaaatttcttcccctctctaggcctgcccattgatttttcagctgaagcacaagtgtctagccagacttggtgaacagtaggccttgcacctaaacttgtcaattgccattgtcacctctaatgaccattgatataaataatgctcagccttcatatttccatgcatattcacccagagaccagaaggctttgtgtagaggatggtgggatcatcccattccatagggaaaaaagggccaggttccctgactccacctgtcattgaattacaagctgggaagctgggccaggcagagctccagttgccagacactgtggccgctctggtaccagctactcctagtacccagtgcaggcaaggtgtttagtgtggcctatgaggatgttgtttaccaggcagcaacctcatgaataggcaaaaggcctgttttgaatgcctcctgtttagaagtctgaaatgtcacatccagacagtttggaaacattttaggtggagtcaagggcagagaccagaagacattcatagatctgcagttgcagatggagactttgttccagctacccatggtgtgagtataccttacgggtgctatttggaataggaccttatttttgttcagtatattggacaaagtaattcctgcttccaaactcacacagtatttatgtggccccggctgtctggcttatccacctgcagctgtggaattacttatgaagcgcttaatatgcagcctcggtttctttatctgttaagaatcgggataactggggcttctgaaggggtagggtcatgtagcctggtggttaggacctctggctttagagatggacaggttttggtttgggctctggctcagctgcctccttgctttatcagcttgagaagttaataatctccaagtttccttatctgtaaagtaaggaaaataataactacctccctcataggttgtagttaggaaaaagatgttgtgaggctcaggtggtctgagggatatagaattgcttctcaaacatgatatgttgctttgcccaatgcttaggagggagttgcggttaatagttgaagtgttctgcaagtaagtcttttggatcagtataaggctgtgataattcttattatttggtttgtgtccgtgcatgaaagcagaaagcagccagaggagtccatgattcaaggagcatgagaattactgtttgcaacaccatgttttctgaattccagtataccatcagttgtaagatatgcttaaggttggacgcggtggctcatgcctgtaatcccagcactttgggaggccgaggagggcggatcacttgagatcaggagtacgagaccagcctggctaacatggtgaaaccctgtctctactaaaaataaaaaaaatttagctgggcttggtggtgcatgcctgtaatcccagctactggggaggctgaggcaggagaattgcttgaacctggaaggcagaggttgcactgagctgagattgcgccattgcactctagcttgggcaacaagagcaaaagtccgtctcaaaaaaaaaaaaaagttatgcttttaatctaaaagcaaattttcagggagaaaaagagcacggctctcttaactgtatctacttaccatatgcatctgaatttcagatgcgtaaaaatgtagaaacaatgcgagtcttcaaatggaggaaataatgcctgtgtgcttatataatttgaataaaagctgtgctgtttggagccctaaacttcaaatggatgacatgttaaaagcttccaaacccacttttgatcaaaaatgggtggaacctatgtggaccagatttttcagctgtgctgaaagagtaacagcaaaccagagtcattgggcgtggttgtgccaacgatcagctcttagaagaccataccaatcacattttacaggattctattcatgaagattctgcatatctgtttccatgttgtttctgaccattaaggagagttgccggtattgacagatgaggaggctgggctgccctgcagcttgcttctccataagcacaccatcaaaaacatgtccacattccagtctcaccttagcccatctcctcattgggaggagttaggctgcagcatgaatgggaacaatgaatatggaggtttcttcagaaggcgatattagagcatttaatatactgctgttcttgtgtattctattggaaagaatgggcaactgcacattaaccttactgtaagtgtgatgcatttgaacatacagttaagaatagctcaaagaatatgcatttctgctgtgagtggttttgaataaatcaacataatagcccatggttattaacatattatgtgaattggacaatgatatatactttgaggaccttgaactaaatccaccagctaagagcaacccgtaggaggggctccagaaggaccggagttctgggtgttgaggttgtcatacaaagaaatgaacagcagacaactggcagaagaattttctggtaatactcaacccaaagtcaattttcaaatgcttggactgcagcacagaattgactaatgtcagattaattgaatttggacttctaaatgtgggtcagtttgggttggaagtgattttattatccagaaacttctgtgtacccctcttcccccacaagaaatattcagccataattttcccctgttgctgagcttctcttgcaaagtttctgagaagcagtgaatctttctgttagatttcataagaagtagtgctaggcttttgatataattacgtttagatttcaaggaaactttcagtgtgttgaaaaataaattctaaggcataaaggggaaggagtcctcggctgagacccagacagcccgagtccttagcccagttagaaacttgccatgtgaccttgagcaagtcttggcatgctctgcctcatggttgaacattttttttttttaagtggggagggttatatatgaccttctttttgtccctttagctcggacacttagaggtttagtgatctgtgggttttgtttgtttgtttttgtttgtttgtatttttggtgggagggggctagagtacaaaatggaaaagaagataagtagacaggggctcataatctttgagaaccaggattttccttaaattgctctcttttgaatctcctggtaccctttaaaaaacctctttacctgggtgcgagtcttcttccgtgacacttaatataactttatggacctcagttagactctgatgtccttttcaaaacagtgttgttttttaaagtatgaagtgcttattaaacccgcttaggagatgcagtcctaggaggccattgatcacacgtgaaaacactctagatataactctcctttcaaaaaagtggctaatgaagtatataccaccttcctattttgaataaagtgctatgactggacaaaatagaacaactttttggacaaaaaggctgctggagccgctgccgtctctattcttgcactgcttgctgttgacagcccatgtgtgaggacactttgttagtgacatttagccagtgattggcccatccaaaaggcggttacccagaagccctcgtgagcaagccaggatgctgggagagggatgggaggtggccttttggaaacaaggggacatggctgggttcttgtaagtcatgtggagagtatgatacacctctaccctgccatgccatggcagctgggcctcgcagagatggacaccagaattcacagcaccagagttcaaacactaaacacgggcagctggacattggccttgggaggcccagacgtggagcactgtcctggacctcaggctgtttcagggacctctgtggcaggaattgactacccttctctttcaggctcagccatgatgtgcttggctgttcccttgggctctctcttctggaagctcgtcccgtccgcaggcccccttgctgtacttgtaccttcattctccatctctcagcttctgcgcactctgaactttggccattcgcatgctgccagaccccttccaactcttggactcctccttacatccctttaccgttggctcccaattctttttttttttttaatttcccaattaaaacaacaaccaccaccaagaacaagagttaggccctgcctacccttctttggatggggtgtttgtgccaagtagcatcaccaactgctgttcatccttgacatgggtgtcctggggtcaggtgtttcctctggcccagttagcagggaggaatgtcatatggtttagaaaggagggcccagggctggccgtctcttggaggggcccgggatggggtacgcccccttggaaggggatggtggttgcggtgggcgctgtaaatgttgtgtccagctcagagggtgcaacagtgtctgtaactcatattctttttttttttttttagacagagtctcgctcctacacccaggctggagtgccgtggtgcaatctcagctcactgcaacctaacctcctgggttcaagcaattctcctgcctcagcctcctgagtagctgagattacaggtgctcaaccaccacgcctggctaatttttgtatttttagtagagacagggtttcaccatgttggccaggctggtctcgaactcctgacctcaagtgatccgcccacctctacctctcaaagtgctgggattacaggcgtgagctgccgtgcccagccagtatctataactgaaggctgtttatttctgcttgcctaacccgtccaggaggatgtgctggggccatctgaacaaccattgacattcagacattatttagaaatggaattgggaagtgtttaaaaggcatagactagtctggccttctgcccattcagagactgtgtatgtagtcagtgtacagtgtattcattgagggcccctcgctggatgtttcagccactccctcacaggttctcgtgtctgcttggtacagttgagatctgcaagagctgattcatcggcctgattgagattcctttgtaaaaccagatattcaagaatactagtggcaagaatgctttggtgagcgtaagatagcggctcccactggatcacatggctggtcggtgtcagggagatcaccgtgggaggtagcaggagtcagtctttaaaaaaattattgggccgggcatggtggctcacacctgtaatctcagcactttgggaggccaaggcgggtggatcatgaggtcaggagatcaagaccagcctggccaacatggtgaaaccccgtctctattaaaaatacaaaaatcagctgagtgtggtggcaagtgcctgtaatcccagctactcgggaggctgaggcaggagaatcccttgaaccagtgagtcggaggttgcagtgagccgagatggtgccactgcactccagcctggcgacagagtgagactccgtcttaaaaaaaaaaaaatttatatatatatatatgtatatatgaattaattaatttaatgttgcattaacgagtggtataaggttcttagccctttgtctggtatctgctgggtgttcagtattcatttcctcgctttccctgcatattttgagctaataaatgtttggggacaccactttcctgtagaatctcatgtaatcccaaacagatcctagctgcttgctatggcccatctgcgggacccgcgtcaaggctttcccataaaggagagccctgcgggaatcatcatgtgccaggcactgtgctaggctctttaggtgcatcttgaaacttaatcctcgtgacattttggagtagatactatcatccccacagaaggtactgaagtctcaagcacattaatagcttacctaaatattgctaagggtcttccagatgatctttaggaaattttcagccaggggagagtgaaagctctatttgctatagttaaagcaaggaaccctccttcttaaaaaattatacagttattgagatataattcacataccttacaattcatccatttaaagcatgcaattcagtggttgtagtagattcaggagttgtgcgagcatcgtcacagtcaattttagaacattttcatcaccttccacaaaacccccgtgtctcctagtagccactccccattttccctaagtcccacagtcctaggcaacaactaatatattttctgcatctatggatttgcctattctggacatttcatatagatgaaatcataggcccgtggtcttttgtaactgacttctttcacttagcaaatggaagggtttttgatggaatcttagctcagatgtcgccctaggcttggccttctggaactcactgttctcttgcttccttccaccctgcctccctacccgctttgctacaagaagacagaatgtagaaacccccagttgactttttgagtagaaatgagccatgttctatttagtggtagaatgtttgctgggttagcccaggacttcagatggagtgcttcctcctttttaataccttgtgactgctgtgttggcaagcagagggttaaatgctgcaggaggacatgggagagtttttgctttgagggtccactggagcaagagaagcttgagagtctgtctctgagatcccagaacagacatgaagatatggtaccgattcccttggtgctaaaaggaactccaggggaatttcaggaaacccctccttttctcgtctttattctcaccccgtccccccgccacctctctccccaagttcacactcaggagggaggaatcttttaccttttccgttctgggcagcagctgtagggaatgttatcagtgttgggactgggcacgggaccaagccttcctggtgcctggactgcaaccaagctgagagctgacatggcagggcgagttgtgtgtgagttggctgcccctaggctcataggcctagcacaatagagaccctgtcaatggagggacactatcaggcaggtcactatcaatgtgacagacactatcaggcaggtcacattggtgcagatccttggaggactcccccccaccccccatgagtggattcctccaggtcaggggctggctgggactgtggatgctggagtaagtggaattgtgggtgcactctgcttcagcagtactctccaaggagaatgattgttttaataaattactgttttaataagggaggtggaagagctttttaatcacttgctttttaaaaatttttaattttattttaattaattaattagtttatttattttttgagacggagtcttgctctgtcgcccaggctggagtgcagtggcacgatctcggctcactgcacctctgcctcctggattcacaccattctcctgcctcagcctccagagtagctgggactacaggcacccgccaccacgcccgactaattttttgtatttttagcagagacggggtttcaccgtgttagccaggatggtgtagatctcctgaccttgtgatcctcccgcctcagccttccaaagggagggattactggcgtgagtcaccgcgcctggcctttattttttatttcttttgagatggagttttgctctgtcacgcaggctggagtacggtggtgggatctcgcctcactgcaacttgcgcctcccgggttcaagcgattctccagcctcagcctcctgagtagctgggattacaggcgtgtgccaccgcctccagctaatttttgtatttttagtagagaccgggcttcaccatgttggccaggctggtctcgaactcctgacctcaggtgagcgtcctgccttggcctcccaaagtgctgggattacaggcgtgagccactacacccagccaatcagttgcttttaaactacttaaataaaaagagccaacccaaaatcttgtgcatgcttgggaaactggcagtggaatatgagaagtttttatttgtggtgcacacaggtgactcgggctgttgtgtattggttcttgcctcgatctgtagcaagcaatctgttgtttcttgcctgccttttgggaagaaatgaaaaaagaagcagcacgagtctccatacatcatgattgtgatggcactgggcctgagaccttttctgctgtccaggtaaaaatgtgaagaccatggttttgaggtttcttaataaattcaggtgttaagtgccaagtgatgctcccagcccctgagctagagcaactatgctgttcatgtccccaggaatggaagtggaccctagttaggtgctggtggccagccatgtgtacctagggcagggccaggtcgtgtgtgtgtgtgtgtgtgtgtgtgtgtgagagagagagagagagagagagacagagagagagatagagagaaacataaaggtgatcggcactcagacatcctgtgtggtccacctcacttctcaagcaggtgtctttccagtctacaactcgttgaccacaggtggaattcataagctctgttccctgtcctgcttgggtcctccagagaaagaaatgttgaattatcatcttggtgatggtcaactctgaaagcctaaattttcatgatcaccaaagtgtttggatttaaaagggtggctcactccgtaattccggcactttgggaggctgaggcagaaggatcacttgagcccagaagtttcagactaggctgggcaacaaagcaagacccggtctctaccaaaaaaaaaaaaaaaaaaaaaaaaaaaaaatcaaaaaaattagctgggggtggtggtgtgctcctatagctccagctactcaggaggctgaggcgggaggatcgcttgagcccaggggtttgcggctgcagtgagctgtgattgcaccactgcactccagcctgggcgactgtgagaccccgtctttaagaaaaaaaaaaaaacaaaggtcacaagacattcttggctccgccctgcagagctgcttcccgatctccttttttatttgcttcccaacctgcgggcctcagtgtgactcaccacaccggactgcctggccctgctgcctgccgcccatccttgcggcctggacgactccatgtgcgagttgctggcgcagcgtccagaaaacagaccacaccccaggaatgatgatacgttatagcatttctctgctctgtaagagaggcaccagggtcgtgtgctgggtctggggtttgtccattccacatccggtgctgctgttgactctggtgtcggccgctggtgagctggctgtagctggtcacctctgggtggtttctggggcggtcgcaggctgactaacacaccaaaggtcagccagggtgttgaagctggcacctttcttcctggagcacagacgtcatcttggatcttttagatacttggacttactttatgcagaacattctggatttgtgaattagatggactctttattattttgtatttggattatttctttaaagagatcagagataaaaatatcattgttttgccagtttgctaccaccagcccacacccctcttcccgttgtccaaaaagggggtggttagagttttcttgagtgactgggctattatgattagcagattactaaagctgtgtgattttaacaagacgtaaacacatatgggaacccctccttccatatcttgctaatgtcaattagcaacatattaatcttgctaatgtcaatcctgtcacttcatacatttataaatattagggacatttaaaagagttgtcggactgtgcgggaccttggcacactgctgacggctgcacactcatcactgcggggctcatcacacattgacaccagcaccatattttgctgggtttcctgatctcggttgagtatttggatttgaatgggatggttttaatgttgctactgactactacagtgatccaaataaactttaaagctggggcctccacgccataggcagattttcataccagttgcctttacctcagtagttttcagctggggcaattttgttccccaggagacatctggatacagtgttggttgtaacagctgggcagggggtacttctgtcatcatctcatgggcacaggccagggatgctgctagggcaacccctcaccctcccaaagaattatcaaaaacatcaacagtgccaaagctgagaagctcagctttaatgtgttcattgagcaactaaagaatagactcagatataggaaagtatttatttatttatttatttagagacagggtctggctctgttgtccagatcataactcactgtaaccttgatctcctgggctgaagcaatcttctcaccttagtctcccaaagcatgctgggattacaggtataagccacagtgcccagcctgaaaagaatactttaaatgggcggggtaatggtggcttatgcctgtaatcccagcactttgggaggcagaggcgggcagatcacctgaggtcaggagttcgagaccagcctggccaacatggtgaaaccctatctctactaaaaatacaaaaattagccgggagtggtgatgggcacctgtaatccgagctctcctggaggctgaggcaggagaatcgcttgaacctgggaggtggagtttacagtgagctgagatcgtgccattgcactccagcctgggcgacaagagcgaaactctgtgtccaaaaaaaaaagaaaagaaaaaagaaaaaaagagtatctttaaatgaatggcaacccaatttgcaaatgtattttttttaatgttgccaattactttatgtgtttaaaaaatatctttctggtttactagggtattcttcaaaaaaagagaaaagattaaagctgcacagacatgatgatgtaaaagctagtagcttctcaagctgtgaaaggtctgtggtgcagagaatagctccctgtgagctgaattttgtttgctgtggtgcagcatgggtttagatcctacctggttagtgaaagagataatgtgaagtcattgcatttgcatttgtcaaaatcctagttttccacttacctaatagttttttgtttgtttgtttgtttcattttgtttttaaagacaggatcttacagccggggcctgtaatcctagcactctgggaggctgaggcgagttgatcacctgaggtcaggagttcgagacacacctggccaacatggtgaaaccctgtctctactaaaaatacaaaaattagccaggcgtggtggcacgtgcctgtaatcccagctactggggaggctgaggcaggagaatcacttaaacccaggaggcgaaggttgtagtgagccgaaatcacgccactgcactccagcgtaggcaacagagcaagactccatctcaaaaaaaaaaaaaaaaaaaaaagacaggatcttgctctgtcacccaggctgggatatactgacttgatcatagctcactgcaacctttagctcctggactcaagcaatcctccagcatcagcctcctgagcagctgggactataggtgtgaattaccatgcctggctaacttttttattttttgtagagacagggtcttaccctattgcctaggctggtttcgaactcctggcctcaagtgatccttttgcctttgcctcccaaagtgctgggattacatgcgtgaaacaccacacctgaactagtctttttgttgttgttgttaaagtgagagacccagaccaaaatcatctttcttctcccaaaatgctaattattatttgttttaagttatagctccagattaccttgtaggattattcacattttctttctaaatgctgttcttgaaaggaaccatctattgacagtacatcagaaattctatggttcctttatgacatttctggggaagtaaatgaaaggtgtaaattaagaaaagcaagtgtttgcggttcccactttaaccttgtgttatgttaagtggctttgttgaagagggctgtcactgttcttgaaaacttgggaaaatccatagcaagctgtgccattagttgcctttgggagcacaggatgtttgatgtgaaaattatatggacacatctaattgggtgtattttcaccccaccagatatcaagtaaagaggtgactcttccccctcccctgcatttttagctaaattgtttaacctgaatttcatgctattaagaattacatttcagtaatccacctgccatttttcaatgccttttgtttagtagcatgtctgtatgatccacctacagaacatttctagacatctggcaagagctagttatcatcccttcctgatttggggtgctaagacctgtggtccccttcttccaccgtaatttacattcttccctgagtcctgcaggaactcagccaggcagtggaaagaaaacagaagctctgtggacctctgcttactgtaaaatgggaataataattcttatcctgcctgtttcccagagttgtatattcttttccaataaaatgtactcaaaattaaaatacaaagcagttacacagagataagatagtggtaattatgccaatttaaactccagaattaaaaaataagtttagtcacataccatgcagttcacccatttaaagtatataattcagtggttttttgtatatttgcagaactatgcaaccaatatcgccattgtagaacattttcctcaccccctaaaagaaactgtacccattagctctcactccccatttcccccactctgccttctcccccatgcccaaggcaactgtcaatctactttctgtttctatggatttgcctgttctggcattagatatatacatgaagtcataaaatttgtggtcctttgtgactgcttctttcgcttaacttaaatgttttcaaggttcgtccatgttgctgcatgtatcaggacataatttctttctttttcttttcttcttttttttttttttttgagatagagtcttgctgtgtcgcccaggctggagtgcagtggcatatctcggctcactgcaacctctgcctcccaggttcaggcgattcacctgcctcggcctcctgtgtagcaggcccatgccaccacgcctggcttgcttatttatttatttatttatttatttatttatttatttatttattgtatttttagtagagatggggtttcaccatgttggctaggctggtgtagaactcctgacctcaagtgatctgccctccttggcctcccaaagtgctgggattacaggcatgagccactgtgcctggccaggactttattccttttatggctgaataatatttcattatatggatatcccatattttgttgacccattcatcagttgatggcaagcttcagaattaaaaaaaaaaaattaagctagttcatatttgctttaattttccaaatgatccctttccttttattgcaagttaagtgttcctatggtaatgactgttatggggcaaagatgatcaagtctatgagcggtccacacagttcaacaaatatgtacctcagcacactacctggaaccagacattgggtaaagataactttagaattcatggtccccctgagacactaaagactttttaatgaatgcaattagtaactttctacttactgttactctttttattttattttttgagcaggatctcactgtgttgcccaggctgaagtgcaatggcccaatcacagctcactgcggccttgacctcctgggatcaagtgatggctgagactacagtcatgtgccaccacatccagctctttaaaaaattttttttgcagagatggggtctcactataggctggtcttgaattcctggcctcaagggatcttcctccctcagcctctcaaagtgctgggattacaggcatgagccaccacacacacccagtttgttgctctttctgtaggttggctaaggattaagatgttatctccggtggctgaaacatgcctctgataggtgctatctcccttgtcttcattttcacgctggtggtaatcctggaagccgcagggatcagtcagatggcaacagcagattctttttttgttttttttttttctgagatggaattttgctctgtcacccaggctggagtgcagtggtgtgatttcatctcactgcaacctccgcctcctgggttcaagtgattctcctgcctcagcctcccgagtagctgggattacaggtgcctgccacaatgcctggctaatttttgtatttttaatagagacgggggtttcaccatgttggccaggctggtctcaaactcctgaccttaagtgatccacccatcctggcctcccaaagtgctgggattacaggcgtgagccagtgcgctgggccagccacagcagattctgacaggtgatgcccttgccagcctggggagccttttggttttgggtttggtttttaaatttgttactgttttggtggttgtttttacctgttgtaaatattaagaagcctaggcatgatgatgctctgaagacaggaaaatttgttttgtcccgatttgccacacggactcctgcctgcatctgcgttgatgtggccacacggagagctgctctgctcaggagatccagcccgggccagcagctttataatcagttctgatcgccaccctgcagggctgtttttggcattttaatgtcccttaagtactttcagaagaaagttttcaaggaaaacctgaattttttctttattggctgcacatgttagacatatgaagatgtgtttcactttacaaagtggggggaaccctcaacaatctttaagagatccctaaaaactgagggttgtttcagaaccatctaaatccaagaacgttggacctgttatacttattctggcagatggacccatccctttttttttctgagacagagtctcgctccatcgcccaggctggagtgcaatggtgtaatctcggctcactgcaacctctgcctctcgggtacaagcgattttcgtgcctcagttacccaagtagctgggattacaggtgtgtgccaccatgcccggctaatttttgtatttttagtagagatggagtttcaccatgttggccaggctggtcttgaaatcctgacctcaggtgaaccacccccctccgcctcccaaagtgctgggattacaagtgtgagcactgtgcctgatcgccatccttttattggtgagaagaaaagggagcaagatgaggttgacccctgcatcttatgtgtgtactgtctctgcctctgtacacacacacatgcaccacagacacaccacacacacacagcccacatacacagcccacatacatgcacacacaatttagggttttcccccttctcacaaaaatcctctttaacgtgatttttactaataaagttataaatgtctggggttagaagacagccaaagttttgggtggcgcaagagataattcatcccagactccacaccccttatgccatgaaaacttcacctctccgtttcaagctgagaaaccccacatacactgcagatacattacaaggcagctaccacatcaccaaaggccaagcagaaggcattgtggatgccctgggtatatactctctgacacagaggtgactgcctaagcagtcagatttgcgacagtgtgatcctttttggaattcatatactggggcaagtattggaaccaaggttgccagcgaatggggctggcaagtcttttttcaagtttccttgtgtgttcccattctgaacaaggtggtgtcaagttgatcctgcctgtgggaatgcattgttcttgaatatttatatctttgtatgctcccattgggatttctcctttcataatatctgaaaagaacttgttttcattaaagccatttcaatttcgtacatttttatgcaataatttagtgtttatggtgtctcttaaccaacatggcttgttttcataagcacccgagaaggtttaaataacattttctcataaattagccctcgtttgcacacttattcagttattgcatcatgaagaccctctggagtttgatgttgtcaggaaacatattagcagaaaatagtgtgttattatctaatgctaataattggttagtggaaatgagaaaagaggatatgtaattggggttcctgtggctaacaagatgtgaattatgaaagcatttccaggagaaattccaggggtgttccaggaacctgttatttacattttaaaacatttgattcccattgaaaggggaggagggcgctgtttaccaacactgctttctttttcagagcaaatccatctaaatttcctgagtggtagctagatctcctaatacacctagcccctatgttgttttgactttgcagtcccattttaggctgctaacgttctttttgtaagagatatgttggcttttaaagagaggattacctagtacacatcacaagtcctgatcagaccctcttctccctcttggccccgtgattctgcccagtaatgtttacagcacacaacacgcaccaatactacttcccaaaggctgcttgggagaaggagcgtacctttagcaagaatctcagtataagcacagtataatgctttcttcattagctagattcacaaagctttctgcagcctgtgctgcttgaacccgagcttctgcttaatgttcttccatagccagtcattgctgagtaaggtggatgggcttctgtgttatgcttaaacaagtgaaatcaactcctgttctctcaaagtcattgatgagcatggtttttcatgcttgctcgctattgacttgtctggaaagattatactgttaaggacagagactctgtcagttgcatatggaaataatggatataaagattgcaaggagagttcattttccacctgcttgaggtcacattgaacctcatccctgttgcggaaaacaaatgggagtgatagctggtgccagttagtgtatggatgtcctcgaaattagatgtgccttcaaaaagacttgatttaatgttagccaggtctgtttgaacttcattattactattattattttgagatggagtgtcgctctgttgcccaggctgcgcccaggctggagtgcagtggcatgatctcggctcactgcaacctctgcctcccaggttcaagcaattctcctgcctcagcctcctgagtatgtgggattacaggtgcctgccaccacgtctggctaatttttgtatttttagtagacacagggtttcaccatgttggccaggctggtctcgaactcttgacctcaagtggtctgcctgccttgacctcccaaagtgctgggattataggtgtgagccactaccattttttttttttttttgcgtgccttggttaatatctcaagttcagataatgttaaggttaaccacttcatcttattacctttcatcccagtaaagccttgaccttcacatataaaactaatttagtgtcaatacagttaaaaagtgtctcctttattcagaattacccatataatgtctttttttaataactttattccaaacttgaaaaaaattatctttacccatttttccctgtactgtttatgatacaacaattaaaaaaatcttatttccaatttctcaatatttgataggtacactttcccccccacaggaaaaaagaaacagttgacaaaactttgttttaaccagcaaacaccttttgaaatggtgctgcaaattcctattcatgatgccatatttctaaaacactttttcttggtcatgttgaacttttattcagtaaaagaaatcttcattctgcttgtgtgtgtgtgtgtgtgtgtgcacgtgcacacgcacatgcatgtggccttttctccttgaatgtgacttattttaataaatttaccctcttattatataatggccatgtccagaaatcggggtgcatcgcttctgtacgtagagagtcaaggtcctaacaaacccgcccctctgtgttctgctagccatacagaagtggagtgtgttggaggtggacacaacccttagaagtcatccagcagccagcatcctcatatgctgtgtcaagctgagccccagaaattcagagagtacagctagtcagtgggagggtggcagtggcagtgacactgaggccccatgctctgtctgtgcgaggttaaggaggggtgagcagtgctttgtaaaggtatgtgaaaaagtggtctctttctatgctcattctgttttgccttctgtttggagccttgtctttttctcaggtgaggtctttgagggctgaggtagacttcatttctgcatgccttgagtgcagagatggtgattacattccaactcgtgccaactttgagcagagtggctgtgtgctatggaggtagtaagggaagagggaggtgccatgtgtgacctggacacttgccattcgtgactctaggacactgccctccacatatactgatagacacacacacacacacacacacacacacacacacacacgtgcaagtgtgggcccatactcacaccttgccactcacaccttgccactcacacatgctcacattaaaaaaaaataataatgagaaaaaaggattgcatacatctgccatgtgagtgatgatatcccggtctggggaggaactgggcttgtctttacgataaaaatggtagcttatctggagccctgatggcagtttctttgcctttgcagtaagttgacagtgtatttcagatgtaattagttcccatcaaagttacctcatcttcagaggtgagaattatcgatggtgcataaagctggatcagtgtgacctgtaaagaccttacctgtctccaaggttacgcgtgtgtacgtggggttggctggtttggatggttgctctttgttttttggcatccttgtgtgtgaatacatgataagaaatatgaggatgttaccttctcaccaatttttaaaaattgtcagttcagtactttgcttttttagtggaatggcccttagcaatatccttcttttaaatggatttcttattgttccaaagatgtggcatttccaaaagaaaattcttccatttatgcatagaaccttgaactctagtctttaaaaatctaggctttagtttcagctcttttttagctgtgtggtcctggacaggcccttttacatctagacttggagatttaaagaaaatcataaagaattaaatgagatgatttctaagactcatttcattttaaaactctgatctttcagagacgcacaaatccattccctcttgctgtggaggagaaaatacatgaaaatctgaatccatatgcatttgtcagggttctccagagacataaaaccaataggatgtatgtgtttatatagagagatttgtaataaggaactggctcacccagtcatggaattccataatctgcatcatcaagtgtcatggtctgtagctgggaagctggagacccaggagagtccatggtgcagctctagtctgagtctaaaggctggaggactggtagaactgatggtgtaattccttttcaaaggccggtgggctggagcccagagatgctgctttagctcaagcccgaaggcagttactcaggaggatgccggctggtttggaggaagatcagccttgtattctgttcaggccttcagctgatgggctgaggcctgctcacatcaaggaggaccatccgccttactcagtgaatgttaaacttatctaaaaatatcctcagagaaacatccagaatagtgtataaccaaatatccgggcaccttgtgacttagtcaaactgacacataaggccaggcatggtggctcacacctgtagtaatcccagcactttgggaggccgaggtgggcggatcacttgagaccaggagttggataccagcctggccaacatggtgaaacccggtctctaccaaaaaaaatacaaacattagccgggagtggtgttgtgcacctgtattcccagctactcgggaggctgtcacaagaatcgcttgaacccgggaggcggaggttgcagtgagctgagattgcacccctgcactccagcctgggtgacaaagtgagactctgtctcaagccacccccccccaaaaaaaaaaaacaaaaaaccctgacacataaaattaatcaccaccagagttttctgaggcaaagaggagtaaagctgttgcctttttcttcttgcctgtgaggttggttgagattcttctaacagccaacaggtgttggccaatgttactctgattgacacctttctttttttttattcaggtttccctctgtcacccaggctggagtgcgggggcacaatcatggctcactgcagccttgatcttccaggcttaaccaaacctttcaccttggccttctgagtagctacaggcctgcaccaccacatctggctattttttttttttttttaatttttagtagagacgaggtcttgctatgttgcccagtctagtcttgaactcttgagctcaagcagtcctccagccttggcctctgacagtgctgggattataggtgtaagccaccacacccagccctgagtgacattatttcatacaaaattctcatctctggaggcctttgtatttttaggggttttgtttttcaaatgctttttacctctttctatacttgttcatttttaaatgtttcctggcagagcaattagtattttctggcttactaggtgctattcgattgcattagcgtttgaatattacccagctagttgtggagtggggcagtaagctcataaagaagcaagataatggaatacacaaatattactacgactttatgggtggcataccttgattcttgatccacgtggctgtgttcagatctggttagcacacattgacatcaggggctgagccaccagtgagagtcaaacccagcagccctgtcagtctaccttctctcttgacttgatccagcctcataacttcactttccgcaggagaaacacacctcttgaggtcctctgtcacaaataggcagtgtttctggagaaagccaggaggcagattttagtgctgttcagcatctgtggtctctactttctggatctggtgcattatggagaccatgaaatgacatgaaatagctcagtgctgccagtggcggtgacagggacactagaggtgaaggagggcccttggggcaattccagcaggtgggtggtggctgaaggtccttgtcttctttctgcagagactggccacctgcttcattctttcaagaagcaccaaatccctacttcagtactttgcccactcgtcatgtcaggagcatgaaactcacgaggccttcatttacttttatcctgtaacaccttcaatttttcccacatcctcccttgattcgtggatggacaactatggaggccaatctggctgaggtgaggactgcttgagtctaaattcctctctcctcaaacccaattcaaactggcctgagcaaaatgaatgtattgatccataactgaaaagtccagaatgatcaggcatcaggcatggttgcatccaggggcccatgtattagaaccatctccttccagttctgggctctgcttgcctcccagttggttttactgcacagaggcttattcaagtccagagagatcttatctttccctacaagtctgtgaccttgattctgaacctgcatctatgggaagggcttgcagtgtctgagtgagcttggactgtgtaaactttcccacttctgaagctgggggtggggttcactccactaagctacatggctctagagtcagggggttgccccctaagtaactggcagtattgttaccagaaaaatcatgaatggacactgagcagaaaactcagcagatgtttatttcctggtctttaggatttgttgaagagttttttatttgtttgttttttaagaaagactcaaaaggaaaaaaaaaaaaaaactatagttattttctcatgatataaaaagattctgtagttgtatatacatttgaactttttgtaagacatctcctacccccctaaaattggaagtcatttattaagactttgtattctgtaagaggattggaaatgaataattaagaacattaaagaggaaagcagggggtggtgggaaagtgtggtcttgagggggtaataaacctcctacaggccacacacacacaagaaaaaaaaaagggcaataagtgtagcccagtaacataaggtggggaataaggttaggggtaaggttaattctacaagttcaaagccagtagcccctgatgcgctgttggacgtgaactataaatttggctctgaggttcccaggcatggaagaatatctagatctgtacagagaggttgtgtgtgtgtttaacatttccataatgtacaatttcctctaagagtaaaggccatgaggaaatgcccgtggaagataaaggagaccatgtggtctgtggcaaccatggatacatttctttcccaacgcattctctgaggcactttggtaactctgcctctttgctctcagcattgtgttagaaaataaagccagcagacaaggattaaaccctcatgttgctgggttccttctagaaacaattggagggctaaccaagtcacctttggtggaaggcagtaaggtgagtcattgctgtggctggactgaataggatagccttagctgtaaaattgggctgatctttcaaatggactcatgcttgccgaatgactcacgctcctgtttacaaatcagctctgtgaagaaatgcagagtgggaggctctgcttgccagacggagaccttagacctccaggggtggagaacggagtacttcctctggtgctcggcttcccttcctgggggcagatctctcagcttctggttggtggctctcaaaatccagacacaaggtcagctgcagccagcgtgggccctggagtagctccagttatggggcagcaatggccccctctcattttgagagctcactttgcctgtggatggttttaatccatctggataaacttgaggcccatgggaataccatatactatggtaaccatgtacactgctctaaagatgtggctgctgttgtataactttttcctttatttttgtcaatttcctattttccagagtcttgcatacccactatgtctactgtgatagtgaacgtaaaaacatacaagatgttggtgttatcctcaatctcttattcttaatcctgaacaaattacatgaaaaaatcgttcatggagtttttcttcatataaaactttttacaatgaacataaagggcatagctatttctttttttttaaaaagaaacgtagaatattatttcttggttgtgaaatcgcccttcttggaccccaagttgttttttacagccctaaattctcttgtttatagagcctgtttatagagccatagacaggccaatgggtctctacagcaggcacctgcatgagttgactgggacctgagctatattccccctctgccatttactagcagtgtgaccttgggcatgctccttacagtctctgagtcagtttcctcctctgtgaaatgggcatgatactacctacctcataaggtaggggtgaggattaatggagtaagaggcacactcctgtccagggccccagacagagtaggccgtcagtaaactgtagcagctattgtgatagggtttgaaattcaaattaacgcatatttcttgagcacccaaggtgtgtgctgctggatctttcaaggggtccagaattggtagtatagttgcttttctcaaaagactgtcgcctggcagaggaaaaggtgttaaggtatgagtgaagacagatcagccagacatggtgccgcttgcctgagatctcaacactttgggaggccgagataggaggattgcctgagcccaggagttcaagaccagcctgagcaacatagcaagattctgcctccacaaaaaaataaaataaaaataaaaagattagctgagtgtggtggcgtgcacctgtagtcctaactgtttgggaggctgagacaggaggattgcttgagcccaggagtttaagtccagtccgggcaacatagcaagaccccatctcttagaaaaaaaaaaaaaagatcagctccccaaacagctgaagtattaagtggaaccatatgtaattgtatttttgtaggacagaaatatcagcaatttcacataactaatagattcagtaaggtaagttgagagagaaaatgctagctaactggttcttgagaggctcagaggaaggggaggccatgcccattaggagaatggtgggtaggggtgggaatacacaacaggaaggctgcctggaggaggttgcatttcagatgttcctagaagggaccctgagctggatggcagggaaataggagagttctgatttgtgctgggaactgtaatccctctatcatggagcttctatagaaatgtgggttagggcagaaaggaaggctgggggctgtgtgtgccttggtgacgtgtccccctcgctcccgagccttactctgttcccctttcttcctggcagcagagccccctcccttgctgcactcagggacatgactgtcagcacttctaccccccctcagacttcactgtcagcactcaagtcttcagggacatgaaaaggagccactccttacaaaaagttggggagccctggtgtattgaggtaggtctcggagcagaatcacggtatgagatgagctagctctaaaatgaagccgcccacccaaagtttacctctctctagggcagggcccatccactgcgatccctgaattcttgttgggtcactgtcattttgggtgccatgatgtctgggtgtgctgaccgctgatagggatatcatagccataaaaacgcctgtttacaaggagagggtggagggtggtgctcgcatgactccaggatgcctggctcccagtgaaggccctcgtgatccagtgccacacgtaacttctgtgaaaatgaggagcacaacattatcccattaaacttggccccaggaagtgtctcttgggactcttcacagttcacaatggaggagaagttaccacctcaactttgccttcgttactagtaatttagaacttaaagattttcttttaaaattcagggtgctggaaaatgcccactttgcctcgacaatacctacctgaggcagccgtgaatggctttactcgcagatgttgctctccaaggacaggaagcattgttaatttcctttaaataattcaatacagtgtcaataccccacactgctcagtgcttgggagtaacagttctcttcaaattaatagtcctgaagaaaaaataacacctagaacatgcttttatcttcagaaaagcaaaagtcaatgcagatgaaaaattttcaaggaactcttaggtttaaacagcaaatgatttagtactagtgttagcttttaaaaaaagaaaagtgaatatttatgaaccaaataataaagcctctgtctttaaaaacatttattgtatacctattgggtgctgtgctatgtgttacagccacagggacagaaagcagtgcctccagcaggcagagacctggagtaatacatatgtacataagtcttgctgttggagagacaaaatgtggaataagtcatctttaaaagtttgttctggcgtaggaagtgatgaatagccacataagacaactagaaactgtaaaaatacataaagaaaatgtaaatacctatactcttattacctattgataatctctctctcttttttgagatagagtctcgctctgttgcccaggccagagtgcagtggcgcaatctcagctcactgcaacttctgcctccggtttcaagcgattcgcctgcctcagcctcccgagtagctggactacaggtgcgcgccaccaagcccagctaattttttgtatttttagtaaagacagggtttcaccctgttagccaggatggtctcgatctcctgacctcgtgatccgcccgcctcggcctcccaaactgctgggattacaggcatgaacaaccatgcctggtcttttttattttttattttgagacggagtcttgctctgtcttccaggctggagtgtgtgatcttggctcactgtgacctccgcctgccagcttcaagaaattctcctgcctcagcctcccgagtagctgggattacaggcacctgttaccatacccggctaatttttgtatttttaatagagacagggttttgccatgttggtcagactgttcttgaactcctgacctcaggtgatctgcatgacttggcctcccaaagtgctaggattacaggcgtgagccaccgtgtctggccgataatctcttaatatttggatacatttccacatttctagtcattcatatgcacagaccttaaaagcgtttcgcaaaattggtattatacctcatacggttttgcaatttctttctacttttaattctaggaacactttttgacactataacatgtgcctaattctctttagtaacttcatgtactaaagtggaaatcctctggtccacctattccctgttagccagatgtgcataaaactgaagatgtggctgggtgcagtggctcacgcctgtaatcccagcactttggaaggctgaggcgggcagatcacgatatcaggagttcaagaccagtgaaaccccgtctctactaaaaatacaaaaattagccaggcgtggtggcgcgtgcccgtactcccagctactcaggaggctgaggcaggagaatcgcttgaactcagaaggaagacagaggtttcagtgagctgagatcacaccactgcactccagcctgggcaacagagtgagactccatctcaaaatgtttctggagtctttcggacttttcgctgtcttgcatgcttgcctctgatcttgcatgttcttgggccacgcctatgtcttgattacctggagctgctgtctgtgtgtttaaggagcattccctttaactggcctgggtctgatagagcagggaggcccccttttctctgcattagccatggcctggtagaagatctttttcagtagcctctcactggttcagcttttaataagcatagctgttcattctggctatttatgataagatgatatgaatatagctattctcccatcagagcctggcacatggtaactcattaatctttggttggcggcaggaggtagataaaggaaccaggcacccattttaagtatgaggaaaatgaaacagaaagactgggtttcttccttataactcaaggtctacaggagctgattagatccctggcgccagtgactgagcatttctcagccttgtcctcagaacccagaagcatctcccagggacgtgccaaaatgccacgtttccaggatgtcatctaaatctgtaaactgtgaataggtgaggtacaaagatgccacttatgggctgtgccaacttgggcaagttacccgactgatctgtgcttcaatttctccatcagtgataaaggttcacatacaggctgtatgtaaagcgggagcttgatgagagagctggtgggctcagactggtgcaggcaattggcaagattcttgaggaatcacaacctgatggtgtgtctgtgtgatgggccagtcgctgctggagtagctcagttatgtgttccatgtaggtttccatggaaattcacatgtaacattcctagtacctacttcaagaattttggtggtggctgggtgtggtgggtcatgcctgtaatcccagcacttcagaaggccgaggtgggcagatcacgaagtcaggagttcgacatggtgaaaccccgtctctactaaaaatacaaaaattaaccaggcgtggtggcacatgcctgtaatcccagctacttgggaggctgaggcaggagaattgcttgaatctgggggacggaggttgcagtgagccaagatagcaccactgctgtccagcctgggcaacagagccaagactccctcggctgggggggttggtgggggcagggtaagaattttggtgatctctgaaaatccggatcccacagcatgggtgtgatagaaatggctctgcagagtgtgatgggaacctcttgtgactggtcgtcagaactaagtttgagtccaacactcacttttttggcaaggtgcttccccgctccgtgatgcaattcttgcatctgcaaaacaggcggtggtcatgggatattcccgcagtctgctccactgggtacctacagagatcccttgacatttaacacaggcttcctgtgatccaggaactactgtacgaactactgtaactacctcctatattaacttttccaaaccttgatagcaaccttatgagggaggtggtgtgattattcccattttgcaattaaggtaactgagccagagagagagaaagcaatatccataagatcacacagctgaagggtgagagctataaaaattgctgggaatgaagggccatggttcttggccatggttcttggccatggttcagagctgtgataccaaccatcttccacttgttcagggagaaggtgtttgatccttttcttcactcagctgccttaggagttgggaggaaattttgtttcaggatacctaagttcttacaagtctcaacaattgtactttctgttccatctacatttcaaattcattgtcccttctctttctttccatgtaattcagccagattcgaaccctttagatcccttcctctagggaattaaggttggtagaccagctgagtaaatgtgactcagaaagtcaatatccacctgggcagggatgagtcatttctttctagttagctattcatgtacattttaaagctcgccacacaaagtcattacattgaggctattaacatgtttaatagtgacaataatagggtgtgacccatggcatataaccgcattcagataagaagaaagagttttcttttttcttcttcctgtaattgctcagtcaataccattttcacggaaatacttgcaaacaaacttttaaaaagttcattgtccaaagccttccctgattccttgtttccttcctcttcaggggttctataaacttttcctgatcagtggccggggattagcgagatggtgcactctgtcctgattttgtggttgacctacccttttgctggtgttgagcctgtttttattgcattttttggggtgtgtgtgcgcgtgcacgcgcatgtgtgttttttcaggagggggcacattattgctgctacttgcttattaacctctcaatctagaaatttcagggaagaagagacttccgctaaatttgccaagctagacacataaacagggagttagccattttggtgagaggaaatgaaacttttcttgggtttattagaccacatcctatgtggcttattttatgtctgatttctaaaaagcatgtcatcacggtcaaagttttatttttgcttgttagtcatttgaaacaaatatagatattgcttcatttcctgggtactgtatttttcagtacgtggtatgtatggaaaatttgggtttacacaatgaagtgcactagaagggaagtatttgctaatttagaactctctacattataactttggattagcaagcattcggctaactaaacattttcatttatctcctacccctgattatataaagaagcagatgagacaaccaaagaaatacccctccaagacaaagtgaatattttgaaatacttcctctcagtcttttaaaaaatgtgatttaaaaatcgtaggtgggatcatactatacatgcacttgttttctgtttattttacatctctctatactagaaacactttcctatatatgccacaaaaactgtgaaagtactaatgattatccctcctgtcccttaatatgcttagctattgccccaatgaactcagactgtttccaaagttccgctgttggccgggcactgtggctcatgcctgaaatcccaacactttgagaggctgaggcaggtggatcacttgaggccaggagtttgagaccagcctggccaacatggcaaaacactgtctctactaaaaaatacaaaaattagctgggtacgtggtcccagctactcgggaggctgagacaggagaatcgcttgaacctgggaggcagagattgcagtaagctgagattgcacctttgcattccagcctgggtgacagagcaagactccatctcaaaaaataaaaacaaaaaacaaaaaaccaaaaaacaaagttccactataaatagtgcaactgcatctcatgtggcagagggtggaagttgcaaatagtgaagagagagtgattctgggacattccataatgcccccttgatgtatgtgacccatcattgcttcgcatgtatagccccggattgttctgtgtgagtgggccggcaaattcaactcctcctcaccccctctctaccccagttcatgctcactgggtaggatgggaggtgggactgccagattatttttattttttcctttcccacattgtctatctgccaatatttttttgttgaagtcttttaggctaaatgagcggacaaattttctctgctgatcaaccgccgtggtagcatcagtgggcactgcagtgcctccctgggaatttttaatgcctcagtgaggtcatattcccagtgtagagggaacatgacgtagtcccactctacttatcagatgcagagcttgctaccaggaaaacagacgcggagaagccgggatcatttctggccccatttccctcattgttcaccattccttggactgcaaagagatgtcattgtaaacgctatccttttcattttgtatactaagcaggaagcccaggcactctctgtggaggtcttccaaggagctcatccatgcagaagataggagtgttcctgcaccctgcatcctagcctcagtgagcccacttgacaccccccagggtgctgcaagctgtgcccatgtctctccacgttagtggctacctcccttttcccctttcgtcgtgagtcacgtattttctttgtgtctcgtgtgacaaaggtcactcgtagagaagatttgggcctttggtgtgtgacatgtcatccccacagttgattgttttggctcctccccttttgtaatgctgtgaggtgacaggtcagtttttaatgggctagtctgcgtcaagggagagtataaattagccttaagactttgtattccatatagggtttcccatatgagaatatgcagttagcacttagggagaggggtagacgctgcaggggtggttttgacttatctgcctatcagtcagcgtctctgttgacgtacctgtttctcagatagcaatcccttttatgacgtcagcaaggtagatgtttggaatttggaaatggagaggaaccatatttcagcccagactctggaacttaatttactcatttttattaagggcagtgattattaggcaagcagctaatagcagatctgagttcttattcttccttataaggcctgtcctatggaccttattggaaaggtatttattgcatcagctgctgctggtttagtcaggagcaccatcatctttcaccttttacttcacacccatccagtgttctctgtcacgtctctgaaaggccatttcaaaccggtttgcattaagaaaaatcagtagtttcttttttttttagtttggtggaagcgccataggaggccagatttgcttttcctggtcaatgtctggcctcttctgtgggggccaaaaatgaaagaggagcagccacacccttttagattctggccatgtcacagcacacttacagccagcttcagaggccagtgcagcagggagaaaagctcttggctgggaagatctaaattagaggcctgtttgtgctcagagtgaaagtttctgttttggaaaagccagctccctccagaggggagggtggggatgggaaagcaacgaagacaccagagaaagaagaaataagagggggacgtgaggaggcatgtagtgactgactgcaggacatgggacccccctgctcggcttctgctcctaccccaccggtcactgggtcagacaagcttagcctgagccccgcgtcaccatccctgtcctagtggtagcctcttgctgtttagaaaaacagagttgggggagatgacagtagcttgcctgtgatctacacacagggcaggttgggaggggtcctgcacactctgtcacgtagtgctcatcccagctcctgcctgctaggtttgtggcaatatttgtggtaagccttgtggttcgccaggggccagggtgacagatgagaagtccacttgttcctgagaaatgagctccactagaaagtaggagcagcttgtaaccaaccagggggaagtcctgtgtgtaggttgtcacaactctctctcaggacaaatttctttcctcttgccagttgtagaagaacccatgaggaggccgggcacggtggctcacgcctataatcccagcactttgggaagccaaggcgggtgaatcacctgaggtcaggagttcgagaccagcctggccaacatggtaaaaccccatctctactgaaaatacaaaaattagccagacatggtggcaggcacctgtaatcccagctcctcgggaggccgaggcagaagaatcacctgaacctgggaggtggaagttgcagtgagccaagactgcaccactgcagggtgacagagtaagactcttgtctcggaaaaaaaaaaaaaaaaaaaaaaaaaaaccaaccatgagaaagatatatggaggtgagagggaaaggtgtaccctggagggatttcttatggcatcttttactggcttcagaaacacaggtcatggccagacgcagtggctcacacctgtaatcctagcactttgggaggctgaggcaggcggatcgcctgaggtcaggagtcagagaccagcctggccaacatggtgaaaccctgtctttgctaaaaacagaaaaattagccaggcgtggtagtgcgcttgtaattccagctactcgggaggctgaggcaggagaatcgcttgaacctgggaggtggaggttgcagtgagccaagataatgccactacactccagcctgggtgacagagtgagactctgtctcaaaaaaaaaaaaaaaaaaaaaaaagaagaagaagaagaaacacatgtcgtacctgaagggaaggtaggtcctttccctgcccttcttccccatttccttggtaggggcagcagtgtctggcacaggctcctgacccttgtgatgtaatgatatgttggggatgtttgtttcttcttggacctttcctgtttgggacagcaaaatctacaagatccaggtctccgttggggctttccgcactgggatcttccttggtcaggtcacttgcagctgtttttcaaatctacactcaatggcatgcaattctgtgccctgatttaacgtatgagggtcaagtgtgagacgtgggatttttatttaaaaaattgtattttaggccgggctcggtggctcacgcctgtaatcccagcactttgggaggccgaggcagatggatcacaaggtcaggagttcgagaccatcctggccaatgtggtgaaacccccgtctctactaaaaatacaaaaattagccaggcatggtggcgggagcctgtagtcccagctactcaggaggctgaggcaggagaatcgcttgaacctgggaggcagtggttgcagtgagctgagatcgcgccactgcactccagcctgggcaacaaagtgagactctgtctcaaaacaaaacaaaaaacaaaaaaaatgtattttaaaatatattatgatcattgactttttcttttggtctcctgttctacgaattgtaatataaattcgtattattgccaccacgtaggacacagaacagctccatcgccctgtacatgtcctgttgctgcctttgtgtagtcactggagatgtgggttttatttttattattttctccatttgatagatagtgccgacttgattcacttcatccattccagggccaatttttcactgttgattgtcaggggctctgctctgctgtttctccagccctctccagtgaaagagatgtaactgcagtgccatagttgtcagcttgttagttattggcaagtcttggttggattttctattcttcattgtgggctgtccttgcctgtacacctagcatgctctggaaccctttgtggatttatgagaattcaagctaattccaacagtggccaaagaaaaaaatagccagggaaatatgttattgctaaccatataggcctcagagtgaaaacggcttttggagtattctgctttgaattatttattttagtctttctcagatgtcaggacagatttttaagatttgggcataatgtttaaaatgaagatggtatgtctgtagattttattgacccaacttggtccccccaggctgtcctcacctgccccactacttagatgaaaccaggaatggcaagaggagagcatccaagccgcctgcaccagccctcagtgcatccccacccaggctctggaacgagctgctacatgcacgggaagaccagagctgccgtcttcctggctgttgttcagagcttatgctttcttagggaaaagtacaatgtagggctatgtgtgtggtggggatcttctgtgtgtgcttgtcctccccctgggaaatgatgagaggtgacccccgagctcccagctcagtgtcacactcgagtgaacagtagatgatgcttctgccatgcgttttgctggggaaggtaacagccatcgcacacatgtaaattcttgtgtaatccaattcctgtctttgtaattacttggagacttgccatcgcagccaattgagaagtgggagcagtgaccctgggcagaaagcagaaattggagaggaggggaggggcggggaggtggcatccagaacacagttgtagctctcctggctttacagcatctaaaatcacttcaggatcaggaaaaagcaaaaacattataactgccctccacgcaagtaccccagcttttctgtcccaagttcccactccctctacctctctcttagcaggctggaggaattctcagcaagcgtgatagagtcaggtcatccgtgacttagctgagaggaaggacttttactgataagaaactcccattgtctggcaacaggtttctgtagaggaatgtcttccaggtgggagaagaatggctttcatttttaacaaccacacactataaacaaagcatcccgagagcacgggtacctagcagaagaagaacgaagtagccaggaaacaagttgcttttcagcatccccactgaaatgatagggtactttagaaagcgggtggtggcattctttccacaagtacagcaagtgtcactgtggggtcttaattctctcgaatctgcctttagaaggcagaaggcagaatgatcagctctgctctgaatgtgtttgccatttgattgacgtcggaaacatgatgtcacttctgcaaacacccacgtgagaaggtgtattttttttttttcttatttgggtgacagattgcatgttagggcactaaaagatgaaagcactaaatacttgctttagaaaaacacagtggaagattctctcatcctccccgctgaaaatttatgggcttagaattccatgaaccaaaatgactgtcttcagttaaacttattgcgaccctctgggcatgattaacaaatcaggtggaaagggaaggtggaggagtatacgggattcttttttcatgttgtgtggaatagggcactttagttgaaattgaggttcaagttagcaaaaagaaattccatccttcggctgggcgtggtggctcacgcctgtaatcccagcattttgggaggctgacgcaggtggatcacctgaggtcgggagttcgagaccagcctgaccaacatggagaaacctcatttccactaaaaatataaaattaggcaggcgtggtggcgtttgcctgtaatcccagctactcgggaggctgaggcaggagaattgcttgaaccagggaggaggaggttgtggtgagctgagatcgcgccattgcactccaggctgagtgacaagagcgaaactccgtctcaaggggggaaaaaatccatccttcttcaatgtgtatcttatccttctcagtgtttaataggacgttctactcaatggattggtttcctccctataaaaaggagcattttgttattccctctttcagatttaatgataaagtcataattcctgcaagccttttgaggaggatatatcttatctcataagatagctgggcacagttgttcaggcctatattgtcagggctttgggaggcctcaaggatcgcttgaaggcaggagtttgagaccagcttgggcaacatagcaagaccccatctctacaaaaaattaaaaagttatccaggcatggtggtgcatacctgtagtcccagctacttgggaggccgaggcaagagaatttcttgagtctaggagttcgaggctgcagtgagctctaattgagccactgcactccagcttgggtggcagaacgaaaccttgcctcttaaaaaaagaagagaggggctgggcgcggtggctcacgcctgtaatcccagcactttgggaggttgaggtgggcggatcacaaggtcaggagatcgagatcatcctggctaacacagtgaaactctgtctctactaaaaaatacaaaaaattagctgggcatggtggcggccgcctgtagtcccagctacttgggaggctgaggcaggagaatggcgtgaacccaggacggggagcttgcagtgagccgagattgtgccactgcactccagcctgggcgacagagcgagactccgtctcaaaaaaaaaaaaaaagagaggtgtggtggctcatgcctataatcccagcactttgggaggccaaggcgggtggattgcctgagctcaggagtttgagaccagcctgggcaacatagtgaaaccccatctctactaaaatacaaaaaattagccgggcgtggtggtgtacgcctgtagtcccagctactcgggaggcaggaggcggaggttgcagtgagccaagattgcaccactgcactccagcctgggtgacagagcgtgactccatcaaaaaaaaaaaaaaaaaaaaaaaaaaaaaaagtgagaaagaatgtggttttggtactcagtgtctaggacgtctgtttaatgggatggttaggagcgtgtgctctgtactctgagctcaaaccttggctttgcctctgaccagctgaatgaccatgtgcaactcactgtttatgcctaagttttcacatcataaaaccaggacattattttgcctatctttacttattagtagatttgaatgaattacagtatataaggcaagtgacatacatggaaactggcaaacatctgttttttgttgttgttgtttgtttgtttttttttttttttgagacagagtctcgctctgtcgccgaggctggagtgcattggtgcaatctctgctcactgcaacctccacctcctgggttcaagtgattctcctgcctcagcctcccgagtagctaggattacacgtgcccaccatcatgcccagctaattttttgtatttttagtagagatggggtttcaccgtgttggccagggtggtcttgaactcccgacctcaggtgatctgtcttcctcggcccctctaagtactgggattacaggcatgagcacctggccatatctgtattttttaattcacttctttgatttgggaggaaagaaacctgaaccctcttcttagtgggagtgggataggctttaatgttaatactatgcatcatgtattaaaaatccactatccttctggcactggattaagcttttcataagtattattgtttcacccttacagctgccacagaagagaaaaaccaatattatttaaagtttatgtataaataagctagtcgctaacatgtactcagcacttactgtataccaggctctgccttaagtggttttcatatattaactcatttaatctgctcaatttgtgggaaccattttttctcattttatagagaggaaactggtgcagactttttttttctttttaataatttgtccttggttccactgaaagtaattgttaggactgggatttgaaggctgggtcttcaaatgttgtccaaacgaggctgcccacctccccatcaatgacaaccttctgtcctgtaatgtggaagtgggcccagctgtatgagaagctcagagcacacagatgctgtccagatatgctggcttctgatccttgcagagaaaaaatctttattaccggaagttgtggcttctgagcctctctgcaattggcaacatagatttttgttttgttttgttttgtgtgtgtggttttgttttttaaataattagaaacagttctacaattgttaccacccacagtaaaaaattgcttggatcccgcgaagtaagaaagaaaaaaaaataggccatttggtagaatgattaacagggggctttaaagaggaaagtctgctttggagggtgagctttggatgtacagatgctgggaccctcgtgtttttcaagtcccccatttgcctgcattgagaatcaaatgtgaatggtggttgccagtgataggaggggttacaatgcgtgagatggctctgggaggaaactcacattttttcgtacttattaatggtatgtcttttgtgcgagtgggtgtgagtactgagagcatcaagtgtatatttgcacagtgtgtggtccttgctgctgtgttccactccccatgatggtgggctacactaggaggagaagcaagccttagcacagcttgacagtttccattatatggacagagtcactgaggcaggagcaagccaggcctttttccaggtcaagggagctgggtcagtgtagctgggactcttggtttcttagcactgtgctctgactatcaaagctacgcccccacttttgtgggaataaaatcggtgcccttgcatataagttgttcgcttcactcccagccccctcctgagaattaggatgggccaggatctgagttcagtgcctttggtccagtaagatgtgctattcattggcgatccttcccccatagtttcaagactgtaagtggtcacatgggcaaagagatgatttcctaatcctcgtgggagcttgaaggatttgcctttgttaaaggaggaacatcacgctggaggggtgtctgtctatgtgtcccacttaaaccacactgcttttgacttctcctctgtgatgattcccaggcagcctcctcttgccatcctgacttgtttaaatttatgggttgttggcaagcaattttttgatgctattcttctcatagccagaggccaagatcccttgtggagcagtgcctgaatttaatagatgtcatctggacaccagggaggggcattgagaagcactgggggaaaagtcttagaagtgagattttacccctaacgccgtctcccagcctcttatttatccttttcagggcaatgcagcctgtgatttttttggtggtaccatagtgtcatataccatactctacaattctaggacaaaggacacagtgtcctaatggtcttgcagatggcctaaaatacatatggtaagccacttatttaatttgatctcaaatatctcagcattactgagctctacacctggatgtttacaaagcctgaagatctgtacccactgctgtaacatcaggtgacactcaaggaacacaattctactcttctggctgtctggggtcttgggtcccaggctagggtctaaggcagacaagacagtaccatcccattagcttggtacatgaggcttaaacagttcctcgaagtcatggggtgaaggagggcacagttaactcagcccccgcttattcaaatatcagattgctggctgatagtctccctccctgcaatgttggcaggaagcagaaaagaagggaagattgtgacaataactgttgcaaaggccattaacttgactttgtgggacagacatgtaggtctctctttactgcttctggacacaaattatgggaaagcctgcacaataggtctcattaacttccagagtgacatgacagggactccagcttttgggacagcttgagtccatttagtaaaatgttattgaggacttctgtgccaggcagggttctggtgttggggacaagggtgtgagtgagaggactgagttgttgcctttaggaagtgtaccgtctagccaggagtaacggcttgagtcgaagtcggctcccattgggcctcttagggagtcccagtttgctctgaggcctgctcctctctgggaagaaatcaccttgagagcttctgggatttggaactccctgcatggttggatcccttccatcttcatgtgaattgtcttggtaatgaggctgcccaggaaagccataacacagggacatttggtgggcaggtccactttcgaagttctgggagttaccgtggctattgttctgactgcagtctagatgctcccaggcccatttctctcctttttcactctttagttctgcctggtgaccagggaggtgccccgcacctcacctgtctagtggggtttcccaccacacttccaattcttgctcattcaacatcaagtctttgctctgcctttcttcgaatcacgaagatcctgtctgccagaagcatcctgtccaggttccaggcagacgacagtctctgagcattccagggtcttacagtttagaaagaggagagagcaagagaatcttaaaagcaccataagctggagctgtttagaatagagcaaacggcccttggggctctggcaattgatgtttgtaattagtatcctgatttattaagaagagtttgttgtctccaggattaaaacaaaacaaaacaaaaaaatagattctttagggagattaattgggactgtcctgtgggtaaggagatagtaagaagatagcagtaagtggaatgttacctaacaggtaaggtgcaaatgggctctgaggtactcccttgaacctgggcttctgacacaagaaaagtaaaataactcaggtcagggaaatggacctgagtgcactgagaatattaatgcaaacagaccccaaccagagtaatgtgttcactgtggttggggtgggtgggtttgtagaatctgttacagaatcttggaattgtgagagcagactgataactctaacctgaccactcttcaaatcctctcttgaacagtgaggaagcagaggctcagagaaagaagactgctgtaagatcaagcaatcgtgtgtagccagacagtgggagaatcaagactagaatccagatctcttggttttcctctttcccctcggccacctccgattcaagggagagtttaattttgtgaaccattcctgttaagtgccattaatttcaaggtctttctggattagtgtgtgaaattcagtgtgttcagtatgaattcacttattttccacttgaaatcctgatttttctcggatgccccgggtgttgatatgatgatcaggaggctcgtgatggtgatgaggatggattaatataatcatctctgctaaaggttaacgagaaagcagtgagctggaattgatacataaaaaacactgaaaacttttcaagcagtgaatgtgctttagcgatacatagacaatcagatcttaccatttatgtgtgtattttgaatgatgaatgaataactagtctttcccagaggactggtatttgggaatctttttataaagtgttgctttctgggctttcattaaaagctcaaacatagaaatgtatgaaaatgatcctttgaaaacaagtttggcaccaacactatgtgagaaaacttgaaaagtatataggttgtggatcaccagttctcgaactcaggaccaccctgactgagttgaccatgatcagaatggatgcaagagttcactggttttataatttttgcgaagagctgtcttctgcccttagcactcccatgtcctgtaaccaggaaacaagccggtgccctgggttgagttcagcaagtttgttttgacttgcagcccatcatgggagtgaaactctcattatgtaatgttaaactgggcctggaatgtcagcagagcttggcctgccaaagcttgaagggttggttgggaatggactatgtttagtatgactaatccagctcggctgggtactgggtgggtgggtggctctctgaggagggaggtatgacttgggctatttcaaatcttagcactttgtataaactctgtagtccctcccctcacccccttcccctcccacaaaagaagttaagccttactgaccaaccagtacagtcaggggctgttgactgatacccaagccttgatgtacacatttgtggtcaagacatcaagttgcggccgggcgtggtggctcatgcctataatctcagcactctgggaggccgaggcgggtggatcacgaggtcaggaaatcgagaccatcctggctaacacagtgaaaccctgtctccactaaaaatacaaaaaattagccgggcgtggtggcgagtacctgtagtcccagctacttgggaggctgaggcaggagaatggcgtgaacccgggaggcggagcttacagcgagcttgcagtgagccgagatcgcaccagtgcactccagcctgggcgaccgagcgagactccgtctaaaaaaaaaaaaaaaaaaaaaaaacaacaaaaaaatcaaggtacatcacttgcaattagggaaataatgcttttgggtcctgtgaaataatggtgtttcttaaagcagcctatattggtcaagcgttgctggcaggggcacttagtaattaaagcaattacacaaagtaaacattaggttccttaataaaaatagcagtgaaccctagtaaaaactgaatgtaaggaaagaggtgggctattttcctaataaagattccaaagtataatttagggtctgtcggctgaccttcttggtcttcctttgagagcctccagccccctttgcccccatacttccccaccaagcttcctcttggctcttcttaggggacaaaagaatcccgtttttatgcaaatgtttttagctggaggtagaataatcaggaaccatgtttgcacagtgatccttaaacacaatgtggacccccccaccccaccaggcaaaggttgcattttggtgaggatgacagagcccccagcctctgctccgcctgaggtgaagtggggaatcgcttttgtcccttccctgatgaatgggtgtaaagtgttcactgaacctggaaacacctccttttgtgtccggtgctctcctaacacaggccgttaaacttggggcaatcgctcatggtgggggattgaatggggccattgtgggggggaggggtgcacactgaagccattgtgggcatagagatgccattgttttctcagtattaagaaaaggagtaggactctagggacctccaggcatcagtgtggccgaccactgcactgactgcttttctaggtttgcattatccctgaggaaccccctagcctgagaggttgggcaaggtcagcctaggctggcagcaccgcggggcgccccctgcagtatggacgtggtattccctttccggcctctgcagggccagggcgctccatttcttcccaggactgcctgccctggtcgtggccgtcatttctgcagggaggttgctgttttcctccaggcatcggagttaaaaagcatttgttcaaaaatcacttcttccactttaggaataacatattctcccattccctgccggtgactttttcatttaattttcgttttgccatatggtctttcagaggcactctgatcttaattatagtattcagcctttgtttatttaaaaatcagaaggcagataggctattgagggtttatctgtactaattgtaccaccatacctgccaactgtccccttaaccactacaatccctgccgacagtgtgtatacacaaacacacgcgcgtgcacacatgggccacataacgtaatgtgttgatcagaaaggagcgtatttccagctttagaattgccgcactggcattttccatcatgaacccctgccatgtagtgttgacttgaaggggatttagccatgggattgggaagagcagggagttagggtcagaagacctgagctcaaatcctgattctgccacttacggtgttatcttggggaaacaattttattcctggagtctcagttttaccatctataaaatagggatagtgctatcaatgtcccagtaagggtgtgggatttattttttaatttttatttgtttatttatttttttgagacaggacaggctctggctctgtcgcccaggctggagtgcagtggtgcaatcaaggctcacagcaacctcccctcctgggttcaagtaattcttttgcctcagcctcccaagtagctgggattacaggctcctgccaccacgcccagctaatttttgtgtttttagtagaagcagggtttctccacgttggctaggctggtctcgaactcctgaccgcaggtcaaccacctgccccagcctcccaaactgctgggattacaggcatgagccactgtgctggctgggtgtgggatttaagtgagatattatgaaaggctggtggatgtgttaagcatcctgacatctggtgttcaagagttagaaagtgaagccccatacagcttttataatcaacaggcttagatgcaatggcctcagttgttttttgaaacataatgtgcatatggttcattttgctgttttacctgcctctttgataacttaaatattctaattaaatcatggcttatatcagaatgtataatattttatagatcttttaaaaagtgacttgtttgaagattataacatcatttcatacagaaaatagctttgctatgcttacattttgaaaacacctgttgaagcctctaaagaaacatgtttataaaatgttaaacacgtcagttatatttttggtttaaaacaagcatgataattcttgacttcttcctctgaatttgggaagctcttctgttagagaaatcaatttttttcctccctgatgcctgaataaagatgcattttaaaaaatattatctttgtagataataatgaacttttagttgttatactaggttctaataactttttcatcaggccatcacagtctgaataattgtaaaaaagtcaattgtagaaactgtttaaagaatttccaattctaacattttctttgaaatgtttgagattgtctactggggttttttttttttttttttttacgaatttttttcctaaaagatttttcagaagcagtgttttcacatgtaaatatctgcaacaaacagcacttaaccagtccttaattggttctatatatttatacgtgagacacagcaataaacatgtagtatacacatgtctttggtaaaggaagctcttcttctcacaagcctggctgccccaaaattatagtgaaggacaatgtcgattctaattgctggcttttgacccctacatctatatattttacctaatttatagttggaaaaggagctaaaaatgttaaaagggttcatgccagtagtttgagttgttgtagtttataaagccctaaaattaagtatggaagtacaagaaagcctatgctatgtactgggtcaaagagaagaaatccaaattaatattaattggtattcatgagcaatccctgagtgcccgtaatgtttctgtcccaatcatagactaatctggccaattgtatgggtcagacaaaatagccaacagctctgagtttagattggtatgaaaaaaggggatctgactgttaacaccatattccccaagtctgtaatgttctctgacctccagtgcaaatagctgttcatctttagatgatttgacagcataatttagcatttgggattcctttttttttttttttctaagtggtgattaaaaacttgtgcttcttctctagcatataaatcaagcttttcagttatattttccggggcatagaataattgaagtgaattgaacattgggctggatggtcatagaactggtttctgttagaggttaactgactttgaggaaattataccatcaaggtactctggggtgtatctgtcagctttttgacagttgtaaataattatctccctctctagattattaattccctgagggcaggactttgattcactgatatatctatctatccctagtgcctagaacagagccaggcatgaaataggcactgaatcagtatttattgaatcagtgaatgaatctccaagtgcacctaagggaaggataccaggaagagtctactgtgtttatggaaacagcagcaataattcctcctcctcattttcatttgctgaaattactaaccaactgggtgcggtggctcacggctgtaatctcagtcctttcagaggccaaagcaggaggatcacttgagcccaggagtttgagaccagcctgggcagcatggtgaaacctcatttctacagaaaatgcaaaaattagccaggcgtggtggcatgtgcccatcacctcagccactcgggaggctgagatgggaggatcacctgagtccaggaggtggaggctgtaatgagctgtgatcacgccactgcactccagcctgggcaactgagtgacaccttttctttaaataaataaaataaataaataaataaaattattaaccagctaatctcaaatcaattcttctaaatcctctgagcttgtttgtttttctgtctgtaaaatggggctgttttcatgtgagacttagattatgagaaatagtcacgcctaaacttccttgaggagatgctagacaaaaacaagatggttttgaaaaaaataacaccaccgtccagactgtactaagatgcctggttgcatttgaaaccagtttcacagtctgctttgggcaggtgattgcgacatgctttccatctgtgcctaatgggagtatactcccagctccacatggcagcaggaacattggcagggctcttctggagagaggagagagccaataggcgttgctatggtggaggcatgacataattcaattttactttattattcactggatgtgcccattgtatgttagcctctgggtatgtttacaaggagcttaggaaagaggtagaggctgtgttgtctgtagaggctgtgctgtcagcagaaggggccaggcatgttcacacacacacacatgcacacatgcgtgcacacgcacacttctcttccctggcatgcagcaccaatcttggggcagaggtgaaatcaccacccggctagcgactggcaaggctcagaaggacttgctttcctaaaatctcctcccctggtctcataattccctgtagcagcttggggcttgggtgtgtgcacacctaatttctctgagaacacatacgtgttgtaaagggcacagcaatttcccgtgcttacttaatagtgtttaaatcaacttactggatttgggtgcctttccttgccaacattcctaaacttcatgtgaacagcaaaagttcaaagtccaccaaaacatcatttatttgttaatgaaaaccaagcaatttcagaatgggatcgtactgtcctgtactgtcaccttctctctgatgttatggaggcatgttgtctttctccagaggcaagcaatattgtgttttaagcttatgaggcaatcatgggaggcgagtttggccagtgtttctgtgtattcagatcctcctccttttaaaaagaataaaataaaaggtagaaggcttttccctgattatgcttttctggtgggtttctatttgtcattgcggtttataaaatggcttcttctcctctgcttccaattcatttgttaatattaactcttggttgtagcagagagtcaccgttatctgaaaagcaaattcccttatttttgtcatattgatgtagtagcagtagttaattagggacctcatgagtgacaggagtttttgggttctataaccaaaaacccaaacactggccaacccggtctgccttgtcaagtcggtgaaatcctgacagcttgcagtttcttcagcctctctccctgcacttcagtacaggagcagcccagtaatagtcccgatcgctaataagagcacaaacacccgtaagcaggtgaattggaaatattgtcattttgactacatcaacaacttataacttaccaaagcaacttgatgtccttacttaattcttcccccgcacctccccaccagtgcttgattaacaaactggtcagtggctatttagacatgaatcacagggcataggacatcctcataggatgagctgcctgggctggacacactggccaggttgatgacttctcttgaaaggggggttctgtgttgctcgcaccttcacctagaaggagatgtgaggcatttcttagaacagtgttcaccccctttagaatttgtgaccctttgtccttgttagtcttgatggcttccagttctccaagccccaaagaactgtgtggtttctcttatttctgcagcatttaaagaaattaaattagttttcctgggctcctcaccatctaatttgtttcccattagagataaataatgacgtttggggcatcataaacccaaggatttccatgttagttttccaaggacctttttttaagagagaggggaataagaatatttgggtcagatgttttaagatgttaaatataaaaatcagccttttaagaatcaaatgcaaagccagtcacttagccttgaatttcccactgtgattccacttttcaaaacccaggatgaccatcatgatgggtttcgttggactatcagttgttacaggtcaaatcatagtctcatgattgttaaaatcttaataaggccccctctaatcctgtgagttttcagaaggaaatccctgtgaacaatcctggaattgctttgcctggtaacatcttatttactgacaatatccccagctgagctctcttggttaatatgtttgctctggcactgtagttcctttttaatcagaaatgcttatcagtaggttgcatggttggggaaaatggcatttattttgtagcattttcccaaggaatattggatgaatatttctttagtactaaatatataatggtctttgtcttaagaacttattagcactgagatttctgtgttggaattttctttattgataccggtttgtaggttctggagagtccaactgatatttttttgcatctcgatcagaagctctgactttttggtccttagcagagaatacatcccttgatatcttggaggcgcccttagtggagtcaatggtgtgtgggcttaaggagaagtcagggcattagcaggtctgtattttcctccagcgtggagttttgtcatttctaatgatgacaatctatcagtccacatggttcaaaatgaagataaattgaattaatatatgtgagttaaccgactcattgatataattatactgtgaggatttctttagtgtaacctaacacatttagtagtgttaattgtaatggctttgcacgggagcacttaatttcctaagcaaacagaataatttattaattctcaaaaagcgatttcaaggcctagactgagagagaaagagtatgtgttttactgtagtctcagtttgctttggcttatcagattgaaaattgctaagaatttttttccagattccaacttgttattgctacatttccatgtgtgcccaattcaatagcgtattgaaatgaaagtaggaaataggtaccgtccagtaaatcttaattaagttattgaaaattgaagagcactgaataataaagcagttctaattgcagttaaaactgtattggcagcagatatgcttgaacagggatgataaaacagctgaggaagagcgttggatggcagaatcgaaaaagggtaatacacagattaaatgcaaaactcaaatgttttgtgaaatgtaggcaagctgtgtaaacctattttttgctggaaagcatgttttctgtcatgtcagaaatgatcacaggaatccttttaatattcatttaaatagtttttaattggcttcagagagtttaaagttcagcatgaaggtgagatctaagcttactaattagatcgaatgcagtttgacttaaagagcagacttgataattaaagaatttcataccaaatatacattttgaaaacatttcttttcacatccttgaggtaaaatgagttttcctgaattttttcccttcttttcaaatagaaatttctcttacagaaagatgatcaaatcttgtatcgcttgttagaaaatgacaaacctctcatttgtttgtcatttagccaacatcctgtgttcaggttattctaattttttttcccatccaagtagaattttgaattgcacggaacgttgtgatgaacacaagttgttgtgtcttgtgtttttccccccaccaagttgtttgatgctgttgaaatggaaggctgaagtagaaggggcacttaagcagtgaagggtttttctttgtaaataatagatcaagagcactggatctgtatctaatggagctgtgtgcggcctccatttcaaggacagcgcgcggttttaaaaaccacaactaccgaccatcccgtccacaacctgtggtcagttttgtgaatgtgtgtgcgtgtgtctctgcttgcctcctctaattccttagcacccttcccccttaaacaggctgctgtcacgtcatatttgatttcataaagttaaaaatagaaacctcaaacaatatgaagatgtgtatcgatatagctccttacctgtcttctaatattatggaatgatttgaggaacttcaatcctattttactcaatgtgtgaatgagcctatttgactatggtaggctttctaagaaaaggtagatgtatgtagctgacaacaatgcagaaatgtttgtcttaggagcagaaaaactggattggttatgtatagtttatcatgataatctgatgaaaaattaaatttatcattttctccctcttttcccttccccttccccttttgtaggttataaatatgttcttatatttgccagtttgaacttgtgtttgaaaatcatagatttgatactctcaagtattgtggtgttattgcatacaattcctaaaagcacaataggactttgttccctctgaatttgaattagttatattttatcacttataatctaaattagacctaattaatattttcccttgtagtgtaatagtgcaaacattgccagtatcttaaaatatgtagtctctgttaaaagcatatttgaaaacagaaaaataaacattatatgttaaatatcaagtaggagtctatgtaaataaaatagaaatgaaagtacagattaagcctggggatcctttgcttatttgtgaaatcgttgtttataagattacaaggtagttactgtaaattgaaacatttctttttttgctgcttcccccccgcccgccccaagtgcatcctacacatttgggcctattttttaaaaagggttaaatagtctttccttataaaatagatccatagataatctaggtaaatagattttaaatcatacattttaatattttttattacatacaaaaataaatgttgaaagctaatgttcctaacacactgctttcttgaaagaaaatcattaatcttctcaaatgcaagtgtaaagttgatccattttagctttcttgtccataaattgttgattattggttttgaaggaaaacgcagtatgagtgtggtttgaattttaacactgaaatcatagatgtacaacatgttcattgcagtcaaatcacaagcagagagaacccatttgaaacaatatttaaaacattcctgtcggggcattatttaatgggaatgataagtttcagattttaggttttagaaagttgaggttggctgtacatcaaatctacgatttaactgctttgaaagaacgcctttgcttgtcttcagggggaaacaaataacttaggggacatcagttcattctctaacagtctttcatccctaagtataacaaattgtttcttttattaatgtggtactcgcactatggaagcagttctttggggaaaataatcaggaagatatgctttgcttctcctagatgctacaacctgaaatatgttgctaccttccttgaagggattttctctctctctctctctctctctctctctctccctctctctctctctctctctctctctctctctctctctctcttctccccccaacaaatatagctaacgtaatagaaattacagaacaggatacaatgagatttctttcccttctctcacagcacgttttggttggctaggagaaggcaaggtattggaatatgattatccctatttaaggaaaaaaagaatgatataatttgtcatcttaccagttctcggcattctttgtggtgcgcgcttagtcaatgccgggaaacggcggtctgacagctaatagatatctctgccctcaattgtttagacattttttgtcttttgtgacattgaagaaaagacaaggaagggaatggaagcaactaaaaaatgtcaaaagatcaaaaaatcaatgggccgcaggaatgcaatctgtttaccggggtgtagctgctgtttctgctccgccacaagtccgaggcggttgtctggggcaggcaccgaagttgcgtcgcctccctccctgggagctgtgatacggcacacaaagcgggcacattagcttgctcgcccccaccccccgcccccataaataaataataaaataaatataagcttttctcttaagactgcaaaaaccaagttttttttggtgctgtgtttttcggtccatttccaaccatttccaggactcgctgggctcagcccagcagacggggtcgagaatttactggtggtgttttaattttctggccaggggagaacccttgatgttttttattatttatttgtttgattttggagagaaaaagtcaattaaaagcaaatgggtgataattaggtgaagcacattgggcagatgaataatggttttgtctctggcttggactatttggacgaggcttatatgtctgtcttgaggtgatcagtgggaagaggggaaattttactggaaacttgtttcttaaagaagagaaaggggtatgtggatagtaagacttatttagttttgtagggagggacagagtgttggtttttctccataaaaacatttgggttttgaatgacagactttgttgccttttctttttcattttttaaagttttcaaccaactggtcatctggggggtgtgtgtgtgtgtgtgtgtgtgtgtgtgtgtttgttcacctacacatttgcctggagtatagtgagaacccaggaaaatggataggccctaccaggagaggctgcaatctgttggggaagttttttttttgtttttttttgtttttttttttttgttttttttattttattttattcccaagccttggttgctatttgatagtaagtgtggtccaggctgcatattttataaactttctattaaagttgtggcatgttatcataaaactcaattgcgatactttgtattacgctctgggattgagagatagacataggattaaaaaaacaatttctaggcatttctagatgataaatttaattttctttgctatttggaggtcttctttgaaaatgcaattgtaatgaacgcattcagaactggagaatagatttacccttggcttcaaatagtcgacgttatcaggcgctgtcattcgttccttcctattttcgggctgctaattgatgtttttgatgtcagcaagaaaattgaagaaaatgtcatgtgtgaaccagtgcggaagttaataagattgacttcgttgacagaatttacaatgagagcagagaccgcataatgggaccgctgcgaattcgtgtgctctctttggagtcaaaattgacacctcacgctaggccagtggtcgataggagagatggaacatttgggaaagttcctaatctcatttttccccccttaccttttggtctccgatggtgatttagtttcaccggcagctgtttatccagggggctattgctgcggaccacgccaggcccttagttcagactcctggtgccaccaacaatgcttattttttatgctgttttgagtttgaaagcaaaagagtcttaaaaaggttagattaagatgtgtcttaaggaaagatatactaatatcggtcagggtcattgcagatgcttaggttatgtgcaataaagccgaaacacaaatccctccctgaataaagaaaccatgttggcactaagatcagtccttgaacataacagaaggttataacttgcaagcaaaaaataataaagttcttggccacatgtctccacccccaaaagaaacattttagccatggtgtcccttaaggtgtttttttttttaaaaaaacttatcgaaggtttcaatataatagactaattttccagttatgtggcaaagtttattggatttgtgtgtataattatggattggattagttgagtttggttcagtgcatctgattatcttctggcctttagggaaatgcgctaaaaccctaatatgtccactacccccaagcggtctctttttgaaggcgccgcacaaaatgtggtctctaccagcgcttggcctccaaggatcttcagtgagagacattattcttggaatatccaattaattccacgggcagtgatcagttagcgcttcttcttcctttctcgccatttgaaatgctaacacaatgaatattttctcattggtctgtgtccctcggctaagctgttgccgcgggctgagaatttcatcgactgatgagaccagaggctccgccaataaaaggttacagtacgtgatttgcatgccaagtggggtttggtttcatgaacttaaaagttctttaacttttatttgactctttttcttttgttcaaagtagattgaggggtagtatatttgtgagtgtttaaagtatgaaaattaccagggacaggaggtcacaactgtattttggaccatcctcacacagacggagaagatggcctttgtgttagtggcttttatggagagcaaccacatcaactttctaagatcaggtcaatgggaagcagtttttcagatgttgcgatttagtgttgggtccttcagtagcttgacattttggggattggtactggtagagtatcttgtagtactaataatcaaatacagcatcatttgaaatgacaagggagccattgagtaggacattaggaggaggaaggactattctttggagtggttggtaatcagagtcttgggtactgagaaaatcataccttctagaggagtgttcagaggcagaatgtcttctgttttcaaggggacgtaggagggtgttatgaaatactgagttgcaccgagcacaagaaaatttacaacaaactaacagcaccagtgtcacaggaggataccgatagcggagtagattgtggtggattagattatggcctacaaaccctgagtttcagaacagtttctcaaccagacaaagcctcaggaagtatgaggccaagagcagttacacatgcattaaattggctaaatgcttggctcagaaaaataatgtctgatggtgtcacctgcatctctttcatcttccagactcttccaaacttggattttattaaatcaggatgcttcttgttgatttaaaggcatgatagatgtcttctaatctaaggagtattgtagacaaaagcaaagagggagtatggtcaaatgaaggtacttctatcccttcgcaaaatggggggaaaagggattgaggcaaaaggaagagtcagccttcaaaccactgtaatcttagaggaagggtaatatgattggagacttgacatgtttcaactgaatgaaaaatcatgatacctttaccaaaattgttagcaaaagggaactggcagggataggaatggagagagccttgcccctcttctcgctctcccgccctcttccttccttcctctcctagctgtctgtgaggagcaaagcaggtggctccctgtggctgacttttcatgacaacatgccattagaaattgccgtcctgttgatcaatcctctcgacatgacagatttgccgcaaggcctggctctttgagcgccagcactgtggcttttccctccttttttcctgcactaattggtgaaagtttttttactgtgctagtggcagaggaaattcttttgaacgttgtcacaatcaagtgttgacttctttagaattgcaagtaggttaagtgagtatcaacattggggggtgaatgggaggagggaaaacactaacacaaagttactactacctaaattttatgattagagtagtgttggaaagcaaactaattggatttaccccccttctctcaatatatatattgtggggggaaatgcacacgtacgcacttgcacacgcacacatacacacaacacacacacacgtgcacgcacacatacacacaacacacacacacacacacacaaatgaaggcaagtatttattaaaatcacagccctttaaaacttccattatgttttgtcatgggggtgctgaggcagccctgacatttgcaatggggaaaacacgttgccatattgattgaagaaaatacgtccattagtttcttcctgtaatacacggattcggaacaacagtaacacaatcattacataacacactgtaaatcaaaggaatatatgaagcttctattagtcgagcacattttactctgaacttagtgacattcttctgtccaaaatcagcatacaaagaatcaaacctcttggcaaaggatatgtccttagacattgattcttctcctgaagtatcaagatacacttctgcttaaattctgacattctagtttatacataagattattttttaacctagaacataacaacctttcttaaatgatttaaatccaaacttctctatgaaactgagagttaatagggtttatctttctatttagacagaatttgaattggaaacctatttttaatattctatgattcaaaatgtttactgaaggaatttgtaaaattaatctttgcttaaacatatattccttgatgattaaaaaacttgttagattaaaagcattgtttagccagattgagacagaatatgtgtatttacatttttcatgtcacagaatctgtgtagtacattctcattcttatctatataccatttcagataattccaagttggtaagaaagtaacagagagtatgaaaccctgcaacttaaccgtgggtttgtgactatcaggaagaaattgtatgcaggaataaagattttgtactggcccatcatctaaaaatagcaaccacatgtaaaaaagaggctacttctatttagcagtaggtatttactaggaaaggagaattatagcaataaaagttactaagattattagcggaatttctagtaaattgctttagttttaggtacaaaatggaaagaagatgggaaagtgtggtccggaattacctgggcccggtatccctccttggccatcacaattgctgcaaccgttatagggaagagaagtgtagaaaccagaaacccctattgaaagaagcatcaattcatataattaattttgccattataaaaatcatttgtaaaatttgcattattaacattatcaagtcactagttggtaagacatcagacatgacgagagtgaagggcagcttagggagaactgggctttaaaccctcagtagatcggagttaggatcaaaggcgcttgctttatgtggctgtgctagactttgaagtcatgactgcacctacagcactcatttcatcaagttcactggtgtcttaatagcagatcaataagtttcaaagtcggagagttaatttgatactagtgctgatgcggtcgtgctggggaagccgagagagaggcagagaaagctgcctattaacaactccggttcagagcgcacaaagatgcagattaaggatatatccatggccctgaaaagacaggctctggccaggaatggggaagctctggattgataaagcaaaggctctttactttagacatctcaggttatttggaagtcagtctatgcttgaaaaatctttagtcggatacacataagtatgtgtgtttacacatgtctgagttttggtctagataaacaggtgatgggggaaacgtctgcacatgcctttctaaaataaaggaacatatctgcataaggactattgtaggttatgggatgatgtgggggaaaaggtaggaaaactgtgatttttgaagggagcattgaatgtgtgctttcatcatagggattacgttgattttttttaaagtggcattgggaatatatccttaagtgaatcatatctaggcaataataatttgacacaagtccattttgatccattttttaaaaaaggagtgctagaggagaagtcttagccccaaattcctttccttctttgtagcgtaccttgacgtgcgtgtgaacaaatgggattctttattgctttcttgtattcttatctcatcctcttaaccgattttgtctcaagtcttcccacttagaaagtgatatatttttaggacctattccaaaaacttgttggatataaagagcactgaaagagagaagaagaaaagttggggcaagataggatgtttgtatgtatgtttgagatttttctttgttttcagcgattttactggggtccttctgacgggataggcataaacattatggggtgtgtggcagagatgacatcagtggctatggcaggaggggatttggaaaggctctttttttgggcaaaaggggagggtgtaaagatacagagttcaaagatgcaaatcacgagaaagtagaaaccttaaaaaaaatttttttatgagaactttgccatctgtatatacagcacaggcttcccagcatcgaaggtcagattcacacccttttcgaacaaaactctaatttagaatgttcatctaagggttgataatggtattagaaggccagtagggtggtcagtgggtgttgtagattagctcagtggccattacagctttacctagacccccacgattcattgggtagattaaccatcacatctgtcattttatcccttttaccacatttaaaatacgaaaaggggggtggaaatatcatctcgaagacaacttatatggagcaagccaatgaagcctgctattcctaaaacatctaagaaatcgccgtatatatctatgtatgcatatatgtataatatagttataagtgatataactctgcaggacatagatatagatgttgagatgatttgggtgaattcaaatatgttggttatgccaggtaagctgcaaatttttaagcttaattccttttaattagtcttctgcctatgttgtagagaaagttctgtgttttaatgatctcgtaaaacgttttctgctactgggctgattgcgcagttcgttaagcttctgttagtttaatttctgataaaacttccatttcaactttgcggcaccctaaatgagaccatcttggctccgaaggagtctagcgggcactctttccgaatggcgatttgggatctgctgcatgtatcagaggctttcgttgagttgtgttgtttcctgtgtgtttatgacagaaagatgtcatcgttaaaggaaacttaagagtttctgtaaatgtaatggttcatcctgaataaagtgagagagacagtgcttggaatctggggaataagggtggaaagagctgagctgatgaaggtgtttcttgtcaaatttgtataggaattatttactgtgctgtctttcctgagccgctacagtaaaagtgaagacatggaaaattatcccagatgggacgaatcgctcgttctctgttctttttttaaaaagaaaagatttcagaaaaaaaaaaaagtcgtctttttctttagaacagtatgaataaaatctggacagctgtcgaaaaagatatgccgtctgcatttttttttaatttctagccaccaccataactaaatagcttgaatagtacctcttttcttttttttccccttcatacataatgatctctacttcattaaaagcgtattaatctggttcccagtctcttgggagacaccttaagatgatgatattgtgggttttttccccccgaattgtttaaaaaaaaattctagcagatttggtccctgtcagtcagaaataattgtgttcttaatcttgtccctgatggatgactcggagttcagcaacgggccggctccaatgacaaatacaatattaatattcattaactgctttgacaatgctaattttgatgcagtagtaaagggccttccaaagttaccggccaaagcatcagagctgcgcaaggtggcaagataatttgtgctggtttgctgagctgaaggcttttaaagtctatagcaaaaagctaggtaccacaaacaaaaaagagaaagggaaaaaagttctgaagcattggaaggcagggctgcggaaataatacgatcacagtccgctaaaaaatttgacacctctgatgcagtttctttgagtgaaatttctacaaagttgcaacaaaaaagcatagcatggtaagtcagcacattcttgattttgtttaatctttttgatcttttcaattatcgctatttgaagatcaatagtcattttttcctactatgcttagaagacgcgcagcggtggtttaatatgtgttaggaccatttgctttaaaggaacacatccacaagtttcggtaggtttttttttttttttaagttagtcatgaaaaatgttatacagtaaattgttctgaattcttttacatatgggtgtttttaatgatctatattggtttttgtatccccccacctccaaaaaaaagaattcagcaagataattaagctctggatgttgccaagaattttgagagtactttcagttggcagaaaactttggagtgaagtggtccctccaagtttatctaaattcagcgagtttcctcccctgccttctctgaatggcatcagatagctattaaagcgtaatttcactggagaactgcaaagcattactttcaccaacttaggtgaagttctttggactattgaaattgcctttatgtttgctaagtcggcaaacaaaatatcaggctttgttcttttgattgaatgccggggtttgggggaaaaaaagaagagtaagaaagccctgccttttttttttaaacgccccctcccttttgtgggggggtgggttgttgtggaatcgggggagatcccagttattgtgctcttccctatcaagcgagataattctgtgaatggaactgtgcgtgagcatcttgtctggcggcgctgctggtgtgtgctgctcccctgtgccgcgggtgcgcggcggcggcgcgggctgcagggcgggtgctgccctccagtggagcccgcggccggcgcgggccctgggcagcatctgggcgcaggcagcatgcccgcgagccggcagcgggaaggacagcgccgcaaccctctctagatggtaagcgcggccggcggcgggcgggcgggcaggggtgcgcggtggccggcccgctgcatcccgcgcgcctgccctgctgcgtccacggctgtccagtccgcatgcatgctctcagcctttgccatgttcgctgtcactttgcggtaactttcaggttgatgtaccttgactggtaagctgccggggtggatgcagtagatttattttttttagcctctctttaaaacaaaacaaaacaaaacaaaaaaaacgaaaaagagaaattgactatacctccccccaccccgaatttcagcttgtgactataaaaacatgcttttttattattattaacttggacgtgaatacggaggggtttcgggttttttttttttttctgtccaccaagttaaagacaccaatgctccaccctcctcgctcccctcctccccatccccaaatattttcgtaaagaatcagcattttgctacttttcgtccatccattcctccaagacccatttccccttcctcccttcttgaacctctttatttaaaacaaaacaaaagtttgctgatgctgcagatgcggaccgtggaatgtaaatgagcagttcctcccacctccttacttcattcctcctgcacatgattgtaatttcatgctgaaaggaaaggaagctttcgtttttgttttgttgttgttgttttgttttgttttggggaagtgtttttttgttgttgctgtctttttttttaaaccctacagaactttgcagcacttgatcaccttttgatttttttgtgggaatgttctaagcgtggtgtacttctgacaaactgggggcaccctggggatgaatttagagtagtgcgatgggatggcaaatatccggaaagagtttctgaggagcagtttttagtttgaagaaattcaagaaatttccctttactttttaaggaagagggggtctgtctagcatgagttagcttatgttgctgcgtcctttttttttttttttttttttccatttttcggtcttttgagaaagctagaaaataaattcttagtcaaagttgcccatcctgtttgccgcactttataagttattgttgctgaatgattgggagctgtccatcagcggcagagaacttgcagtttacttaagaaattgcgtgtgtgacaaaagcagctgccaggagtgtggtggtccgcgtgaatagagggagagaaggcaattagggggctgtgtggttggggctttttacttgtcaaagtggaggctcattgcttttgttaccaccatgtaaagggaatggcagggttttgttttggtattaagggccttaaagattgctgcctgacacttacacaggaaggccagataagtccagaaagagaggccacggagcagtattttaaaaaagaagaaaagaagaaatgaagaattcccacttttttgttatttttaagcctgcccagcccttgtttttgttgatttttttggtggggagcggcgagggtgattaacttgtcccgtgtcttaacagattgtttaaagacctacatcgtgaaaacagtcttgtgggcttggagataaacagatgggcaatcagttcagtaaattaaaaacatctctaccttaggtgtcctgccgccagaagaaaccaaatctttgccactggtcttgcttcaagccacacaagtccaggatcccatgtggcagcaggggtgttttcttacctgcatgcaaatcggagttgtgtgtttgcttttgaagagggtgaaatggcttaacacttggggtgggaaaagaccggaaaagcgttctggatgagttttgtcccctgcaactttttctgtctgtaatccctccatgagcagccaccctcccacactcccctccttcatgtaaaagaggacgatttctggcctgtgatgtctgagtgtctcaactcaagttaagttaaaaccacacaaatgtacccggccctggatcccataagagccccaggaaaagtaagtcgggtttgtggaattcagctctagcctttgcatccctctgccgtttcccttccttctctctctctctctttctttctctctctgtgttcctggggaaagctcacaaaactcaacagtcaaaaaagcgagttagcattctgactattggaatactagcgagcccaggaagcttcgtttcttctgcttccagggaggtcagttgaaaatctttcaggcacattctgttactctggaaggaagagagggtgtatacagggcaggcaaggccctgcaaagtgtcacttccgtgtcactgtgacaagaaaatatcctttcctcctccctcccctctcccatcgcagccctctccctaagaaatttgttttgagggatttgacaatcttgcagataaagtgcctgcctcctgcactcggttgatcattttccctcatggctgaccgtaatttctttgctactcttagcggcagctctgtccctgctgcccaaggtaacgggtgagggaggggactttgctgaggtgccctgagctggctggggaacatggaccttcccccttccttcacggattctgtagtggcaaagattagaaagtagaaggagtttttaaaattttttttaaaaaattaaatctgcaaccagctgaactctagattattagtggacttttttgttttttatttttaagatttttttagggatgtgtgtacagggggaaggattaacaagataattctaggcaatatgagcgacaactttgagcattttgagcctactcggccaggaatctggagccatttcgatctttttagatgctttttttcagttctttaagtgaaaggtttaaagggaggggaagctgggaggaaaaagaaaagtgagaaaagcagaaagggaggaggaagaaaaactggcccagtcccatctcgaaggtacagagaaagtttttttagaggtggagagagggaaaaccaaggctgttatgtaccctagggacacaattttagtgggaatggaagatttgagtggtaagggaggcgcagtggcctccggggtctctctgttccagcagttgggcggttggcacctcaatttgaattgctgggtgagtagtggggtgtgtggtgtgtgtatggggggatgtgtgtatgttcgtgtccatgcttatggtattgaccattaaacctatgctttttcccccccttaatttagatcatgggaaggaaaaaacaaaacaagaataaatggtcaactcaagctatgccctttctttgagtccttttcacagcagttttttggggagggggagaaagggttaaaaaaagatggggaggagagaagtctcactttcatcacagtccttacacttctatggtaaggcagaccctgttcccaaagtacgggtgagctggaatctgggaaggggtggtacggtttggaatttcttctaacaaataattgttttcttcacccaccagggtgggctccatcagaaaagagagaaggaaaaatgacattgcctcatagaggagcatactttaaaagcttgaaagttttgagtgataaggctttaacagtagcagggctgtgtaaactgtgtattttggtttcatatttaatgctaactttctgttgctccgtctttagttgtcaatctccagatttagatgctggctttttagggctatggtcttgcttgtggtgtgttttgtaaacttaatataaaatgtgttttggaaacccgagcaagagcctgatgacagctcattgtgctgttaatgattagggagaaggcccttttgcaatatgaatttgggatttaggatccattatactctcttcaactgtgtggtgatatctttttaaaaaattattattattattattattattatttttgagacggagtttcgctcttattacccaggctggagtgcagtggcgagatctcggctcactgcaacctccacctcccgggttcaagcaattcccctgcctcagcttcctgagtagctggtattacaggcacccgccaccatgcccagataatttttgtatttttagtagagacggggtttcatcacgttggccaggctagtcttgaactcctgacctcaggtgatccgcccgtctcggtctcccaaagtgctgggattacaggcgtgagccaccgtgcccggccggagtgattatcttttgccacaagctgtaagaggattctcttgaatttggaggcaattccttaattacttttattatttgtgatgttattgtatgaccaaacagaaataatctgcagtggtcgataagctcttccatccaattttggggtgagaaggaatgaaatataccatagacttatgttcatattttcaacatcatgaattaaattctgtgtgtcaaattaaaacacaagatcatagatagttctctcgttgagcgtaaaataatgatgggtgtaaatcttggttttcctttctagctgtgtgcaactctttggttcaatctaggattgtgtaaactgtcaggaatggtggtgaagagagtggaggctgtgttgcaaatgtgtatgttgtgttactgcaaatatcacacccagtacagtctcccatgttgaggttctagaccctagtttactcaaattacctgcgttacttaatagtggtcctgttggctttgatgagagtaaaccactattcttgatgtcttaggagaagggagttcctttgaaaacgtaaattcccgactccagtgatacaggtattatgatctctgtattgtcacaacaggctgctgcatcggcattttctggaagcagcagagcctgaaaccttgtattcttagggaaacctcccctttgtggtttggggttgttggggacctggctgagctgtgtaatagaattctttccttctgcaatattttggaatgtgatgaaatcctgacatgccctccagattacgtagttctgcacacatttgaggatttttgaaaaaattcaactttgcctgggtcactccctcgttaccttaaacttgcaacacatcagctggagatcagagggagcagcaattgtgtttgccctccttgtcccatggtgactctgtgtcattttcacgcgtgttatttattctggctgtagatgcccattaaaggatgcccatgtttgggatactaacaaggcaggatagaacggaacaatgcagttctgcctttgtgttcgtcttcctttctgtcggtctttgctgaatcacagggtttgagcatttgtgtttgttgagccacatgagtggaaacatttattcttcctcttggcttacctcctctttttctagggagaagatttacctgatcagtgaaggaaacagctgtttcttgagcttttctcagactccatggagtaggcatgattttcaaatgcaggctgagattcgaaagttaggcacagggtatacaagaaaaacaaaagacctttttatgcagctgttccttgtaaataaattagaaagttggtgtcagattttgttcactacttctttctttaattccccaggatgtaataaccattatgctcttaaaatttactctaaatcaaaattggtgatttcctttccattatatttaggaatccctagatttggggttgttgtatttggtggcgagggggtggtctggaaatcattattatttgttaaaagttgttttgaatttgagcttttggatttcttcatttgggataggttcgatttatttctggctcgattttgaagatctgctctcctagaaacagctgtactctcttacccaattcccaaacattctctgtgaactcgggcacttaacaagattgattatgttaacgctaatcatttaatacccaagtagtagagaaatatttggcaggagggtggaggttgcaaattcctgggaaattacttaggggtgaagtggctggttcttcatccctgagacctggcagaggattaggacagagggccccgttgtgcctgtcgcactccctcactgacctccaggttgagaattttgtgacgctgccggagggaggcagaggcaggcaggaagaaaaccctggaaactcgctgatcaggggcgagcctggaccgggtgggctaagatgtaagcttgcaagtgttttaaaggttggctgggggaggcacaatgggatgttttctttttaattgcaaaataaatgagaatgaggggaaataaattatgtttaatgaacttaactggaagtaattgttcaagagcctgtgaatgcacagctttactgggtcggcccttggctgcggttttcacaaagccaagcagctggtgcacatctttattttccaggttcgaatgttcctttattcctccatctcaacaccttctttattttccaggtacgaatgttcctctattcctccatcttaacaccttctttattttccaggttcgaatgttcctctattcctccatcccaacacctccagcccacccaccacctctcaccccccagcccttccatcctccttttgaggatagagaaaaggtctttaagaagagctgagcttggtcctctagacccttcatgtttggcagtctgtttggtgtgttaccagctgggtggttatagtatagaaagggccaccccaagaaaggccaaggacttgaagtgatcgagttagttctaggtatttgcatgtgtgtgagagaatttggatgaaaactgactgcacgtttctcctctccctgcttgctctgttcagtcatttcccagcaagaagaattttaatgcctgtgtgaatccatgagaaactatgagtcggcaaaatttcacagacggcagggagaatcatctctcttcctcttcttgctgtctaaatggatttgattccagagagggagagggagagaaataaaagccagctattgataatttacaatacaaataagcagcacccttcctaggaggctctcagggattggagacgctctaactctgcagcctgcgggggtaggttctgcagcagcccggccagaggatgcaggctgtgtactgcggctggcagggtgggctttgcttttctgcatctcacaggcagatctcttttctcttaccaccttgtttctccaagtaaaactcgaaccctgtgaaaccttctgtcttttatttattatttccaacaggcagtgctgtagctatcgatagaagtcttgtccagggaaacaatccaccattagctgggagcaaggccttagacagaaaggagcaacattcaactaaggaagaccccggccacggtgatgcatgggtcctggctagctgcgaggggagaggggcacgggccagggtaaaatgctctgaggaagcccacccatttggggccacgggaggaagtcatgactgctgtttttattctgtgtatatataagaggtttgcaggatgcaaaagcaagtgttggcctgctgggttgggatgggactgtccatgcaggcctaggcctaggttgcactggctgtgtctcctgtggccatcccaccagcagaaatagttgctaactgctggggtcataggctgttggggacaggggggttaccttaactgactgttcaccaccctcacaggctggaaaaacaggactagttgagttgccaaagggtagttgatggataagaaacagcccttccttcattgtgttcccagcctgtcctcttccccaacttaccacatcttcagtgatgtgaaacttttattaacgttttagcggttgccattggtcttgctgcagccatagtaaacggcatctggaaaaatgcatagaggtggactataaaccaatttttaaatgtaaacctggagtgaatggtgtcccttcctgatgctgatttcagcccctgggagggctggtaagtgaagacccccaaagaccttccatgcccaccctgaggaggggaaaaggctgacaaatgctcctctgttgctttagttttattgtgcagagctcctaaaggcactttctggccccattttgcttctgcagaaagaggcagcaataggggcgtattgaagaggagggccaagggagacaccagggccagcaatggctctatttgttttcagtgtctgttgattaataggttgcggaggtgaatggcaagctttcattccctctaggttgcccacagttatagagccttgtggggtcggggtgagagggggactaagcagagggatcttagaagtgccttaatcagtctttcacttgccaagttccaaatgaggaacagcgtctggatgggtgtgtgggcgcttggcgatgagggtggcatggccaagttgcagagcgctatgcttaagggttcttgaaaggtcaaaggtcagccacaggggcgcctccccctccccattcccccccactgtagtcgatgaatacgatgaatactttgggtggaagggctttgtgtgccttgagggctgttaaaggaccttttctttatgatttaactattcaatgctcaaaacccatggagcctaaggaaccagacagaggaaagcttggctttgccaaagagcgttttctccaggtagaaagcataaagccctgaatgatttaaagtcagatgaggattttggttccttttaaatagatattgtttacttcatttaatggttcggctttttagtagactttttctttagtttcttgtcagcccagaactgacgacataaagtgtttttatcatctgaatcctgctgggccgagatactgcatgtttgtatttgagaagcagaaacatcctattaaatgtctttaccccttccatccccagtcttcccataatcagccaaatgtgtaaaaatccctgctaaaaatattcaatgccctgtggcattgtggctaaggcagggaacactgagctccacctaatttggggtttaggggcaatatttgctgaaaatggtctaggatgcagtgattggtaggtgggagtttgaggacagatcccaccgagagtcctgaagcagctgtatccaataggaaggttggcccaggctgatctcattgggtgcatctccctagatgaacacagcaattaaccccatcccagtaatgccagtttctgcagactgggagagtgtagaagtggggtggtggaggcaggcaggtgaggctgcaaagcttagaaacaccactctctcaaggcatgtaacctggaaaaaaaatatctttacctaccgcgtggaactgataacaaatgccgactacttcataggctcgttgtgaggatttcctagaataaagcatgtgatgcactcagcacagaggcacacagacacagagcccaaggcaccattaaacggcggccaccctgagctgtgctggtgtggatggtagtgcttcaggggtagcagctggtcagtccccatcctaccttcatttcgtctagaaaaggtgttctaagctgatggtggtggtgtgacttcggcagctgtggtataaccgtctcgaaattatgtgagttattcatatatgagtgtttgctgtttttgtggctcggagaatccgttgtcatcatgttttcagagttcagtacagcaacgcaggctcttcacacagctctccttgaccatcactaccatgaacttgaacattggttcgctgtcactggctgtaatgattttgtatccccatgtagttttgaagatgtatttaggtgaaatagttcccgaaaggaacctggccttacgttgagctgtttcccttgcacattgggctctgtttataaagagataaaagggggagggaataagtactgcaggctaatgagcccaccagcactccaactaccccatggatagttgctgctaatttagttgccatgaatacatttctggaaggttgtctatgttgcaaccaagttacttttcatatctaaattttcttagggtggtgcagttttgaacacaattcttaaagacctcgttagagaagtgggaggtgttcaaagagaaggagaaccatccaaggggcatctttctgtttggattcttttgtgtttcatttatgacagctcttacttaaaggcccttgccctgatctggaagggaccatgatcatctccacctgcctttttttttttctttaactttcagctcctctgtggcaatctcatttattggcatagtaaagtgatgacttttctcacaagagatattaaaatatatggattaattaaataccgcattttgaagaagggtatgtgcctgaggagagtgccactaatcatctagaatgatcttgccccataaacaaacatccttacctttgaaatcaggagtggaatcatggctgtgtatcccccctgctccgtgaattaaatcagaagaggctagagggatagtgaactgtgtcatcattagtatttatcagattgcattttcaaagcatctttgtattgcacgtttagcttgtgcctgtcactgtgctaaatactttacgtgcaagttctcattcagttttcacaactctgcgaggtagacacgattctcatccagagttgacagagacagaaaggaagtcttgagggaggtcgaacagccaacctggtgaggaagaatgaaaactcgggtcttccttgaattcagttcttgaatcactgtgtgcaatgccagttgcccctaaaacccttttaaaggcacagttgtaattgagatagtgtctgcaagggtattgaactggatggtccagaaggaccactaagctctgttctgtgattctaaggagactacatttaaagagcgccaacatttacttgaagttaatctgtgattggctttgtctttccctttgaatgcttgcagttgcaatttggtggttcttctgcagtttaggagaatgtgctctccattccgcagactgggcacttgggaggacataaagttctagaagacatagtccttgtccctaagggacttaggtatagtgggaccaagaagggtgcacacacacccccagcaatgggcatcgtgtgatgtaggaagaaagggttctggggtctgaggccggagagacataggcatttgtaagaagaaaatccctccatcatagaggattccaggtagaggcaggttggctggagtggcaattagtccctggttttggcaggtatgaccacagagttctcctctcttgcaagggaacccatgagcttggacagagaggaagttctgttctttcacagggacctgcctggcatgcagttgaggtcagagggagtaaggctagtcctagtacaggtcccattttttccccctaaagccaggcagtacctaaaacttccagttccctgccaccccctccaccccacccccacccccatggtatagttttgactgaacaggaaaaaactagttggctaggctcaggtgtgcaaaataatactgggagaggtgttagtagccagaacacagggctccaccttttgttggaatcgccttcatatgtatatctaagaagatggagacttaatttttaaatctcacactcagttaactccattattgcccaaacgctatcttcctcttttgttgtaaagtagagaaagagggttttccccacatctccccttagtcctgcttagaagatggctgtgggatttgtgcttctttactgtagacagatcatgtcatctggacagcttcttcctaacaataaaaataatattaataataaaccactgtaatagataataaataacaaacttatcatgtgctaggttctgtgctaagccttttcctgggttccttaagaactaggatttgattcatgatcagaacccatggctctttgcctctgtgcttgcctgtgtgcgtgtggtcctcatggcggaacacaagaaccacccacaacacccagcaagcaggcccaggatgcttgggtcctgagcccagacccactgtgaatgaattagggcctactgagagatttcctaggattggggaatctgaatgagtgaaaagcatcccgggagatgcttgactaggggctgactgctgctggttctgatgcccaccactagccctttctcttcccatgtgatccttctcctggctgatggtggtcctgctcccgtggcacttgatcagtccttccaccccttagtaatcatcttcccttctctgggctatgggtggttctccccactggccctggtgtttttccacactcactttaaactgtctggagctggtctgctttctttcatgtcagcgggtatgtatctttccaaccaaagagaaaacttctggaaggcagcaacagtcatttgccctgcctcctaacagtctccactttgtccgtgtctgtctctttccctcccttcctctccttttcccttttccttctccacctcagcacacagtgggagcttccttgttccttatttctcaagttgtcctgagcaaatcttcctcttaaggaatccttagtgcctgtccttgaggtgcccagcactggctgtgggcagcagcccttcaccctggccatggcctgccccgcccttcatggctgccccttttatggaagtgttgctggtttccaaagctccatctgctttggtggcttttagcttacttgctttgatgcaaaattggtagcacataacacaaagctcctgtaagcaacctgctagcccctttctccaagagtccagttatacataggaattggtaaaccaggctgttggaaacgttgacttctttttctgtagtttttttctggggcatctagagagaatgccttatttttctttccacacataaccacaaaaaagttaaaagcactttttaaaagacactttcccctcaattacctgtggtaagaaatgctgttcttatattacattccttcctcacccatttaaaaaaaaaaaaaaaaaaaggacaagaagagaaatagtaaagagaactaactgcttagtgatccctcagctcaacaggcactagtgggcagcactaggaccttccttcttttcttttaatgcaattccttttccttgatgttaatgcaagttgtgccttcctaaaagtaataaaaggaaatgaagacacgttctgaaatgaaacttgactctaatccattcatcatctaatacttgcctctttatcttcgctggtacctaatctggttaaatgtccctgttgtaggattttagcgaaaatcctctatggggaatagggttttttgcaattggattactctcagtaaatggcccagtagttcgcttgtttcagcttaattttttctttgtgatcttgctgggctaagttatagcacagagtagtggagtggggaggggtggactgagcgggaggtgggggaaagaggaggagaataatttgggaaagcctgggcatggcaactagaaacatttttaaaatgcttttcttccccccaccctgccctctgcttctctccactgacccacccttcccaaacacaaaaatgcctgtactttgttttttagaactgcccatttctaaaatgcataccttttattagcccaattcgtcatcatccagttaatgtattagcgttcccggatgactttctaatgaaattcctaatgaatcagggctgctgtaatctgcataaaatatgcaggtgcttgtcaggcagtttagagctttctggtaaagttcacactcccacccaaaccgtgagtggggttttgcatccatgctgtctgtgaaggattgtagcatgcccgctgtttctaagggcagggaggggataggagctgtcggggggtggctaaggaggctggctgggtgggatttgggccctgccagtttcttgtaagtggtggttttcctagatggtcccctgtgcagcctgcgtgcctcctggaggtggggccttggggtaggaggtccccacaacatgtggaaacgcagtaggcatgggagattgaagtctccacttctgactcacctgctaatgggaaaagtgcagactcttgggctccataatggggtaggggttgagaaggtattttaaaagccaggcttagtggggaaataaaaactaaagcagacccacccagagagctgtcttacaactatctattattttcacatggactggggggagtatgggatgggcagagttgagtgcatcttagaaaatccaggtgagaggctgtggccaagggaacccacgggcccggtgctctgaagccctgggctgctggaaccggcttgacggtgtctttctctgttctcctccccacagtctaacaaagtgccagtggtgcagcaccctcaccatgtccaccccctcacgcctcttatcacgtacagcaatgaacacttcacgccgggaaacccacctccacacttaccagccgacgtagaccccaaaacaggtaggctgtgggctacggagccaaggtagagtgctggtcctggggttctgggggaacctttgaggcctccacaggaaccccaggggtggagcagtaggggactttgggggaacggtggtgggggggcccctgttgcttttctgggtgttgaaaaggaagctctttggggtggttgaggcctggtgtggcagtggttttccactccctttggagaagttcatttgcagtgttaaagatctctttatggcttccagtacccctgaaggggctgtcttgggaacctggctatgagtcctcagtatgtttcaggagtggcttttaactctaagagcctcaggcagacatggatgcaggaatcatattgaaggcatttcttgggttcctcctcagcttcctgggaagatgagacagcatggctttccaagcctcggctccctcactggctaagaggctccagtcactacttgacaatgacttgttggtatagcctcaaaaagccacatcactggattctgcattttctttgctaatttatttaggttctttttcccctacaatattctaggtattgttgaacccattttacagatatgaatactgaagtccaggcaggttgcttcatttcttcgtagaacaaccaatgggtgtctgagaaaagttgccatgcttttcaacgtctttttgttgttgttgttgttgttgtttttaaacagagtcttgctctgtcatccaggctggagtgccgtggcacaattttggctccctgcaacctctgcctcccagttttaaacaattctcctgcctgagcctcccaagtagctgggactacaggcatgtgccaccatacccggctaatttttgtatttttaggagagacaggttttcaccatgctggccaggctggtctcgaactcctgaccacctcggcctcccaaagtgctgggattacaggcatgagccaccacacccagcccagcatcccctttttatcccagttgttcattgactgcttttttcccaaaggggagagggagggaaggtggggttacttgtagctctcctccaacaagatctaaatcaggcaggcagccccagcagcctggtggggtggtcttgggagaacaggtaaggttagtgtgtgtctttcaggctacccagtgtgttggtaggatttccccttcctagctcagtaattggaaggatgggtttaaagtggtgattgcacatcactttgttagaggggattggtagtgttggggtaggtaggctgcctggttaggcggccttcactgcccctgaacgaagccacacatgagctgggttttactggtctctgagcccctttgtgctggtgcaggactgagcctggcgcttggatgcctggtggcctcctccagccggccccaggctccaccagtgaatggcagcgtcaacgtctcatttaaataatggtagtacagggaatagcttttaaatggttatcgtaaaacatatgattaacgtctgtggactgtttacttttcctctgcgaacattctttcaagtgtgcaaatggctcgatgtagggtccaagcccagctaatctgtttggtttttgtaatagagagaaagcaatgtctgcatgaaaatgtcacccagggagacttaatttacagattaaaagcttcctgaatgaattttttaaaaaatgaagtcgttttcgtccacgaacatgcagcccgttccctccattactctgttttaattctgtggtattgtgccttttgcctcccacttcaatggcatacatcaattcctctctgtcagagtggactacaggatgtgctcctgtggaactggcagatgtgcggtggcacgtacttgcagaatccgctcatgtgtgccttgtgaagctcttagcccctgcgacgcacgcggtgcccattcagcaggtgggcttaatccccacagacgactctgtcctctagcggatgaagttccagaatggagtacacaagcctccaacacctccttgtctgttcagctctgactctgccttagataagatgccagatggcatttgatcagtttctccagctcatccaaatagaggcagagacattttagaggagtcaccatttttgaaaaaaggcaagggtagtaacttttcaaatgccacagctcaaaaagtgtgttagaaatcagaggagtagctcttgtgcaggtaaggcatgaaactccgcagggtgaagggccagagttgtaagagcaacagggattaccattgcttcattctccaccaggtgctgagcctttttgatgttgtttcttttaaacttgaaacaatcacaccagtcacatgaggcacaaatacccaagatggcatatcttgagtctactcagtataccagtccatttagaaggagataaactaatttttcaaactgaggctgagggaaaatgagatgaaacctaccaacaactcaggatttataatcatgaatgaaccttgtgctaggattccagaagagatgcgtctcttcctcctttccctgttcccatcccctaatggattgctctttccttctctccctcctttgtacctaaaatgctgcttcttccctcaggaatcccacggcctccgcaccctccagatatatccccgtattacccactatcgcctggcaccgtaggacaaatcccccatccgctaggatggttagtaccacagtaaggagttccattttttaatttcctttttgtttcttacatgggcatgtttattatttattctgtgtgtgtgtctgtgtgtgtgtgtgtgtgtgtgtgtgtgtgtgtatgtgtgtgtgttagaagccagggttggggagggggctgcgggagggcacagaaaaggtgttgctgaggtgtcctgtgggaatacaggcaaatccacagccattcaggtggcttatgttactggcacttagcattccgcgaccatggtccccagaggctctgtggacagaggtgccctgcagttcctttgggaattgcagaagactactggaacttccacccaatgaagctggtcatgacccttctgctgttggctgcccaaactgcagtcatgtcattgggttgaggctgtcgagtcctccattttaggtgttacatattttggggcacagaagcaggaacaagaacggccttgttttgaaatccagggttgggattagggcatgttcttgtatgattccaggaccccccacctcatcctgaacattactcccaaggttgacaacaacagtggaaagttttgtctgttgagaagctccatgggactgaatcagcatctctctgagagtctttgcacgttgaatgttttacctaactgtgaacggtgggaatggggcatttggaaccgtcactgcagcatgtggggccttcgtaagcatcaatcctagctcctggcagtgcccagattatttgactaacttttgcaacttaaaaaaactgtgttttaaattcagagtagaaaggcctttgatgcattagcatactgtggcaggttgtgtgtatgtatatttttgcatgagcatgtgtgtaatatgtgtttcgtgattgtttctgtggatgtatttctccttaccagtgatctgtactctgaacaacacaggacaatacattgaatgctaaaaggaataaatcctggtaaaactcaggtttgagtcttagggaagatggcctttcaaagccttaaggaagataaaattttggagtggcttaccccacaattctacccgtatttctctagttagatagattctatgctgtttttttttttttaataaaaaacagattgcattatgtagtagctgtaccaaataccaaccctgggtatagtttctgtttctctgtctcttcttatttttattgggacggtagacatgaacatgagcttgtgacccatttcttctaaatagatggggccaaccctcgaatagttctcagtgatcatttgccccattcggctgatggggagatatttgaaggctagataaaaaggaatagccaactcagacaaccctctgtcagaaaaagttgtgtgtctttcatgaggatgctattttgcatgttgctgtattttttaattattgtaatgaggtgtgattgtctattggttacccacaattcttcttggggactctccccccggtaactcttgtcaacacttgttaatttgacaaaaggctacaaattaagctctgttaatttaatgttttctcaccgagatctaaataccgaaagaggcccaaagcgcaactgaagtcctttgattcactgtactttattttggtataaatttacattcattattgttttcctttggatgtgtagccctcaattagtgtgatggctccattaaagcaagcgagacttcgcctttaattattacaacaaaacacctagtttcagcttggggagagggtctctattgacataagcagaggttataaaatttaattagccattcctatcagatttatggcattcaaattgttctgtgtttcttccctttgatccttcctgtacaatccccaagatttttgttctgatcaaatgagaataaagcttactgtgcagagagaacttttcccttttcttctttttcttgtccccacccccacccttgtttcaagtctcttactttgtaccccttctttgtaggcaaggtcaaccagtgtacccaatcacgacaggaggattcagacacccctaccccacagctctgaccgtcaatgcttccatgtccaggtgagttccaagaaccggggccttcatccaaggccatgtgtgacttctcaagaagttctctagatggccaccaagccacccagggaccacagctacatgtagttctattagtgtaaagccaatgtggcattaggctgtactcccagaaaatcctgaaaaattgccctgaaattccaaggtaaatgatgtctttctgggtaaaatttttgagtcactcagttgaacaatgtattttaatgaattaagaaggtaagggagaaacaggacagaagcttttaaaaatgccatttctctgttgtcctgtcctcagcaagaaaggtagcggtgaaggtagttttattattataccaagaagagttcgaaaaaagattactggtgttctcaaagctcagactctgattgcaagtcaacaagaaagcatccgcctcctcccctcgaaggtagcactgtccaatagaaatatagtgtgagccacagagggaattttaaatttcgtagtagccgtgtttttaaaaaagtttttgtttttttttttttaaaaaaaagataaagttatttttaatgacatgtttttattcaatgcaatatagccaaaatattatcattttaacatgctattcctggacaacaactattaataagatgttatgttcttttttgtgctgagctttggtacaaaatctgatgtgtatcttatacgcacagcacttctcagtttagactggccacatttcaaatattcaatagccacacgtggctggtgcatatcatagtggtctgtgcagctctaagtctttgaaagttaaaaaaaaacatgtgtgtgtgtgctgtacattcatatatatttatatttcagcgtagaaacatatttacaagatacattcctatccccatgttcttcttttcctccctctgattaattctggctaatttttcagtgactgctagtttatttacaaactggttggcagcagtatgttttagtcgctaattgtttctaatgatagttttattttctgttcatctgattttcagtcaagttaattaaatcggtggaggtttagactttgctgatggtctgaaatcaccaacccattctgatgatggcacataatgaaattagcatgcgttacatggcaggggtgctgtccccagcttctttccccagtccctgtggccaacatgggaagccaagaccggagaagggcctggaaagacaggtcaagatgctgcttttcctacttacaaaacagtaactttagcagtgatagagagttacattcattaagaaaaacaaaccgtggcatatctagcatcggtaactatgccgtggatatcatagttgaagagatccattttctacctgcgatatatcatcaaaatttcaaaatccatgccagtattagttaggtaggaaaacgctcgtgtgttctctggcctagagagaagaggaggcgtaacacttattaaatagtgtcatcacagcctcgcaaagcatgggaatgagtagggggtctcccaggtggagagcacccagggaccacggctacatgtcattctattagtgtagcagcttatactccacagctcatcttcccaccttcccagcatttgtatattacacctggttatttttcatgtttgtttatttggtgcgttctggaggttaacagtggtaaagtaattgtaggatagggattggggttaagctgatcgattgaattatcattaggaggttagtcgatgaattataggtgggcatgggggtggaggaaaggcagggaacgtcaggaagaaaggttagggcctcaaggtgcggggagaggcggccgactccccaggtaggccaaatgaaagatagctagttaaaaagcatatacagcaaattaaatacattattgtgataatggggcgacagaagtataggtctattatacttatggcagttatagcaaatgtaggcagcttgccctgttccagaacaccctttgatattcattctattcagcagtggggccaggacttctcagaattaagtgatgggtcattatactttaaacaccatggagaagcctagattggcaattaaacagctcttgctgacactcacttgtgccaccctgtgaccccctttagattgagatgttggagctccgggccctcagcctgctaaattggtgcaaggctcttctcctgacgagagccggctctgaaatctgccggcttcaaagggagcgagatcatgtataaaccataatgtgggtgcaccgtggctcacaaaaaataaggcaggaagagatgaaatgttacaagtgcaagggggaaaatgagagaataatgacaaacctaatgcaactcaaagcaggattgttgcacaggaaaatgcatcctactgcttgtgcataaaatcaaggccggcagatgacatccggttaacagaaacgtgtcaacagtgaagtaaagtgagagtgagtaagagagaagcccctgagacagccagaaacaaaaattagttgttcttaacaagttaaggttcatcattatattctggcttggagccatgaaagcagacgggggtatataatgagctgcttagaatttttagggtgtttattgcatttcatgaaatagtagtctgcagaaaggaatttcttaagcgaaggtatgtgtatacagcccacatccatgttcacacatggtctctttctttgctgaacatttttcagatatgggaatatacgcgtaggtatgggaacttagaaatgtgccttcttcatggctgcattagaagtttgtctgcaccccaaaatgtactcagattgtggtgccttcccgtggtatttggtgtatgtacacacacgtacacacacacactcacacatgcagtgtttttctctctccccctccctctccctctcacgtctgtacacatattctcattctgcaggaagggaacatatgtatttgaggaatgtcaggccttcaaaattcacagtaaaagctgccacccaccacttcacccaagggcttccaagaacacatgttcttaacttctgtttcctctgaggccttcgagcagtgggaaggaacagggtgtcacttggagcccaagtgtctcccaagggcttttgctttttttgtttttcacattattttgagaggaaggggatgaagatgaaggttgttagcatgtttgtttccttacattttccttctctctctctttttttgatacattcgaaggacttgtattgttgttatttttaaaatcatgtcatgcagtcttcactactggcttaaatttgtaaaggcagtggcaggaaaggccacgtcagcgtgggatttttgagtgaaatgtctactgtggcttgggccttcttcaagaatcagcattaactttccttcctctgttgatctgtgtagattcagttagtactttaatcattttattatttttcaaattaatgtttgttaccttattttggctgaatggaaactatctctagcccgcttctggaaaaaactttgtaaatacatacagaatcattttggaagaattgtcgtgatcgatcctcattaggccctctagttcccaccagaattggctttgtaaagagcagattgttattccttggatggtacattggactgctttggtttggacttattaagaaagcaacagttgccatgatcttcatctgaacagcttcccatctgctcacttgaatcaccttgccaggttggagcaggaggctgccatattgtttacttttgggattctgccctttctgtccctcactattttttctatagtaggatatgttgcttgaagaggggtgagtcttccaacccagtacaaatcatggtgacaccacgcaaaatagaaaatgagaaaggtgtttgatccagttgtcagtctgcagatgggccaagagtaggttgagattagctctttctgtcctggctaatgtacttggttgggaaatgccaattcaggtcctaaaatgtgccttagagaactgtccaaaaaatgagcagcatgagaggagaaaacacaaactgtttctttcatttataattttgataatcatttagaagacttcttaatgatgcctagacaacatatgaagtaaaagtgatataggaatcctaaattttagaggagaaagggcatacaaatcagaatcaaaggtttattgtgtgtgtgtgcacctttcctttcctttttttttttgcatctttccataaagggatagaaacttatttaaaatgtccatgacttatgatatgaaccaaataggaactatttgaattttccctgtcttcctgcctcactctctcccattcctgtcaaatgatgggacacagcacaaaagaaaaataaaaattgtattgcacttcatcaacaggatgaggcctaatgaggcttgcacagcattgtcaaaaatgtatgtatatttcaaccacgttaatattttatttagctgtcaatatacaacaaaagatttcacctttcattttagagctgattaggacttaggaaattgtcttcttagatgccactaataatgcctcaaaaaacaagtggacgtgcgatttctggcaggtagtccaagcccacttttccgcccaagtacgtcagttgaatttgtcttttgctaaagatgttaaaaatcataatgtcttatgtcagtagcaataatgaattggctttaatgacattatgagaatcattatgtttaatttatcgctaattaatgctgacaggtttcatatgccttgggttgctttcatgtgagtgttacgtgctgtttttttttttctttttaattgtgtgtacacatccctcctcattcattcattttgattctgacgatttacacagctttctgtcttctaggttccctccccatatggtcccaccacatcatacgctacacacgacgggcattccgcatccggccatagtcacaccaacagtcaaacaggaatcgtcccagagtgatgtcggctcactccatagttcgtaagtgttgctgtttttctcaccttcttcgtagccgcagtgttctgcaagcctgttgcagctgctgggtggtggctttctgcctaaggttggcctcgtttggtttgactgcagccaatacccagcctgtgtgggctcttcactcccttacaaagagagagagagtgcacagtggcagaatctcactgtaccaccgcgggttagaacagaactgttttttgtgtgtgtacttggatacactgggatttgcaaccacttccctgccccctaaccgcatcattgaacatttagagctttgttctgcaagcaggagaaaaccctgccgaggtgaagacagcaaccatgtgctttcccctctggcttgggaaaattgtatatttgtgaaacttgaggaagtgattgcaaaatccctctcttcccccaacccctccccaagctatttttgttccattttccggggtgcagaagaactaaaagcatgctttttaatccaaaactgctaggcttgggggttatgagacaaggagatacgttccctgccatggaggaagttggaccacgaccttgtttattgggttgcgtctgttttgtctatctccagaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggagggtaggtgacgcccttctcagggagaagcggggggcgggtggtgagggaccagagtgcagcaggtcaggtggcagaatgtctctgtccccatttctttggagaattcttgcccttcagccacattctgaatccttgaatggccttcactgagtcaggactagttattctgcactcagcgttcagaacagccacagccatgctcttcccctacccgagcgagtgagcaaatgacagaatgacatagataacaaatcaagttttgtctaaacattcctgttagtgccaggacccagccgacggtcagtatgtacagattataccatttctggacggactcacccaaaaaggcagcattatttatcccctgaccttggcgtaatgtgtgatgttctttcatgcttttctctttgttcatgtctttctcatctgtaccccacgtcccctccagtggcatgcactgtccagagaagagcaagcgaaatactacgagctggcccggaaggagcgacagcttcatatgcaactgtaccccggctggtccgcgcgggataactatgtaggtggatcattttcgttaggattggagtctgtagagctgtgttgtgcgtctatacggacaaagagaacaggacctgccacttgactagggtgggcctcaggaccatccaatctgcccgctttggggactggtagcatcttcctggatcgctaaactgcagggaggggcttcccgtgtggatggttggatcagctcacagtcattcttcagggtggagagaggaggctgcagtcccagtgttccagctcaggaccaatgaggttgatttggtgcttgtctcctttctagaggaggcaaggctcttaggatacacccaaaggaccttatgttccggattaggttccgcaggctcctcagcagtgatcagtggtgtggccttctagggaagaccagtgggtaggtgtggaggaacagaatttaattcctcccaggcctttcagcaggccctttaccgttaagaaggaaaaacaaaactattcctttgtgccatggtgcagtagaagttagaagcctatttcatcctgagaggagcatgatgggaatatccctgaaagcagccagaggaagtcagcctttggcaggatgcatgaaccgactctggccccagcaagggcagggaaagtgtgctatgcggtgtgtgtgttcctgggctctgtgttggctacaggatctgcctagtcctctcttgggttgtaggaaacaccatgggatgattgtttttactaattgcagtggttgtgaccccacgattcctctcctcccatgagcacgctgtcttccggagacttctgtcacttctcaccattgctggttatcctccattttgcccagtaactccgctttcctctctcgagggatgaaatgcctcttgttttgcctgatactttatttcatgacatttggttccgtgaagggatttcaccatccactcttaggggaacaccaaaacttgtcttaaggccggcacaggcctctcatccccttcctgtcgatgtcttggagccatggatggttacttttccagttacttttgactctcccactggcatcatccgcggtgaagcagcttgacgtataggggtcgaggtcgttaaattattactgaattgagtgaaacatatcatggcctttgaggcttctgtggcaggggctggggacacacagctcttaactgccttggcctggaagtgtcatgggtcacttactcccatcacccattggccagagctagtcatgtgacccaacctaactgcaggagatgctgggaaatgtgcagttactgtgcacaagttattacagggattcagagttaagtcggatatctttactccctcagaacttagcatccgccaggaaatcgcaaacatctgccggcctatgtgatcctgaggaagagctgcttctgcctgctctgatgagtaatttcaggcctccttcctctttcttctcatacttttaaacccgtgcttgccatgtagatgagggaacagggaggtgcccctggccatctttctcgaggccctgcccccttagctggcagcgctagactgtgctcctcctgggagttgaatcaggaaggagtgctggcacctctgggatggcgcgtgtgctctgctgagagcccttgtcgccgacagatgggcttgcacggggtctccactgcttgggacctttctgtttgtccccagcatgtgtgcagtggggaggcctttcttctggagctgaaaggaagaggatgagaaagtgaatgctctcccacaggcttgctgttcacccccacctgaccctgaggtggagatttccagtagcaggcaggctccatagcctccacgtacacaaccatatcatttcaggacagctgctctcctggtttcgggtcagaagttcttagagttcatcttgagcttctacctgctacagacccaattctttgagtaatctagaatgataccacagagcggaattcagcttctctatagagatcatatccccaatagacattttgggtcatagtagggccttcatgtacagctgtgcagggcgtgcactgcacaactctagagtatgtcatttacactggggtctatgtgaatggtgccccctggagttgtgcagggtgaaatctctacaaaggtacaaggcagactgtgatagcttcaaaagaataccgtgtttgacttgcctgggagtcgtttagagaaagtattgctcgaggctttttgtgacatactttctcggtttcagaagggctgttaggcactcgaaatgactttagctcagttttaaatttggaagatggtttggtataataagggaactcctgagacgatttgaggtttagagatctggatttagggctctaggaactttatctcttgtaagaggtacttagattcctattacaatggctcattacacatgggtgtgaacacacacactcacactcacgccttccttttatgtgctagggaacactgggactaagaaccgcagcactgaagcttttatgcatttgaatgtggtagcaacttaactagtatttttttttttttttttaactaacttgacgtgggagtttccatatattactttggtcattgtaaactccaaaagcttcttctggaaaatatttcctgagatcttctcatggctctttcacattcctgcttttccagccaactggtaacggaagcctttatatctttaccttaggacaacagaattgagtgaaacagtcacgtttggattgtcagacttggtaccttctttagagcccaagagaaaacatcttgagtcccatagtaatatgtaacccctgggattatatttgacattatttcctttttaaccctctacactgggtaaaggatagaggtcccatgccatttgctcacctgagtttcttttcttctacccatatcgtaggccctttctttcttctgttacatttaaaggggtagtagcgtggccacttccctggagatgcatcttcctcttcactaagtgtaggttttatccactttctcatgtcttctttttattaaaacacaatccctgtcctccagaagtctctagtctaaatgacaacttcttcagtagtcaacatctccgtgctatatcctaaaggcacagcttctttgtgtgtagaggaattttcagatgccttcacagtatattgcaaggaattggaaacggggatgctttttcacacatggctgagaagcccttgggtatgtggatgctgatactccttgaagttaaaacatttctgtgcccagtttttatgaatacttcaggctcctaaatgaaccgaaactaggcccgcctgcctgttccaggatagccaggtggcactttgcccctcacgtgggagaggcgcgggcatggagatggtccattgcaggcccatgagatgccagcttcatgataaagcacatgaggtccttttaaaagaaattgtacatgaaggaacatagcgcgtttcaacaagatccccgaacagaaggccaaaacaaagctcccaagttgcacaggccccttcccctcacagaaaagataggccatttctacaacagatggccctcagccctgggtggagcctaagcttggtggcatcaccaccttgaggttttcctgacagaacctaacgtgttctcgagtttctttctttctttttttttttttttttgagactgagtcttgttctgtcaccagggtggagtgcagtagcacgatctcagctcactgcaacctctgcctcccaggttcaagtgatcctcctgtctcagcctcccgagtagctgggactacagatatgtgccaccacgcccagctaattttttgtatttttagtagagatggggtttcaccatgttggccaggatggtctcgatctcttgaccttgtgatctgcccgccttggcctcccaaagtgctgggattacaggcgtgagccaccgcacctggacctcaagtttctttctgcctatcattgtctttttctcttccgagttgacatcaacatactgtgagaagctttaggcaaaggcaacttttagctgttctgaaacatatagcagtgtaagaccatttcatttcaatgtatgccaggcagctacttcatctggtagggctatgaggggagggagaactagtccaatccggaatgaggcagtcgcctctcctgaattccccccagtcccattccacatttgcaacctcgagcagatggatcaggttggagaatatgaaagactccatgcagttcatcccctaaagccctcactaaaagagcttccttggagggctgggcattaaacttgtaggcagcagagccttgtggttgagggctttggagccaagaccacctgagttctctccttgccccaccacttgctagatgtgtgaccctggcaaagttacctaactcgtcagttttctcctctgtgaaactggaatggtggtaatacctgttgaagaggattgttgtgatgattaaaatgagtccatctgcgtagcacacctagaatcatgcctggcacctggcatatgctcaacacatgtgacccattcatgggaggagtggtatcatcctcattatgtcagctagaagagaattgagggaacatcttctttcttacagatgtccactcagcaggttttttttgtttgttttttgtttttttgtttttaaacagagttttgctcttgttgcccaggctggcatgcagtagcatgatctcggctcactgcaacctccgccttctgggttcaggcgattctcctgcctcggcctcccgagtagctggggctacaggcatgcaccaccatgcccggctaattttgcatttttagtagagacggggtttcgccacgttggccaggctggtcttgaactcctgacttcaggtgatcctcccacctccgcccctcagagtgccaggattataggcgtcagccactgctcccagcccactcagcagttgtgaaaggagcccagatgattcctcgttctatttcacccttttcccctgcatctttaacagcaaactctaagagaagcctctgctaaagctttcattctcttgattcagagtgggaccctttggccttcataagtaagaactgtgagcaggtcaggcagggcagcccttgaagctggtgcggccatgaccaccttcatgtgctcctcaaagatgggctctcagactgcttgcaacgccatcatcccactcctctctgaatcttcctcgtgccgtcccccattcccttttatggatcaaatgctgtgggtcaggtttgacaatggacataggtacatgagaaatgagagcttcccttcaccacccgccaatcccttctctgctcccaagaagcgtgtgtccctccagctggggtacaatgcaagggcatttggcttgaagcggggttggaggttggacaaataccgggggtttgtgtggatggagatggcagtatggtcacttcctcctgccttctccttccaggtgcgcccagacactcttctcacatctgtttcttgcagtaattccctgtgtttcatctcttcatctagggaaagaagaagaagaggaaaagggacaagcagccgggagagaccaatggtaagtgacaatcatcaggttagaggaaggagctgtagcctgaggaccacccttttatgttaggtttccatctgggggaggcaggagaaattcaaggccaggacattgtgggggaacccttcttagctagcctttttgtttatgcattttaattaattgcttcatgactgcccttttaaagctagtaacatccattgttgcatgaaaagcacattgtaattctagtggaatgtgttttaaaataactgcagagcctataactggagagcaagcggtaggcatgcctatgccgggatttatacagtctgcttattttgtgtgtgcctgagaagggatgaggagggggcggggcttaggggagtaggagggggtgtgtgtgagtgtttgatattaactgggctgttcctgaatgttctgatgcatgcctttacagtggtaaattacacccattttaaattaaggaggtttgtcattctctagaagaaattagaaatactgcataggcaatctcagaggtcccttggagaaggccaggcttttacaaacaaacaaaacaaaaattttgaaggctttgtataatttgttcttttttttcagaacacagcgaatgtttcctaaatccttgcctttcacttcctccgattacaggtgctaatgtcattttgagtcattaaaatagttgataaactgttttttaatttttcttgccattatagttttattaacatttaaacacgtatgacatttgaacattctttaaaatgaccatcaacacggtttcgtatgtttcagtagattttttttttcagttgcttctgttttttttttttaatttaacctttgttttgtttatttatttttcccataacagttgtttaagcagtgatgacagtgatttagagttgaactaactgtgcaaattgaatatgcagtatttctttaaaagagactggttaaaaaaaaaaatggaaggaattcagtaataaacctccttaatctaatggcatttttttcattgctcccactaagttttctcacgcaagcatgcatccgcagtatgattattttttcctttgcttttttttattttagttttttctttcttttgcttttctgctcataatttgcaagtccactagcattttactgactgtgcctgcttaaatgctgctatgagcttctaactaactcctaacagctcattcacacagcctgtttacctttatcttttcctctcttaataattaatgaaaatagatttaaaaaaaagacgaacgttccaaaagctgcaatatcccagtaccacaacccttttctttctttatttctttctattttgtttcgttttgttctgtttttatttgtaatttttttctttttttaaactattgtattctgagaagaaaaaagcatgttacaaacttaattccctccttcgctttattttcttctttaagaaaaaaaattgagagaaaaaagggaaagcagaactaaaagaggaaaaatatttaagagttattccatgtctaacttccctttgtcagctcgaaccaaatctgagagacagtccttaaagaagggatactgcagctttatttgcaacagctaatttcaaaagttgaataagaatgtgacttttacttttttttttttaattaaagaaagttaaaaaacgaaagtcaatattttgcaattagtaaccaggtcattgatttattcccttttttatttttatttttttcttatttgtatctttctcttcccccccccccctccctctctctctttctctctctctctctctccctttctcccacgttctcctcctctgctcgcttctctcttgaactcattcagacctgagcgctcctaagaaatgccgagcgcgctttggccttgatcaacagaataactggtgcggcccttgcaggtgtgtatagttttccagattcgctgtgctggtttgcagctggtctattcgatcctctcccccttctctggcctgttgctttgtagctctgtgtgtggatctcaggagacacaggggagtgggacactgccaagtgtatgggttctatgagggatgtgcttgttctcctgctgctgccagccaaaatgccactgtaaaacagcatcactcgtgcctcctcgggtcagcgacagcaaaccttagcgcgccccctcccagggaatgttacctgccaacccccatcccttccttgtgacagcccaggatcggaatcctggcctaggtagaagcaaatgacatcaccttctcccctcctcttctctctctctttttatttatttattttttcattgttgttttttggtttctggttgttgttttgtgtgtgtgtgttttattgttttattttattattttttttcttttggctcatagaagtcctttcctttcatgtccttggtgagggaagattatcaaatagaaccaaggtgatagagaagaaaaggaagctgtagctgagatttcacatccaactgagcacgacccaccattgtgttgtattttttgtgtttaccttatgctaacagatgcaaatactccaaagaagtgtcgggcactgttcgggcttgaccgacagactttatggtgcaaaccgtgcaggtatattaccactgcgaggcctttgggaaaatcaaagcattctgtccttccggtaccttagcgtgataatttattttgacctcgttccccatctacttcccctctggcatcaatgactaatgatcctcattcttcaaaatttccttgctaattttatgccatttcctctccccactttctctttctctcttttccccctgctctcatgaacaatatccctggtggcaggactgagaccacagccttaacaaacaaggaggggcacttatctttttgctttgaaagccagcatcctggagctggtccggccctatgaatgccttggtggcccgggtactgagcacagagagccaccatttccaaaggtttgaatgagttaacacttggcagcaattgcattcccgtgcacttagagtcgagacacatggagaagggttctggggtaggcttcttctttcccttttttctttttcctttttggttgttttatgtttaaaaaccacatgtctgtacggaggagcttggttagctgacattgttttacagtgctgaaaaagaagcgtggcattgaacggcatgcaccagctaaagggctgcaagcagtgagtcatgcagtctcagactgcagcgtccctaggcctgcagaattaacaaaatatatgtgtgtatatatgtagcattggttccaaaaggaatcagaacagcccagaagtgtccaaattaagcacccatgttccacctgcaggtctccatccagcctgcattctcagggaaagtgtaggtacttccttcttggtggagggataccgactagctcctgtctcatttcctttctttaatgaccacctttggttaaatgtgttgtttctttgttctgatacaagcagtctttgaatttggaatattacaatggtaggtatttcaacaccctaaacacgcttccctgtttgtagtgcctccctcgtcacgtgtccctccccttcatgactttgccatgtgctccgtgtttagacgttagatcagatgtgcatcccattacgtgcatgcccacgagtctcctgtgtctcttccccccttctctgatgccaatacgagagatcggtgaagtgcctcgtgttgaccccagcacacattagaggagagagggcctgagagtattccctgagagggagccacacagacagccctctgcctgtggaatgagggatttgggggcgagttgaacacccggcaggagaggaactccccaggcattctgtgagatggtagtgttcacagcgctgacagatgtccctttgacacagtcctggggtcttctctgcacaacagaaaggagttttgtgacaaagttgatggaggaggttaggtatttaattaggactagccagggagggcagggactctgttaagcagtgaatttgtcaaaattttacttgtaccaggtgggaagataactagctgtggaagcctgttctgagatgccctgccatggccaatgactggttaaccacaagggtcactaaaagagagggtttctcatgatctgtagaaatgtacaactgacactattgtgtgctcctcacaataaggccggttcaggtacctagtttgtttattttattaatggggtgggtggtggtttatgaatcctttttttgttttggaagcagttgctgcaagtcagacttttttttttcttgaagttattcctaacattgacccaaacatgcatcccccatttgggcatagctttagcttacaccttgcttacagcctgggtgtatcttcagagaccagaattttattgatatataaaaaaaaaatctgccaaccgaaaacctttgtagctgcttcctgtttgagcagcatggttttctaaaatgcatcttggaggggctgtcaatagggcagcatttctgctgcagacgctgagcccctggtcctaggtgccagagttccccaggtccctgtctccacctggttttctttccagtctcagcagtgttcagactttcccagcagatatttttctttgttggtgacttttccataccatggaatgattagcaaatgcatttctgctgtctttgaaggatgctattccaaaacaggatcaggaagaacccttagtttcctttcagaataaacaagaagctagaaaggggtttctaagaggccactcctctgaatcgagatgaagcctaggttgggggtgctaagagtatgggttaccttcccccttttactcaacttttccttttaacgtggctatggccacccctggcttaatgctaaaactcataggacaaaatgtacttaaaaaaaaaaaaaaaggaaaaaaagaaaagcagttgccaaccgaggcattttctgactcgtcagaaatgtgtgtgcgtgccagctgccctgtgctcagccaccttaggagacccattgctctgtcgccatagtcttcatgtcccgtgttccagatacccctctcattcctatgatctggaaacttccacgtcatgagggtgggaggggtgaggaaggtaccagaatgctcctagccaatcagggcttctagcttgccacacaaggtttctagtttcatttgacatttgtggacattttaacaagattctgttttgagcccaccaagttgcttttcccatcttttcactctgccctaatatagcatggaatgctgcttggtgctgttcccttgtcttcctggttgttctccctgcttctttctttctccctttcctttcctctctctgtttttctctgttgctttctcagttttgcttatgccctccccctccccacctcctttccttctcccatttttaaaatgcatggacatcttagttttttgagcatgttttgatctgcaggctaaggtggtttaaaactctgagaggcttaattatttatcttggtttctgggatggaagcagaacccatagtctatttactctctcccagggagaaaaaggaaccttgccaaattgagggtgagagggggtggtgcttgctcccctagagttccttctgacccagaaggaacagacagaccctgaggccactagcccccatgaatctcagcctctgggaggcagggaggactgagcatgctcccttacacccctcccctccttccctgccttcctgccatcttgctgagtccaaaccccaagcacagaggggcatgatcagacagctctggggcacagactgagaggaggaactcagcacacccttcctttccaaggccagtgacattgtctgacagtggttgccttcaagcaggcagcatcttggttgcttccagcggcagaaagctggccagtgcttacacacgtgtttccagttggagtgttatcagccatggttctgacaatattctagggtccttagatgagcacacttcctgtatctgcattatttttatagcattagtggggttgatccccaggctcacctttccttaccaaataccatcccatcagactgggattaatgggaggagaagctttgaagtcacatgctcaatttcttgagttgattttccccgacctcatcctttgatgctaagcaagaagggctctgaaattctcattcctatttcttacatgaatgagtagtgaagaggggagatgctggttttggtgcagggcaaaattagtctttctggtttaaacacgaatcacgataacccaaacccaggaaggtccatgctgcgattccctggcacttcttctttgtagtcacttcggtgaccggcttgtgctgcaccctccattgactagccttggcatattgacaagagcaggatgcccctccatccatcccatcctcaccatctctccttccaaccttctcactacggggtgggggaggggaaagccccaaatcttaaaaaaaaaaaaaaaatcaagtttgaatcttaatttaatccacaacctgcaggccatacaaccagttattcttgttcctttgaatcattttctgtttttcttattcttccccctcccccacctttgtttatcctcttctacctgtttttggtggtttcttttttttgtttcgttttttgttttttgtttttgttttaagtttattttgttttatttttgtttcccttcctcccttctcacctgattctgacctctcttgatttggtgtggttcttaacagacaagcccgaaagctctctgggcgccagcagcctcatggtggtggtgtgttaaaacctttaagcctcttgctagcgctgccttcagctatgtgggctcaacagtgagcattttgagagtttcatattgatacgaggcggctggggaaggagctctgtctttctcttttaaacacacacacactcacactcacacactcacacacacacatcactgggggatgggggtggtagtggtgggaatgggagtgaagggccgaggaaacttgatgggaaagtgagggactgtctaagccaaaagagcttttcagttcttctcaatttggacaaagccactttttggcaaatagatgccaccatctgcaggtggccgcctccatgctgctctcgtatataatttgggcatggtggggcatgggtgtttagtaggggttgggggaagcaagtagagagttcagactcttaaataagttgtttgccagagcaggcttagatctgggcactgtgaagtaagcgacccaccctgggggggcgccactgtaattgtcctcggaccactgggcgtgccacctctgtgggacatcccttaggtgacctcagcttgggtgtgagcattaggtaactctctcccttggcatctgtgccctctattcacagataactctctcccctgtttctaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggctggtcacttgtttctgtgatttggatttttatctctagggaaactggacctaccgtaatcaagaaaaacatattcccacgttggaacttgaccatacagttagtgtgtaggtgatgacttagataccagaacgtggtcttggactcttttgaggggttgatcccctcccctccatcctcgtggcccatttggtgtatctggtttgcataatgtgtcatttgcaatggagatgatcagtatcaaaggggatccctggtgtgtgtcttctgtagtatttcaccgtgccattcccagtagtttgttgctgaaagcaaagcacagttacagagcaaatgtcacttttttgggggctataaaccagtttctctgaaatatcctactcatcctctcacagtagcaagcagaaagaatttaattctggtgaatgagacttagtccaccaagagtgcacttaagaaaccacatccttagcagttaaggatcatgggtgtgaaagcatcctaacctccaagagttgcatcctgggagagatgcaagggtatcaaactgccctttctctagcagtgagcgattattgagtaagcagctttttagaaaattggattaaggtgatgcactgaaaggtgtgtgtggaag

SEQ ID NO: 16665 - DNA, 36820 bp, Human
taaggagttcactgccactcccagggcctggccgggaggaacagagtgcagagctcaccgcacatcatgcaacatggattccttcagccgagctcgagctcggttccactggatcacactttccccaggaccctcctgaaacctctttctcactcctccctcctacatacatatacattcctacagccccgtgccccaggcccacaaactctcagcacctacaggtagtccacgctgctctccctctgaaccgtaacttaagccttgggctcaatcccacctttcctgcccccccgcccaaatcactttgtggctgcatttcccttccttccttccttttttttctttccttccttccttccttccctccttctttccttcctttcttcccctcttctttcctcccttcccttctttccgttagtattaccagcaagacctcccgacctgccctttttaccctccccttttcctaggttccataccctaagtggagtagttgttaatcactcaattaaataattggtgtgtgtcccccccaacctcaccttctgccgggaacatctggcatcggaaacacacaaccattcacatgcacattggacacacactatgccactgaaacacgcacacactcatacacctgctttcccactcacagggataatggaggctgcaccagggacacactcagccatgctacagccactttcacgggcatatccacgccagctctcacagacacccttaaccagattattggacagaccaaagcaccctgctcacgccagcaggtcagaaaaacgaaggaaagtctgagattgtagtgctttaggggaagggtcacaggccttgttgctcgtgcacacatttgcacacacaccttcgttctcaatctttcgtccaggcccccttctgagtcaaagaaggccccttctggtgcgttgagagagacactaggctcgggagagcgctggcctctccagtaaatggtggggatccgcacgcctcaaagggctgcgccccgggaccccagctgctccgctcctcacagcctgaccctgcttcacttccagccgtgctcacctccgccctttacctctcctcagcctcggagaaggcgggacccgggacagcgacagagcacggagaaagctccgcgggggaaacaaggaaatccccaccttctatccctgtctcgtggtgcggtcccctgtgacggcctcagacctgcggggaacccaggactttgccgcctaccacggtctcagccttattctcgagcctctgggcgcctgcaaccggctgtctgtctgtgtgcctgttcactctcccccggggatgcgggtgagtcggtcttcttgcctcactttgctagccttattcgcccactcttgccttgctcttccaggagggccgggggagggggtcctccggtctgggttcatgagtgtgggtgtgggtataaatctaggggttggcgcactgagcctaggcctgcgcccccgcctccagcacccccaccgaccccaccccgccaagcgcccgagcaaggccaacctcctgttctctgctaggtctctccgaggtcgccttctttgcgcactttggttattgatcctgctgaaccggccggagcgcagcggctgcgcttctctgggaaagaacggagtggggaggtgagtaggctaggggaacggtggaggggaggagaggttgatcaactttaggagggggtgtagggcgttcctcagggccgccccagtctccctctgccgggcttggagcagggctagactaggggtggagcgggaccaccgctcccctccccctctccccctggcgcggagccccggcgcagctgggagtcttggaaacctgactcccacccaatcagcagggaggggaggagcagcggccaggagcggggcctgaggaggaggagtcgagcgggggcgcgaggggcggggagcggcgctcccggccagcgtaggctggctccgccgtagaggggttggcagtggcggtcagcatgggcgatgggggcgccgagcgcgaccggggccccgcgcgccgggcggagtctggtggcggcggtgggcgctgcggagaccgcagcggagcgggggacttgcgagctgatggcggtggccacagcccaacggaggtggccgggacctcagcctccagtcccgcaggctccagggagagtggagccgacagcgacgggcagcccgggcccggcgaggcagaccactgccgccgcatactggtgcgaggtaaggggacagcccgcggccctgctccactggaccctcaccctacccatactggggcccccgacctagctgcagctgacacctctcaattcatatattcattcattcgtcatccagtcattcattcagcaaatattattttgagcgtctattgtgtgctggacattaagctgagtgcaagggacaaagcagcgaatgggaccgaagcggtccccgtttctccgcctctcgggccagtcccctagttctaggcccattcggaacggctactgtggcgggggcagaaatggagtgcgggatgctgagagcctggactccgtcccgtgaccctcaaggcaagtgcggagaaaagcgtcttgcgcgctccgcggggacaggacgtggagggagcagcgtcggcaaccgcgggaggaaaaggccccggctctgcagggcggccggggtgcttcctcgcctcctgcctagccgcgtttcccgtccccggcaatcgggacccgcacggattgcccaggggagacggcgcgggacgcggagggtggcgtgcgcggcgctagcccgctgtgcttcactctctcggttcccacttcctcgcggcgcctgggcccagccggctctcggcgccgccttcccgcggcctggcctttcacgtccttctctttctccctcggccctcgtcctcctctcgtctttcccggccattcctctcagccgaacgcgccttcccagcaccttcttcctgcaagctcctccatctggactgcgaccgattacccagctcttcccggcctcctctccgcgaggccgaggctccccaggtccccagcgccagcctttcgcaatgccaagggctccgctttccctcgatctgggcctcgcccggcgagatgagaggagaaaggggactccggggtcttgccctcagcccgaccccaggccgcggccagagcctgaagtccgctgcctcctccatccctaagccctgggaccgggagacccagcgccagaagaggccactggcggtaatggctcccccaggctccttcctgggctccctcctcccggcttcctcctgctgcctctttccagcctcttcacacgcgccgctcgggagagccactgggcctctggaggctaccggcccgagcggatttctttggcctccgcctggggaaggcgaacaggctggaagctggccctgggtcgttccagcgaggggattatgtttgatctgagctcggctaccctcaagctgactgggacaccctgggccagttgggcactatctctctgcggctgctgggtgtgggtggcactggggactggagggtagagcatgcatgcagcccagtgtgagggtgactgatgactgccttgaatacagagacaggggccttagctctgggaaacattcctggtgccagatgtcactgggacagtaggtgctcactgctactcatagttgactgcttgagtcaaggcagttataccatcaggaattccagcaggtgtgtggacctgttgggcaccagggattaaatccgattttattctttagactgtgggatgtcttgagtgaaggcataagcagaccttttggttccattaaaaatatctgtaggactgccagagaaatcagtcctccaatcccacacattcccaggggaggatctaaagtcactgcctgtgacactcatcaccttgaaccccacctatgggtggacattttcttccccccaggacaattgtgagttctgtgcccacctaacatcctctccactctactaaccctgtatgtagagcaaataagttttgtgtacagatgtcaattaaatagccttcaggggtaaactcataggaagtggaattcaaaagtgaccctccaccctgtgaggtggggccacccaagctgggagcaatccacagccaggcagagatgggcttgcactggatgtgagacagcctgtgtgcgtcttcagggggtgtacttttataaatgtatgtgcacacacagaggtgccaatgcatttgtaaaatataatcgaaatattagacataaagcatagaggatatatttacacacttgacagaaatgaaaggcaaatggggcttttataaatccctctgcccttccccatttaatgatagggaggttattatgggcctgaaacgctcaggatgtgatttgccactaatctctcctagccagggtcacctgtgttactggcagtcccaccatggctcagggctctgatcaatgaaacaggcctggcactggtgaaggaaagtctgaactaactgccttggcccctgaatgaacattccttccataggccttcaatacactttgcccttgacctcagagaacacatcctcccaaagagcctttggaaggaaaccactaaaaggtaaaagggaggcatttgcccttgctgtcctatgtcaatgttgggttggggcctccccaggacctgtcctttcttggggaggcctcaccccttctgggtcctttctgcctccctttcattctgcactcctccacctaagggcataccacaggggggtggggggcaggtttgttgagggagtcctttggcacagggagtaggaggagagcttgggcaccagagttaagcaaaattggtttagattactgaccttacagccctttaaacctgaaccagtttctttgtttctctttgcttgtttccttatcttacaaagggacccatagcccttatcttaaaggacttgccaagaatcagaggtgatgtctataaaattgcaaacacccagtaggatcttcataaatatttgttgacagaaggaagggtgtagctctgaggtgacccacgaaccacttttgatgggtggggcagtggaccttcgttgtctgaggcctctcccaagtcacccctttccccctccttctggctctgggcccggggcctgggctgtactggaggtgagcacctaggggttaagaagccactaatggtaaaggaaaattagcaccatcttgcagaccacacagtgcagccctccccaatctccttggtgggaccctttttgggccagtgactcaagcctctgcgaatacagggtggagagccaaagaggccaaacgtggtgcgtctcctgcctcaaaatgaagactcctacacgtcacacatgggcacggaccagagctgctgagatgataggccgggcgcataacaggcaccccgcacatcgcaccgcggacgcagcgatcctcccatttgtaccctaaggcctgagaaggccgctccacacctccgcgtgcacagtccctagaccagtgagggcggggacggggaaatccttttgttttatattggaaaccttacgccaaaggcaggcaggaagcaaccaaaggaacaacaggccgcctgagccgtggctcaaacagcacagggcagtggccgagcaccaggcttttcggtggagctgggatcccagcaggcagaagaggtggacaactctgaccgcagactccctacaaccccgcgatcgatgctccacctgcacgctcaaacgcacctgtttcccaaattaatccagacgcgaatttaacgaccgattttgatagatccgggaaattctgtccaccagcgtcacccaacacagcaacttttacagacaatgcgtggcgtccgttcctgctcacccaaagcggcctctctgggctgacagccacccctgcgggtcctcaaaccccactcgaaaccctccgaacccctgtgtctgggagcagtagggtgggatgactgcaggatcccttgaagaagtgactcgctgcaaccccaccaccagcagcaaaaacgctttcacccgggagctgcatggatgcgcggatggctgggggctgaggggacgcgtgaagcccaggcctcttgcttgggctgggcgattcccgccgtgggacgggtgggattgaccttagtggagtccagtccttcggagaatccgcgggcagtcgggacccacgctccggaaacacccaagtccgaactcgtacacacagcacaatggcgtgcagccgccggggccctaactcccagagacgcgtctgaagaagccatacaagggggcgcagcttcggggctctggctgggaggttactgcagggacagacgcctcgcctccagcagccgggtccaggctcagggccggccggcctctgctcgctttctgcttggattaccaacagccactgggcttggggagatcggccgggccgcaggcctagccctgctgagcaggcgtttagtaaggaccacaggactttagtctcaatatctgagtctgttaatagacctgacaaccgaggaccagcccccaaggcagacgtggaaaggtgtaaatggttcatgcaaggaattgcactttgagatttttgtatttgttttattttttggttttagcatttgtagagggtttcttttttgtttgtttgttttcttggagttgctttacgttattttttccttttacttgttttcggcaggaggcccacattcccatagcgtgcctattcctatgccgggccctctcatttgggtcttcttttgtttcccccccttccataacccttacccccacaaacacacactgaagcagaccagcaacccgaaaaatcatcttgtaggtgtgtcttgtgtgcccagttttcattttcagggaacggttcaggaagattagacagctccttccctcctcaggcgatttctgttccccgcctggtctggtagacccaggaacccatggaactgccaccgcatccccttgccccacacacctgcatcttcagggatggtcccccaggtagcttctggggagtccgaggggcaaggaggccaaatcctttggaagcccggacaaggagtgggtacctggggctacaggaaagggaggagatggcagtggcatgcacccgcagtcagtcaaagccaccgggctcaagtcttcctcttttgcgcagcaccggtaaggagagagggtgtctatgcatcacgttggcctgggtgccatttccccaattaccccttggctgcaggctcccttcttgttggctacatttctttgatttctattttaatggtgggaggtggagcatatgaattttgcctatttgctccttgcttaatataaaatcacaaataatgctagacctgactacccttggagagccagtagccggttacctggctgtgcatctgcagattctgtaccccagttcaagatactctgatagaagacaccaacgctgcatgggcctgcccaccaatccctgcggcgagacaggtctaggaggctagttcattcctcatacccccaacccagctcatccgggaaggcagttgggggtttcagtgtcctgggttctcccactgttggtggatgctgactggggacattcagcactgcagaaagaggtagcagccccaggcttggatgtggcctacagagccagggtgaatgcacccggaaagtcagggtgagtgccagactgaaggagtgtgctataaggccctggcggaggcttgggcttgtaaaggctcagggccctccttgaaccatctcccccgtggccttaacatcttttattctttctttttttttcttttcttttccttttttttttttttttttttttttttttttagatagagtggttgctctgttgcccagactagagtgcaagggtgcaatcatagttcactgtaaccttgaacctctgggctcaagcgatcctccctcatcgacctcccaaagtgctggattacaggactgagctaccgcgcgtttcttgttctttaacttattctacaaacattaatgcgtactcactgtgtgccagactgatcctggctcaagctgctggcacgcagcttcccataaatgtaagctgtttctgcccagctcccacagtcaggccagaaacagctgggtagagacttccccgctgaagtcgagggggcgggctccccgagcctgcttcccttgaagccaggcaaagaccacgtaggaggtggtcactgtgcccaccaaatccaggcgatcttcccggatgcttttagtgcactgtaggcactcaataaatacttctcgaataacttaaatgggacaaaattcatcaacatggcataattctgtaggtattaattaggcggccaacgccttctcccggaagaacgtgtgttctaatattatcttattttttgacgttgcaatgtccttcttatatgaaacagtgatcatggcagaacatagaataattgttaaagcatgaagttgacaaccccatagtttcgaaattttgtttctgcaatccgcagctttgggaagcactgaattacaaaacctgaaaaccctcatatatgtggcggcttagaggccggcctaggctggagcggaggtcttgggaagcgctgggccgctcgtaaagtcaatggtgagtctcccggctttcggctttcggctttcggcggcagccgggtgtgaggttccacgggcaaagccagccagagggttgacagaaataactggataaatctgtgcccctgcccctgccggctcacacggctgcagcccacggctggagccaaaaataaccgcgcagttgacgccacggtttctttagcgtcttgctggagacattgactttcagagcccctgtcccgccttccattccccactacttggcagcccaccgcgtccacccgcggagctgcggaagccagggccgggcaaaggacactctacgaggcacagcctccggcagggccacacttacaatgtagacaggaaaatagaggatttaaattcaaaaagtaatacgagctcgatttttttaaaaaccggaagcaaagaaggatcccaggaacagccactgttttcaattctgggcgagtccttccaggcgatttttccacgctcttatagacgaacaaataaataaaagcagaactatatttcataggctgttttgcaatttaccatttcaaaaaaatttaatctgcagtgatcatcttctctgctgaaccagttcttgctgtcccttgactgtagaattaagtattcctttagttggggaaagcctaattcccctaaagactggagggaccttggggttgtttttccttaatataaacactgtgaagtaagctccgaaggcagggttcttctagacctttgactgtttctgtgggataagtttctagcagtgtaattactgcttcgaaagatttacacacacaatttaaatatatttcatttactgtaataggtaattgtaaaatagataattaattcatcaaaacatctttttttcagacatcaggagatgggaggtctcactattttgggtttaagctggactcaagtgctcacatagctgggattacaggtgggagccactgcactttttaaaaagtatccggtgaaaaacctctcccatccctgtccccatcacccacttcccacctggttcaaggactttctaatatgtccttccagataatgtttatgcctatggaaatcagtgcagttatataacttttttcttccaatatatcttggggtgtaaataactttttgtttgttttttttatagatgcataatattccatttaagtggactaggtggatcataatgtatatcatataaccagtaccctatttgtggacatttggttattttcttatctgttgctattatatgtaatcctgaaataaataaacttgtttcttagtcatttccacatgtgtgagtatatctgtcagagaagttcctaaaagtgaattactgggtcaaatggtatctgtgtttgaaatttgcaagataatgcccaattgtttgtcctccataagatggaagcagtttacactgccaccagcgatgtctgaaagtggttgtttctccaaaatttgccagcacagttcacattttacatcctgatgaacatagtcaagttattctgcaggagaagtttagttacttatgtccacccctttgccctgtccccacactggacattttgtatcatttcatctttgtcgatcttcatattcattagccagttgtatttcttctatctattgattcatttcctttgaccagtttaatttgcaaatataccttttccttattgatctgtagaaactctatgtattgctttcaatatgtgttgcaacattttaatttacaatttatcctttgattttgtttaggatggtcttttgttttcagaagtataaaatgtctttttatttttattatgtcattatatttattttttagagacaagggctcactctgtcacccaggctggagtgcagtggcccaacaatagcacactataaccttgaactcctggcctcaagcagtccccccacctcagcctctggagtaactgagactataggcactccccacaatgctggcctagctttaattttttatttattttctttaattttttatttttaattttttttagtagggacagggtttcaccatattgaggaggccagtctcaaactcttggcctcaagcaatcctcccacctgcgcctctcataaaatatctttttaattacaaaagcaatccatactattttgctatgtcatgtaaaatttaaaagtttctaatttcccttacatgatacacttccactcctaagatttaccttccaaactttacctagtaattgaaaaatataaatatgtaagttatatattacaaaaattggatttttttgcaatgacttttttcttaattaaacaaattgtcttagcttgcaagtagagtaaaagaatatttgtggaaatctttctttctagaactccctcattctttttaaccactgtataggattccgttatgtagatatcatataacttatttaactagtcctctattaatggatatttaggttggttgtactttttcattattacaaacaatgctgtagtgaacatctttgtatcctaatttgaacaaatggtttgttttatttttaattattcttatctttttatcccaggcaacacctacctcatttataccatagaatgagtgctcccttgaacaaatggttttttttaaatcttatttatgagacaatttggaacatgtaaaaccaggtgggatattttattatattaaggaataattgtcgatttttattgtgataatagtattataggtgacttttttaagagtcccccctttttaagagatacatgttgaaatactcataagtgaaatgttatgacttctagaatttgctaataattacagcagaatagaagaaagaagattattcctgagtttctaatagttgaaattgggggataggtatatcggagctcattgtactgctctccctaattttgtaaatatttgaaatttgtcataataaactgtttaaagtaacaagaatcattttacatatacatggtatgaatataattacaggataaattcctagaagcaaacttttaaaatccaaggatatacatttaaagttatgatagtatttccaaattttataccaaaactcttatattgatttatactcttagccatcttgtataaaagtgtcatttctctacgtcctcccaactcaggatatacttaattttttagagtgaaatcttttcaagtgacagaataatctcattttattagtagtttaaattgctagtgaggttaagcatgtttttatgtagttattcttcattttaatattctcttctgtgaatttttcatatatttagccatttctctatcggatcactaattgttttctcatcttcgtaagtgccacttatatagtaaggaaatgagccctttttctgtgacatgtattgcaaacaactcccaggtcactttcttaaaaaaaaaaacaaaacaaaacaaaaaacccacaaaaaaacagcaacaaaaaactttctttgtgggattttttttttttctaaactgaaatttaaactctaaccacatttaatggttgttcctttttgggcttctagattctagctcctagttagaaaaatcttcatccagcatttaaaacattatatatgcatacacaaacatattaaaatgtttgctaccaaaaaaattttattccctagtcttttcaccaaaagaaataataaagaaagacaaaaaatgagttgaatctttcctccctgatcggtttccactcctcagaggcaagagaagagtgaggtgcttcttttgccagacttgttcctatgtggttacaaaaacacaaacacacacacagaaagagtttacttttactgtttttttaatataaaaatgggtttatgcacacttgccatttcacttagtagtatacaataaacatccatccaggttatgtgtctcattcttgttaatgtttacatatagccaaagttattactagactgtgattttatcgacaattttcctattgataaacattcagcttttcccccttttctccctcttgcaaactatgctacaaacagtgggtctgtatttatcaactacgccaacgtttctgtgtgatagaaagctctataaaaatgctgggacaaaggaacagtgcattttaagtttagctaggcattattcctcttcaaaaaccatatattatatcaatttatgttcttattgagagagcttgagagaacctaattctactcagccttgccagtacaattttccaaatctgatagataaaatatggcatctcaaaaaacaaggatatctcattgctgttataactttcatttttctgattcctctagcccgagtattttttcatatttattaaccacatgcatttcttcttctctgaataatttgttcggtttcccactggactgcttgactttactcactggtttacagaggctgtgtgtataccagacattaggactctgttaagaattcattatgaatattttctccccatctgtctcttaccctgcagatgcgtttatttttaggtactcaaatatgtcatttattttcctttctagaaagttattttatatttgttcttcaatttttagagcttttatttacatttaaatttgtgtttatttttgcacacagtgtgagataaatagctttattccaaataatgaactaattgttcaaaagctatgtctctaataaccctgtctttcctccaactaattcaaaatactgtcttcccaacataccagatccacatagacacatgaatttgcttcataactcttgtgcagcattataccattttagttgctgtagatttgtaacatatttgctgtgtggtaatgcaagtattcactactattgtttaactttttttgttgactatccttgcattttcaatgttcccaataaacttgagaatgaattttccataaggaatttttatagcaatcacattatatttgtaggtgggggcaggaagggccttgcacacttaaaagtcagcatattatcggccaggcatggtggctcatgcctgtaatcccagcactttgggaggccagagggggcagatcacttgaggtcaggagcttgaaaccagcctgggcaacatggcgaaaccccgtccctactaaaaatacaaaaattagccaggcgcggtggtgggcgcctgtaatcccatctactcaggaggctgagggaggagaatcgcttgaacccgggaggcggaggttgcagtgagctgagatcacgccgttgcactccagcctgggtgacagagtgagactccgtttcaaaaaaaagtcagcacattatcagcttatcgtgcaaagagactacctagtgctaggtaggaaaagaagtgagatagggctttggaggtgggggggatgtctattgggagaggtgccagaggggcaccagaggtcagaagcataagctaactactatcaggccgggggtcaccacctctcccaagcaaaggctcttgggcagaattcaccctcccacataccctcagagctcactgctctttgaggagacttgaggggtagcaaaatgcaggactcatttcatttcaccctaataagtgcctacctgcaaggaagccctggaatgaaagctgttcctctttccagatgctcctcccaaactcctcctagaaaaggagcaactcaaaaaaagaggactattttagtaagataggctatattttgctgcagagacaaccgcaaattttagaggcttaacaaaacacaaatgcatttatcactcacagaagtccatcacaagtggacaggggctcatcctgatactcagaaacccaggctggtaaagcttcttcactcctgcttccaagaccatcacagtagaaagggtgtggcaacacacacacactctctggttattgggttttgttatttagggcagggatggtaatatccccttatcttattttattgccttcccaacactcgtctttgccttacatatttttaaaatttattttttattagaaataaattgcttgaaggccgggtgcagtggcttacgcctgtaatcccagcactttgggaggctgaggcggggggatcacttgagccttttgagaccagtctggccaacatggtgaaaccctgcctctactaaaaatacaaaaattagcgggcatggtggtgggtgcctgtaatctcaactactcaggaggcggatgcaggagaatcgttcgaacccaggaggcagaggttgccgtgagccaagatcacgccactgcactctagcctgggtgacagagcgagactccgactcaaaataaataaataaataaataaataaataactttacatttattatctgtctccctccccagtacaaggtttacaggaacaaatgcttttctcttttgctcatttctgtatccccaggccctagaataatatttgacaaataagggcttattaaatacatgttgaatggttgaatatattcagttgttttaatctacataaatgagattaaactacatgttattctgtaacttactttcatacactaatgtctgttcacatagcttattgcctcattcttttcaattattacatggtattttataatacaaatgtaccactatttgttcagccatttctcttgtggaaaatactgaggatgctttcaaatttttggtgttttgagcagtgcagcaacacacaccattgttgtatatactttggagcacctgagcctgtgtttctctaggacaaataccaacgaaaataaaatcaggccaggtgcggtggctcatatctgtaatcccagcattttgggaggccaaggtgggtggatcacttgaggtcaagagtttgagaccagcctggccaacatggtgaaaccctgtctctactaaaaaattacaaaaattagggggcgtggtgatgggcacctgtaatcccagctacttgggaggctgaggcaggagaatcacttgaacccgggaggcggaggctgcagtgagcattgatattgcaccactgcactccagcctgagcaacagagtgagactctatctcaaaaaataaaataaaataattggagcaaaagttatgtgcatctttaatcttgataaatgcagccttaaaagatggactcaattatggttctattaatagcgtataggagtgtagatttccctacagtgcaccattgttattaattgtcatcattgtttttaatcacttgttaatgtcctttcaaccttatgggatataaagggctttccattgttgctggaacttgtattatattgattactataaagctatgcttatcctttcatatgtttattggccatttagctgtctttttttgtgaatgacccagataaattacttgaccatttattttatcaggctatttacttaaatttttttttttttttttgagacagagtctcacggtattgccaggctggagtgcaacggtgcgatcttggctcactgcaacctctccctcccaggttcaagtgattctcatgcctcggcccctgagtagctgggattagaggcgcacgccaccacacccagctaatttttttatttttagtaaagaagaggtttcaccatgttgcccaggctggtctccaatgcctggcctcaagtgatctgcccacctcggcctcccaaagtgctgggattacaggcatgagttaccacaaccagcctctttgactcttaaatgtattttttttttcaaatctgtttcttgtactttaccttgattttggtgcttttgtcatccaagtttttagctttaatatagtcaaatacatcctttgtgtttcctttacagcctccagtttttttgctgtttgttttttgttttttttgagaccgagtcttgctctgtctcccaggctggagagcaatggcacaatctcagctcactgcaacttccccttccctgcctcagcctcccaagtagctggattacaggtgcctgccaccgcatccagctaatttttgtattttttagtagagacggagtttcgccacgttggccaggctggtctcgaactcctgacctcaggtgatccacctgcctcagcctcccaaagtgctgggattacaggcgtgagccaccacgcctagcctacagcctccagttttgcagcttgcttagaaatttcatcccaagcctagcattctaaaaacatcctcctatatttttttgtaatgcccttataattttatcatctatgatttggtctttaatccagttgaaatgtgttgttatttatggagcgagataggaatttaacttaattttattccaaacatacaatttatggtcaccaatctgcttaacgtgacttattgactaaatcactcttttcccatcttgaatgcccttttatgataaactctatgactatggatacatgtgtctaatatccccttatcttgtacttcccatgctattgtttccccacatgcagtcatttgagtcccatcttcatttgttatattaatattccatttattttcttaatattttagcataatgcattttaagattaaatttccactttagcctcaccctaagcctataaaattataggtttaaatttttttctagtaaacattaaaataaatgcctaactttttaaatgacatgcttatttatgtacaattttaaatcatcttacaaaccataagtggaatacagagacactatcgtgttttttctactaatggatttgtcaatttctgtgacaacacatcactctagctttgtggcatgcttttgttgtcaactttttattttgaaataattatagactcgcaaggagttataaaaatagtacagagaagtcccatgtatccatcacctagcttctctgtagatggcattttacaaacctatagtaccttatcaaaaccagaaaattgacattaatacaatataattaactagactacagaccttcctcagatttcacctgtttttccttgcactgtttttttgttttttgtatatagttctatgacattttattacatatatagatccatgtcaccaccaccacagccatgatacagtactgtggtgtcaccacaaaggaacttcctcttactactcattgatggccaggtccttcctccatccccaaatcctggcaaccactgatctggtctccacctctataattttgttacctttatattaaataaatggaatcatatagtgtataacttttgggaactgttttttcccctcagtataatttcctgtgtaaattgttgtgtgtttcaatcgttcttcctttttttcctgagtagtatcccagagtacagttacaccacagtttgtttaaccattcacccattgaaggacatctgatttatttccattagggggctattacaaataaagctgctatgatcatttgtatacaggtttttgtgtgaacataggatttcagctgggctgaaatgggattacagctcacgcctgtaatcccaacactttgggaggcccaggcaggtggatcacctgaggtcaggagttcgagaccagcctggccaacatggtaaaaccccatctctactaaaaatacaataattagctggttgtggtggcaggcgcctgtaatcccagctacttaggaggctgaggcaggaaaatcgcttgaaaccagaagacggaggttgcagtgagccgagatcgcgccactgcactccagcctgggcaacaagagtgaaactctgtctcaaaaaaaaaaaaaaaaaaaaaaatcagccgcgcatggtggcaggtgcctgtaaccccagctactcaggaggctgagacatgagaatcgtttgaacctgggaggtggaggttgcagtgagctaagattgcaccactgcactccagcctgggggatagagcgagactctatctccaaataaataaataaataaataaataaaacaaaaacaaatatttcatttccctagaataaatgcccatttattctgggcatttattctgggttgtagggtaagtatatttttaactctttaagaaactgcctggctagtagtaccattttccattcccaccagcaatgtaagagagatccagcttccctgcatcctcaccagcttttccactctcagtattttttctttttgctgttctgataggtgtttcttattgcagctttaatttgcctttccctgatggccagcaatgttgaacatttttcatgtgcttatttgtatggcatgttttaatatttggtggcaagtctgaggttgcctttctcgtctgggtcatgcctccatgaccctgagggagacagctgcacttggctgctccctgaggtggcaatccccctttaggtcttgtataaagagggaaggatggtttgatctcatgtttagggactcaggctcagatgctacagggtgggcttgaggaggcttattaaggggagggtaagacaccagctgtaacagcacccttcctcctattcataccccacaaaacatgtttgataaaatcagtgcctttgagatggattcacttgggagttttgccacaaagttctgagtctgctctcacaattggaaattatggaacctgagcaaaggagactgatccagtcacagtggggtcacacatattatcctatctttttgaaatgtgaacagaattggagctggggagcttgagttgtcctaagaggcctgtagtttctagaacacatccttttgataggctctgcccagcagcttagcaggacctggcctgggatggggagggaggccacctctgagcagtgacacatcctccaccctggctcaccttttccctgaggctgactatgaacaggacggtgcttgagaacctgtgagatctgagccaggactcttgagccaggagccagagcataccctggaaggggagtgtcaatttgcactggcaggacccagaaagagtcagtctcctggggtgggacgcttggagggaggggctcagggtaaccctctagagcagggattctcaaggtaggtcccaccgtccctgtggatcacaaggagcctcctgccagacagcacatcccgaatacagctctttccattatgttctctaggggaatgatgaacccatccagaagattccatcttttactcatgaccaggtcctcttcatttcaacctattaattgaattattaagaattatcaaccgagggctgggcacagtggctcacgcctgtaatcccagcactttgggtgtccgaggtgggcagatcacgaggtcaggagattgagactatcctggctaacatggtgaaaccccgtctttactaaaaatacaaaaaattagccaggtgtggtggtgggcgcctgtagtcccagcttcttgggaggctgaggcaggagaatggtgtgaaccctggaggcagagctgaaattgcgccacagcactccagccgtctcaaaaaaaaaaaaaaaaaaagaattaccaactgagggtagacataaagtaaaatgatggaggcgggcgcagtggttcatgcctgtaatcccagcactttgggaggtcgaggtgagcagatcatgaagtcaggagttcaaggtcagcctggccaacatagtgaaaccctgtctctactaaaaatacaaaaattagccaggcatggtggcgcacgcctgtagtcccagttactcgggaggctgaggcaggagaatcacttgaacctgggaggcggaggttgtggtgagccgagatggtgccactgcacttcagcctaagcaacagagtgtgtctccacaaaaaaaaaaaaaaaagaataaaaaaaaaagacggtgtttcaagagtttcttggacactgccagtaggaccttgagtaaattacttaaattttgttactccatttcctcatctgtaaaatggggatcataatagttccaaattcatggagacattgagaaggttaaagtgcttaaaacagcagggtgtggtggctcacacctataatcccagcactttgggaggctgagacaagaggatcacttgagcccaggagttcaaaaccagcctaagtgagaccccatctcattttttaaaaacaaagaaaaaaataattaaaaaataaaataagtccaggcacaatggctcacacctgtaatcccagcactttgggaggctgaggcgggcagatcacttgaacccagaagttacagactagcctgggcaacacggtgaaatcccctatgccccccgtctctacaaaaaatacaaaaattagcagggcgtggtggtgtgctcctgtagtcccagcaacttgggaggctgaagtcggaggattgattgaaccctagaggtcgagactgcagtaagctgagatgcgcctctgcattacagcctgggcgtgagagtgagaccctgtctcaaaaaataaataaacaaaacaaaattaaatttaattaagtgcttagaacagtgactggcccagagcaagtactgcagacgtttgtcagcctttgttacggctggaatgtcaacagccactgcccattctggccgcgttgcaaactccgactgcgtgcgccccctggagggtattggaattcctgcacctgtggagggttgcttgctttcttgggcttcctcaaggcggccttgtgttggtaagcttcccattgccaatgctaagtaatggaaattcctgttagtttagcttcgttatcatggacatcatttgtagggagtgattttgtaaatcctacaggatgtgatgctgcatatttccacaatctaatttgtaatataaaatgttctaataactagatttcaagccatcagtatatgtgggtcacacatggatcatctccacccctgtagttaaatgttactaagttctttatcaggaatgtgtggggaacgtgggctccaaatcactcttcagtgggctccaaaatattggaggccctctgtgcggagggcattggtcagagcccaggagtggccctgctgttcaggactaggcacatggggagtggcagcagcccccctctggaaggcatccagcagcctgatatggtagcagttgtccttgggctcctcctagggacctcagctccccagactgtcctctaccgctcatcagctagcctcctcctcatggaccccaggtcccaggtctgtggatgcatgacactccttcatgcatgcatgcatgcacagacacacacacacacacacacacgcacagcttaggacctggctctgacctctccagtaagccttacctgattgatcacattcaattctaacccatcatcccctatgtacttgaggacccagcatatttttcccatctgttccttactctgcaaaggcccagaatcctggctgggacagagtgagtcctttcttcccagaccacattggtagacctggcagttgtactgaggcctattcacatacatttagccacccattagatataatatcctgcattgggtggttaaggaatctgggcccagagagggtgagcaacttgtcacaggtcatgcaaccagatccaggcctgaggagctctgcgatagatcacaccaccttttattaagatgctttctggtgatctaactccctagctaatgaactaagctggctcctttcatggcctctgcagatgccaaagggacaattcgggaaattgtcctgcctaagggcctggacctggaccggcccaagcggacacgtacatccttcactgccgagcagctgtaccgcctggagatggagttccagcgctgccagtatgtggtgggccgcgagcgcactgagctggcccgccagctgaacctctccgagacccaggtaagagaccagggccaggccactccactcttgtcctggcagcctgggaactcctggggatatgaggccctgtgagctgctacagggagacccaactttggaggagttcagacaagcatgagggaaagactttaagctacaggtaaaccagagtgaaagagcaaataaatatagcgccgaccacagacagtcaggaaatgccaatgggggccttctggatagatcaggcacttttggatggaatatggaaaaggttcagagaaactgggggagagcagccctcagggcacagggagtggcttgggggggtgttggcatgtaagaggagtgacaagaagggatggtgagggcttggctggttggaaataacgattctggggaagatgaaacattataaaattgggctggggacctctcgcttctccatttctggccctttcccaccctccatcaccttcccttcatctcagggtgcctcagtctcttgttggaaaggaggggtctgcacacccccttcacctgggtaggactggcattttaacagcagtgtgcttaactcaaaagaaaaaaacttttgtaaattaagcacctaccctgtatgaatggagacccttcaagctggtactagagctataaaatactaccactactactactactactaatacttagtacttacatgtgtcaggcactaagtgctttgcctatgttaagtaactaatccctcccaagaagcagatgatgtcattcccatgttacacgtgaaaggaagttatgcccaaggtcagacaactaattagttccggagctgggctttggacaagcagtctctcatctttatgctgcctataaactgggcaaccttccttgagattgtcaaagaataactcagagacccttctttcagccagagctctagtagtttgctctcatatatgagggagatcaatcaatacatgcattgtaaacgacggccaaaacaggattgataaagtggagaggaagggaggaggggaatgcggaagcactggtctggagcagtgtgctggtttccttccttggagcgaggcgggaggctgtgctggagtgagggcttcccgtctgtgctgtgtggctgctgtcctcccctgtgtccctgcctcagtgaggtcagctctccctgtttccctcagcataattcctccagcccctcaaatccccccaacagagtgctgtgcagcccacccctggggagggggtagtcagatgcgcctggaagtcctcctggtccccttgagaggttagcaggttcctcctggggtacactgagagtagggcagaggaagaggtgagaaggggtgagaggcagaggaggggcaggccgggaggaggggcaggccgggaggaggggaaggccggggaaggacagcagctgctgtcctgcagggccgggtcatctccacctgcacttgtttttccccagctgccactgcagagctcccaaacaaccctgcggggcctccctccagctgggctcaacagggggctgggaagccaggcttgtgctcagagaggaggctgcagtggcagggccaggccagaactcctggggaagtcactgaggcccgtattccctacactgagctgcccttggaggtcaagcccaagcccccctcttccaggaagccttctgcaggcaccttgccctcttcccaagagacccttccacatggcgtgacctggagagacagatagtgtgtgtgtgtgtgtgcacgtgtgtgcatgtgtacatgtgtgtggtgttggatgtccaccagtatttgcttccctaggacaagaatgtatttataggccatggctcctcgtcgtgcttcacaaggagcccagaacacagctggacacatagtaggccctcagcaagtcctccgcactgttctcactacaaccctccttcctctgtccccagtcctagggttgacagatagtaaaagtaatggacagctgatgcttattgagcgcttcccatgcaccaggtcctgttccaagggtgtgacatagtctaactagtttagtcctcaccacaaccttatgggatacgtgtgagatttttcttccaacaccaggtgtatggtatgttccaaccaccagcaggcagtgctccaattctccagcatcactgagtatattcaacagttcaatactgacactaattcccagagctagcacagaccctacaagttaagggctctgtcccacaagacagtgccacagcagactcaagttccaggagccacctgtgcttctgaatggactggcctaaaaccgggggctcccacatcgccctctgcaggtttgacaattcactagaatgacgcacacaactcaggaaacacctcccctacacttgctggtttattataaatgacacgagtgaggaagagccagatggaagagacacaaagggcaaggtaagggggaggtgcgtggagctcccatgccgtttccagtgcccccattcccagcacttccacgtgttcgccaaccagaagttctcctggtctccttgttcaagactaaatccaggccggcctggcacagtggctcacgcctgcaatcccagcactttgggaggccaaggagggaggatcgctcaggagtccaggagttcaagaccagccttggcagcagagggagaccttatctctaaaaaaagttttttaaaacattttttacagtttacactgtaaactgcagggtgtggtggcacacacctgtagtcccagctacttgggaggctgaggtgggaggattgtttgagcccaggaggtcaaggctacagtgagccatgttagcttcactgcactccagcctggatgacagagcaagactctatctcaaaaacaaacaaaaaaagactataatccaatctccattcccctcccctccctagaaggaaagaatgggggcggctgaaagtttctaccctctaatcacaagtatggtctttctagaaccagccccagtcctgaaactacctagagatccaccctgaatcacctcattagcatacaacagtaagtcttatttatttatttatttatttatgtttactgtagagacggggtctcgctttgtttcctaggctggcctggaactcctggtctcaagtaatcctccctcctcggccttccaaagtgctgggattataggtgtgagccaccatgcccagccaataagagtatattgtttccactttaaatagaaggaaactgaggcatagaaaagttaaatagataacttgctcaagacttgcagcgggtgcattcatgggtaatagtacccatgaagatggctttatgggtactattatccccatttaagcaaactgagcctcagagaggttaactaacttgtagctagaattctgtggcattctcagtatgttcacccataattttgttcaaaaatattattgaatacctactatatagcaggtactcttctaggcacttgggctttggcttagaacaaaacagaccaggcatctgccctcgtgcagctaagatccacagagacaaagacaaaccgcatttccaggagtgatgagtgttgtgagggagctcaaatggggtcataggagagagactaaaaggaagtgttttactggggtgttcagggaaggcctctttgagaagatgacgttgagcttaggcctgagtggcaagggagaaacagccagatgaggagccagaaggagacgtcaaggcagacggtaactatgaagacgtgaggggcaggaattggcatagaatgttctagaagtatcagaaggccagagtggctggagctacagggtaattgggtaagtaggtaggggaggatcatgcgatgcttagagactatggtaatacattgaagagaaagtgacaggagatgattggcattttacagaggttctctggctgccacttggggaagggacccacaggggaaaggagtggacaggtgtggacaggtaggaactactgacatgggtcctgaacagagcagtggtggaggagagaagcgtactaatgtgagaggcactctaatttagtgctggaacatattaggacttgctcatggattatacgcccagggcaagggaaaggaagtggtttgggtagaacaactgggagaatggtgacaccatataatgagttgagaaactgggggagaagcaagatggtgggagcataatcaagaattttgttttggatcagttaagtttgagatcccagcggagatgtcaagaaagcatgtcagattttggggggagggctggtttttctctggtttaagttatctgagagtctctgtcagagctcttttgggggaaaagataagaaattccttcaagtgccctcagataatggatggactccccagggattaaaaacagaagccatagccttgttgaaattcaataacaggaaccatggtgtagccaggaattggaagagactggaagccaaaggctcttttgggcccgagggattcagcaccagctactcacagaacttcctcccagtgctctgctgagtatgtgctccaactgctctccaaaatatctgcttctctctctgtttcttcctctcctctcctctctttttatctcttctcctctcttttttctcttctcttccttctgccaaatagcatctctaccttcttccctggatactcagaggacccaggcatggtcccaattcaggcagagaaaacacagagcttgctcagggcccatttccatggctagtctcttctttaatctagcatgcccaattcagctgagttgtctgcagatttaaatctgaaacccacttacaggattgggcaggcagaatggcgaagccctttccttggctctccaccactcacagggctctacaggacaaagggtccaccagagtaggaacagtgaacaagacacagtgcagctgacctctgtcccggccttgcccagactccatggctgtgcaacagaggctaagcatggctgccctggagagcaggggcagcctcagaggaatctctctctcaagactatcaaaagaaccctctgcccacctttgtcagcccaagggtagcatacactgaaagttcttctcatgtcagagaacatggacagccccacttagtccagttctccttggttttagaaaccttctgatacaccttgtcaccatgctttgtttgaaaaagaaagtttggtgtttgattaaagcagcatttctcaaggtatgctctggagaccagctgtacgtacagctcccctggggtaaaatacagatgcctgtgccaccctcagcccagaggttcccagtcagatttctagggaagaccccacaacctatatattttttgttccaggtgatttaatgcacagtgatgtctgagaatcactggcttatggaaaagtgagcaaatctgaccagatgatgtgatcaccatgttgcttaaaagacttcatcaactgccagcactttaataagtctgtgattattagcccaccgagtcatcacaacaaaactatgaggaagagttaagaaccccattttactggtggggaaactgaggctccaagaagttaagtaacttgacttaagtcatctagctagttaagggaaccagaattgaatcagtggctgtctgacctctgattctccacgatagtttgctactatatattgtctcctccactatattgtttgctacttcaaccaaaacacttaccgtgttgtaacacttactgcttgcccatgacccaccctgctagtgtctgacagccaagagggtcaaaatggagttttatttatttttgttttttcagcacctggcaatgcctggcttgcatcaaatgcttgatatttctgtgttgcctgaatgaatgaccagagtaccagggtccaagtaggacataagaggatgtggctgcagaggaaaggaagatgagaagctggctcaggactcccctcctgcagctgggctggaggacgttctcagggccaggagcccaggagccaggtggagaacaaactgccaagtcccaatatccccccgggatgcccacctagcttgggtaagagctgctccagcccttcagcattgtcctcagcctcatgcttgatgcctctgcctcagatggcttcttccagaacagcacgatagatggtaccttcctagtgcagattacaaaaaccaagccatcctagatacacagataccactcacctcagattaagtatgggcccatggtcacagaaaacagtcttcaaaagatgaatgccatttccagatcaacaatgaatcctggaatttgatattgaccatgagcccaaagaagctggtggataatctcctggaaaattcctctgtagtcctggcagccaagtggaaactgtgcccatctcctggtgcgcggccatggatcacagtgtggcccagaaagaaatcagggagggggcagtgccatgggtcacagtgtggcccagcaagagatcgcggaggggggcggggcagccaccaagcactcactgagtcccagggagtcaagatggcagcctccaggaggccacacaggaccctgagaaaacagaggagggagacagcccagaaggtgcactgggcaggtgaggggagaggcacagctgcggaggtgtgctggccccgccaccctgtgaagtcggctaggaatggtttcccagaagtggataaggaccgatcactttggatttaaccttgagaagaggatgaacctgagatggaaatgaaggtttcctggggcaggagggacacattcagagggctctgagcctgtctgttcttcagaaagacagagagacaacatttgcagggccctgtgaacctacccgctagggcctgaagggcctgataggcttggtgggcctgatgggcttgatggtgggaagtagagagttgacccttcttactctcacccttgaagtttgcaatgctgggaagcacattagattcacccacagagctttagaagaatacccaggcctcagccccattccctagagattctgatttaatatgggtgaggcatgaggcccggacatcatcccagaaaattccagtgtgcggccaaggttgagaattcctgacctagcccatatgtggccaagaaacaagcacccctggtcccagcccctgctccatctgcctctgacttctcctctcctagggtccaggctcaccttctcaggagacgcccaaacccagcaccagcccacacccgcctctccttgctacacccagagctgcaggaagatgggatatgtgggagagcaccttgtaaatgcctggtcattcctcatctgtcacaccccattactgccactccctgagtacgaattgccctctgttttttgggaatgagttagtgccactcccccactagaccctcagcttcccaaggactggagtcatgacatctgtgtctcctctccctctagttcagaaacagagctagaaacagagaaagccagcgataaataactattcacatttcctgtgggccaggcgtgatgccaagctccctaaatgggttttcttctttcatctctgcaatagccaagtattattgtccccattttaaagataagacactgaggctcaggggttcctggaggtggcctggcctcaggtcctaggacggggaggtgctggcttggctaagaggtcaggaagcttcccagcagggagggggaatgcagcagtgtgcagcgctatggtccttgaggatctggtgagactccttccctcagcagtcagattccagaggtgacaaatgggaaagggttttcttctttccagtcattgccttcagctagacttggctgaatcttccttgaccatcccttactgatatcttcttcaaatgtcccctcttcagggaggctgtatgtgccattccattaacaaaacagtcacccccctccttcctttctgctatcctgccacctttctctaaagcagtgccccccagagtatggcccttgggccactgccagcccataaactgttacctgtctatgacatggtaagtatagaaataaagaataggtatttagaaaaggcctggagcggtggctcatgcctgtaatcccagcactttaggaggccgaggtgggcagatcacgaggtcaggagttcgagaccagcctggccaacatggtgaaaccctgtctctagcaaaaatacaaaaattagttgggtgtgatggcacacgcctataatcccagctactcaggaggctgaggcaggagactcacttgaaccccggaggtggaagttgcagtgagccgagatcatgccactgcactccagcctgggctacagagtgagactccatctcaaaaaaaaaaaacaatgtatatagcaatctttccagtaattcattttaattgtattttttaaagtattggtcctcaacaaaattggacactttataaagtggtcctcacctcaaatcatttgagaaacacggctcaaagcccttgctgccaattgacagacaggcttgtttgtgtttgttgttcatcctctgcctccccaactccaccgcccactccacgtggcaaggattcactgggctttgttcactgctgattccctgggcctcaatgtatatctggtgagtgaatgaatggataaatgaagcaatcaacctcaagtaggtctcataactttctggtcacttttgattattgaatctgcatccgccaggtgcggtggtgtgcacctgtagtcccagaacttgggaggctgaggcaagaggatcacttgaggccaggattttgaggctgcagtgagctctcatgacactagtgtactgcagcccaggcagaaaaccaacactttgtctctaaaaacaaaaataaagaaataaactcaatccaatgtccttcaaaacaccaactcacatctagtttaaatctcatcttctcctgaagccccacacctgcttccccactcagaacagccttgactcactgcttgccagcaaggtttgaggtttgaggaaagcacatctcacataggagcatgaacacccagtcatcctgctgaagaactacaaaaggacccctgcccactctttacctcctcccagtgcagcctctggaggggattgtgatctgtctcagtcacttgctccctcttcccccaacagccacctcctccaggatcagacgacagggggtggcttcaaggaggcagagatctttttaaaagactggacatcttctggtgtgaggaggggaagcaccaaggcctcactttctgaaggcctttgctgaagggccagtcactcctagcaggtggtgatgtctggcatggcccaggtggcccagtctgtcttggctctgcctgtcttcttaacctgggcagccctctggctcaagccttctcctccacccatctcttggcaacttctcaaaaccacagcagttgctggactattaaatcttccaaaagctggaaggaaccagcaaggtcttcctgaccttttcttattgggccctcccctccacggttctcaccctccctgccggtacacctgccccagctccaggcgaggagcagggttggcctctatgttcccagggaaacaagtctgggtgctcccatggtggcctccatgacatgggcctgtagatgctgtggcctgatgagtttctggagtggggcatgaatgccagtctctccttctagtgcctacaagtgattcttttgggccctcccccaacttgcatctgcagggcagcacacccttcctcccatgaggttttgtggcccccaggggactgagcctcagcttcctgcccagttccctttcctcatgtagagtaggaaggggtttggagcactgggtgttgggtagtagaggcagggccagttctgcctcctctcagaggccctgaaaaagacctcttccatgattctggtgactttcttcagactgtggcacctctttgtcctcagctttgaatgtgtggccaacagaagtccccctcaacaacctgccacatccagtcacacttggtgtcacattgagaaacttggcctttataggtgatggggtaggagggtgctgctaaaaacttcaaaccgggcaatggccagattgggttagaaagagctccctccaaaggcagcgtggcggccagcatggatgcagagacctcaccatccccagacaggcatctggcccctcctctggtcatgcccctccctacggaatgaggactctgcaaagccaaggggtctcgcctgccagaagcctgtgcccacctttgagaccacccatccctgccaacaaagtgtccagtttcagaattccccgccaaatggccctgagccacatccggcacctgcctgggcctctccagggtcagtcttcccaagggcagaccacagacattattcagcactccaggcccaagaagcggccaatggggggctatttgcagactgtgaacaggctggggcagccacacacgtgtgggtcagagccagggtgggccatgagccagaggcttccattttttctcttgccccagccctctagatgttacagtttagacctggggcagagacacctttaaaacactggcttcttcaccttggaatcacctggtgagctttaaaaactactaaagtctgggtcccaggttcccccgttctgagtttattggtccaaggtgagaagtgagttaggggcttaaagctccccaggttctcatgggcagccagggtcgagaggtgctgctgtagagacaatgccacggtccaggtcagagagaacaaagggagagaggagggtctgttctaggcagctgggagacaggctcctgcatgagtgagtggaggcagccatgatggaagagggagcgtgggaagcctctgtttggaggacagagctgcacatgtggggtttggggtgttttttgagatatccatggggagatgtctagcaggcaggtggatacatggcctggatctcagttcagatctctgggcctgaggtagagttggaattaccagcacataaatggtggctgaggctgtgaacttgactttgagccaagggcatgtgggccaagaggagaacatcagttgtactcccaaactccattctctgtctgtcgatccattcctccatcctaggccagagtcagtttagtagtagaggggcctccataatttgggggaccagagtccctaatcagttcgcctacagcaggatggttgtggggagaccttaacaacaatctgctcttctttccctcttgctccaccctcacaccccacccccacccccatccaccacctgccccaaccccatgcccttcctctcctttcctcctcccacctgcccccactttgctttgcctgtcccatctccctccttgacaccccctcccccaccccaaggtgaaggtctggttccagaaccgccgcaccaagcagaagaaagaccagagcagagacctggagaagcgggcgtcctcctcagcctccgaggcctttgccacctccaacattctgcggctgctggagcagggccggctgctctctgtgcccagggcccctagcctcctggcgctgacccctagcctgccaggcctacctgccagccacaggggcacctccttaggtgaccccaggaactcctccccacgcctcaacccgctgtcctcggcctcagcgtcccccccactgccgccccctctgccagctgtctgcttttcctcggccccgctcctggatctgcctgccggctacgaactgggttcctcggccttcgagccatacagctggctagaacggaaagtgggcagcgccagcagctgcaagaaagctaacacttaagactcccaccctgtgacactgagtcccgagcacagcaccttcccagtctcctgtgccccagcggacagcactgagcaggccccggagaggaggggctgcagccacacactcttccccacctgccccccagctcagagactcgtgaccaaatggccttggtcccgcagcttgtgtgcgtgagtgcagtgtgagtgtgtgtgtctctcactgaaataaaaggaaaacaatgacaagaagggaaatggtgcccacagcacaactacttacccctcaatcccttctatccctcttgtcactggaagggaaaatgggcttagagtcagagggacctcagatgggagagggcagaaactgggattctgggggtcaggggactcacatgtgtcggtcagcaggcacctgattcccactcaatagaagcccatggcaccaacacgaattctttggttaaatgttgccctttacaagctctctttcaaacataaaaatacttgagagagggaaacattgtcaccttgaagagggtgaatggtgaaaggggagaccaggttgagagagagggagagagagcatcaaagctaaacacaagcaagagtccagatgtttagagacggcctacccatcacaaactgcaacatgaaaccctttaaaatatctatacacagcctggccaacatggggaaactccatctctactcaaaatacaaaaattagctgggcatggtggcgggcgcctgtaatctcagccactcaggaggctgaagcaggagaatcgcttgaacccaggaggtggaggctgcagtgagccaagatcatgcctctgcatttcagcctgacaacagagggagactctgactcaaaaaaaaaaaaaaaaatatatatatatatacacacacacacacacacacacacacatacatattatatatatttcatattgctcaaacaatataaatttttttaaagttaaataagagtcttgctcaagactcttttatttaactttttattttgcagtaattatagatttacaggaagctgcagagataggacagagaagttccttccattggcaggaactcaatagtatgagacagataggcttcatcttccctaactatagtacaatatcaaaactaggaaattggcattggtaccgtgtgtgtgcatagtgccatgtcattttatagattcatggactcactgctgcaatccagatgcagacctgttccatcaccacagagatcttcctcatgctgctccttgatggtcacacccacccccgccctccacaggagagttctttgaaaggatgggcattaggaaccagagacctgaaatgggtcctcaggagggaggatgcggggtaagattttgactctgtgaagagaaataacaagcacagtctcctccagtctgctctgagaaacatagtagctgctgctttggtttcaaattggctgtcctgagtcacctggagtgggtgcttggggacagtgatccctaggcaaatgtacttctgccgttccctctgctcagtggtatggtttggggaggagcttagaaatgcagaaatcctgagcctagaatgaggcatgggggtgactagaagaccttgggttgggcaggtccagctaccacccagggtccaccctgccttgcccagaggaactgtaccacactccactcaccaggagaaaccacaactcttagtttcatgacatgaagagagagttcttgggaagcagtggtgaggtcttgggtggaacccaggccaggctgtgcacatagtttgatttataactccaggtatttagttatacaatacagggacctccattttactttctgacctgggctggaaaggtcagggcaggcctgctgtatagaaatctggaggtgaatgtgagaagatgagacacggttctatgatcagatggagagagaccagccctcattctcaagaactctcaatagtatgagacagacaggcttcaggagacccaggtctgtgggttgagacacaggctcagcttttgggggctcacagcccagtggcagggacaagagaggcctctcctaaagggcatgacttaggaaagaggctagatgtgtagtaaatcttggctgctagagaatccagagaaggcttcatgtaggagatggcactgaggctgaccaggaaataattctctacagatgttcaaaaagatgacgatggaattgtcagggggcagaagtatcc

SEQ ID NO: 16666 - DNA, 33551 bp, Human
cagcctggccaacatggggaaactccatctctactcaaaatacaaaaattagctgggcatggtggcgggcgcctgtaatctcagccactcaggaggctgaagcaggagaatcgcttgaacccaggaggtggaggctgcagtgagccaagatcatgcctctgcatttcagcctgacaacagagggagactctgactcaaaaaaaaaaaaaaaaatatatatatatatacacacacacacacacacacacacacatacatattatatatatttcatattgctcaaacaatataaatttttttaaagttaaataagagtcttgctcaagactcttttatttaactttttattttgcagtaattatagatttacaggaagctgcagagataggacagagaagttccttccattggcaggaactcaatagtatgagacagataggcttcatcttccctaactatagtacaatatcaaaactaggaaattggcattggtaccgtgtgtgtgcatagtgccatgtcattttatagattcatggactcactgctgcaatccagatgcagacctgttccatcaccacagagatcttcctcatgctgctccttgatggtcacacccacccccgccctccacaggagagttctttgaaaggatgggcattaggaaccagagacctgaaatgggtcctcaggagggaggatgcggggtaagattttgactctgtgaagagaaataacaagcacagtctcctccagtctgctctgagaaacatagtagctgctgctttggtttcaaattggctgtcctgagtcacctggagtgggtgcttggggacagtgatccctaggcaaatgtacttctgccgttccctctgctcagtggtatggtttggggaggagcttagaaatgcagaaatcctgagcctagaatgaggcatgggggtgactagaagaccttgggttgggcaggtccagctaccacccagggtccaccctgccttgcccagaggaactgtaccacactccactcaccaggagaaaccacaactcttagtttcatgacatgaagagagagttcttgggaagcagtggtgaggtcttgggtggaacccaggccaggctgtgcacatagtttgatttataactccaggtatttagttatacaatacagggacctccattttactttctgacctgggctggaaaggtcagggcaggcctgctgtatagaaatctggaggtgaatgtgagaagatgagacacggttctatgatcagatggagagagaccagccctcattctcaagaactctcaatagtatgagacagacaggcttcaggagacccaggtctgtgggttgagacacaggctcagcttttgggggctcacagcccagtggcagggacaagagaggcctctcctaaagggcatgacttaggaaagaggctagatgtgtagtaaatcttggctgctagagaatccagagaaggcttcatgtaggagatggcactgaggctgaccaggaaataattctctacagatgttcaaaaagatgacgatggaattgtcagggggcagaagtatccaggtatagtcagggcaaggagtgcagggtaaggtcaggttgcgagaacagtgaagaaagggcagcctgccagaagttgggtgtggagagaccagaaagagctgtggtgagggacgagtgtgggaatgttgacagcacctgatggtccaggggaggaattgaattcatacagtttggggttggcggggaggaaccgcctagcacagaagaaggaaaaagccagccctcccctcttcccttctccctccacatcctccagctctcaggtgacgggggcccctcccagacctgcacagcttggtgtggggaaagcttgggagccagagccccaggcttccttgtttactgtcaacctagaggaggaggagagggaggggagggggagaggggaggggtggctgcaggggaaggctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcagtgagtagcccctccaccgtgacgggtgaggtcagggtggggagctggggtgggctgccaggttcccgggccccgcttcttgcctcagaaaaggaggaggacccaagacctggggagacctggagggctctctgtccagcagagtgacgcagtggggccacctggaccagaggccacctctgcaggtgaagggttgcaggtccccagcccagcccaccccagaagagagggctggggagtagctgtcatcagcccaatcctgctgtaacacccgaagtccagagatagcttccagttgcccctgagagtggggtgtgctgtgcacctgctcttgtgtaaacgtgcctgtgtgaggagtgtgcacccaagcactcagagtcaggcggggtgtgattaagtgtacttggagtggtgtgtgtggcagtgcagagtgtcagcgctctcagcctgaggaaataggtgccccgtgtgcgtcacatcaatgggtgcatgtcgtatgtgtgttctgaggagggtgcctgtgtgcataagcaggtaggagcatgtgcctagggggtgctcccaccttcacttggggtaaggaaatgtgtgactgcatgcttatgcactcagggcaaaggtgtgtgtgtgtgcacttaggtgtgatgtacgtgtgtgcatgtgcactcatggagagaacacttgtgtatgtgttctggcagtgtcacatatctgagtatggtgagtgtgtgtacagctgggataagaatgcgtatccaggtgtggggcatggaagtgtctacaggtgctgggatgtacccttgtcaatttcagaggggaggccctacttgtggctcctgtgcctgtcctgcaagggtggcccagatgtctggggcaaggtccagaggaccaaagggaacccctgcatctccttgtccaaggtcactctccctggcctggtgaattctcaggccgccctgctcactggagtaaaccagcatggcccgccacagctatgcaaagccagaggctcactggagtaaaccagcatggcccgccacagctatgcagagccagaggctcactggagtaaaccagcatggcccgccacagctatgcagagccagaggctcctaacagggagtgtggtgtgaggggaagtgagcctgatgcagccaccccacctccctctgttcctctgttgctatccaggccaggagaggaggtggagtgaactcagagggtagctgaggggtgaaatcagagtaaaggggcccgggggcgcatgggaggagagccctggggtgtggggcacctcctgaggcctgaggcaggtgctgagggtggagcacattccagctaagaagaaatggtgagaatggggtgggtcagatttctcaagcaaggcctgtaggccctgccccatggagctcgggggaggataggaggtccggatactccctaggccaaagctagggtcaccaaggcccagaaatatgcagtgactgggcccccttgggtccagagcccaggcctggagccctgagctggcatgtgtgactcttgccagtctgttgtgatgagccccactccctgcaggccgtccctcctccctgcaggcacccgggagttgctgggtgctgagtgtggtgtgtgatctgcaccttcatgctctgctttccttcttcctggaaagtgcccccacctcctgatacccagggaccctataggtaccatctaaccccacactcctctgggcaggttggcccaagcctggagccacctccagccagctctttcccacccagccccttatgtatagtcaacatgccctggaggttctgacccaggctggaacccagggatggctgtgcccgccccccatgtttgcatgcttccctcgatgctggctctatatggcctccacccaggagaatgtgttcacaccaaacaacccaacagtggacccagagcaaaggtcagtgcaggggagcccctctaggctctgctccctgccagcgcctttacttttgctgcctatcaagtatcctcacaggatgcaccgggccagcctcagcccagcccagatgccctcccacccccaggggaaggctgggattccttggtgtgtcccttcatccacagtgtctcccaatcccctccccgcctcactcacttcctcctcaggctctgggagtgggagggatgaggggggtggttctccctggggcctgtggacaggcgcagggctggcaagggtttggaaatttagggctgcaccctcagtacgccagaggcagggccactctgtccctctccacctgtctcctccccagcctggcctcctaccctgggtctgtaagcactcccagacaggagaactctgggagaaaagctgggggtgcctaagggcagggaggccccagtgctcgctgggccacggtggaggtgagtccaggtgacttaggcattcccctcccccgggggaggtgggctaaagaggcctgagactttaaggctgatttcactgcagtggctgagagaggattggctagaaaggaggagacactagaaagagtggaggcagcctggggagctgaccctgccaacatctaccttgggaaagaagggtcccctgtgcctcccgtggagctagaatggttccccaagggccttggctcccggctggggaggaggtatcctggagcttcatctgtttgggcagaagatgttgggcttggagggtggaggtgcccagcaggagcaaaggtcaggaaggacaagctggcagcctggttggagggatgaagccaggtcagatccctgaagatcccccaggagcttgagtgccaaaccactgtctttgcctccccacctcggtttcctcaactggaaggggaaggagttacacggagagagtcccaacaagcagggtcttgggctgaagagccctcagcttccagcccctgccctccctcctctaatccctccagcgggatcagggaggaggtgcgggacctgctgccccgggcttgcccccatcccggcctcacgcatgggcgcctgtctcagccctctcccaggacgctgcaggtgtggctgggccagcgctaattagtgggccgcgcgggggccccgctgagcctttgacagaaaaggcggtagggaggtgggggcagggaggcgctccaccagccagaagtccggagcgcaacccaaagtgtcagctaagacaatggagagggggtgggccgggcagctggagggagtgtctgcaaagtctctggaaggcccatggaaggagcgccctttgggtcttctgatccagccctctgcctgtggcaatgcacccgcttccctctccagggtcaaggcgaacatcccagggttgcagagtgggccataatcgctgagcgctgcaggataccgtcttgaactgtggtgcgtcctgccagaaactagcccactttctgggcctcgttttgccactccatgcaagggacacacggaggtaggggcggcagtgtacaaacaaaaggaccggcttgcggtcaaggacacctctgttgctcagcccccattttggctgtgtccaaaccaaacagcctagaagaaaagatcaggctggcttaacaggggagaggcagagctctaagacgtctgacgggagagacatccctctagggtcccagtctgtagtaccgtgggacagcagtggggagaggacccagtgggctgcagtagtcagtcaagggcaaggccttgaaggatgggcatagtccaatgctgaacagaaacagccgcctaagtggattatctgcaatgatgggtccaggccatgaagcgatgtgttcacccagagccaggcctggaggctgcgagaagcccaggaaggcaactcacagctgaggctgatgtgctaagatgttgagcttcgatatctcaccccggtcacccgagcggcctggccggggaaggcatctgactcccagaggacctgcagcaagcactttgcagctgcctctaggccccttccagcccagcccttcctcctgagggaagggctgtgtggatcccctaatcctctgtcccccactctgctgctgcccccactcccaggtggagttgctggatgtcagggctaatggggattctacatgacaggggctgtgaagtgggggagcagctgtgaaggaagggaggaagttgaaagacttgtctcctgaggcagtggaattagaaatgattccctggacttttctggtccttgggccccatcccctcccacacccccacctccctatccagcccacccaccctgcatctttacatcactgctttcttcccccagcgcagccctttggcaggtgtggcatgcaagatgccagctctcccgggggcttataaaaatgagggtctctcctgcctgccctgcatccctttgcttgcacaatccactagcaatccagacaatctgatccaaacaccatgtgggtgtgggagtgctgtggctgtttggagttttttttaattgatgggaagggtaatgcccaagcctctgtctcctaccctttctcgttgaggagtcttcctatgcccaacagccccttagcccagtacatcctctttctcttctactctctgccttctcaggaagtatggctggtgctaggggtgcaaccctttaggctggtcaatgggactctcatttggtttggaggcttgggaaggtcgggagggggcacacaatggttctgatgtgggaagtatgagaaggagcagatggggtcagttaacacctttcataatccatccacaaagatttctttttcttctttttttcttttttctttttctttttcttttttttttttttttgagacaggatcttactctgtcacccaggctggagtgcaataatagcatgatcagagctcaccgcagcctcaacctccctgggctcaggtgatcctcccacctcagcctcctgagagctgggaccacaggcacgttccaccatgcccagctaatttttaaatttttctgtagagacgaggcttcaccatattgcccaggctggtctcgaactcctgggctcaagtgatccacccacctcagcctcccagagtgctgggattacaggtgtgagccactgtagctgtccaaatatttcttgagtgtgtaccatattcccagcactattccatgaagtgggacacaacgatgagcaccacagatgatgtcttgccctcctggaggtgacaggtcttactgcacctgaagcgagcctgtgcatgccagcccactgcccctctttctgttccacgaaggccctggatgagtcctttctctcctctgccagaagtgccctttccccagctccctgggggctggcaccccttgaccctgaaggctcagctcaaacggcccttcccataagatgcttcctccaagcgcacccagtctggtcttccctcccactctcgttcacccatcctgatctttcccttaggagcacccactgcagtttgtaattatgttatttgctctgtatccttcttttagcctgtaggcacttcacattttcatttgtcactttcatttgcctagcttagtacatagaaggcatccatgcagtagatatgcttgaagaaaggaagcagggagggaaggaagaaggcagatctcagaggaaaggagaggaagaagtggagagccaggccaaacctcgaagtcctccagcacccaaaggtctgagagcgaggagtgtgagtcttcagaggaggctgacaggcggccccagagggaagcttccaaaggacagtgcacccaggctctgagtgtagccatcggaggccactgaagccagagtggagaaggccaaggagagggtggaaggtggggaaggaaagccagcagtggggggccatgcttgtgaggggaggaactggagaaggactgggactgagcgaggtttattttgtactggaaacatcagagcttcatgggaagacaagagagggagagagagacagagagagaggcaaggaggctctggtccttcaccccatggagtcatctctagggcctgtttcccggtgcaggggaaggacccactatgaaggaagcagggacacctccttagtgggaataggaaggaagaagagggtggctcaggtgcaggccaggcaggtctgtaaggtaggtttgaaggcagggagctgagggagatcccctgctctggcaaagtgcaagttgaacttatcttctctggctgtcctcaaggcccggagttttccaaatggttgttacacttggaggatccttataaaaatctgtgcaagaatcaccgtgcccagttgatcttcctagtccaagtcctggtgaaaagagcttagatcaaacaaaaagaagaagcttgaccacacatatccagactgggaaggggagggacttttggtttttctttggcatggggtggctcggggccaggcttgcccaaagcaagagggtaagtgaactgagaaccagtgtggtccagcaagaagcacagggtgggttcccagccccagctctgctacagatgtgctgtgtggccctgggcaaggcttctcacacttctgggccccattttccttgcctgtgaaagaggggttgggccactcccctctgcatcctgccagcctgtggctgacccagaggcctcacagaccccctgcccaccttgccaaatgccttcatctcaggtgtctcatctcattggtgcatcacaagaacctcagagaagggcactggtcaggactatgggcaagggactgtcccaggtctctcagccagcctctagcagaaccaaaactaggcttgcctcccgcaagtccacagcttcttctatgggagttaggaagtattttttggcatctaacccaattccctctgcaagctgagctcatttgccatgtgtgggtctctgcagctgccacatctgcaggcatttccctccttcccttgccttttcactccctcccctcccatgctgagcacccagtgagcctggggagtccaggaaccttgtgatgagagcagaggccccgtctggtttttctcactgacgtctgcaccccctacacaccacatacacacacacacacacactgctcaatcagtgtggggtgaatggagggaaatgcagtcctggtgagggcagaggagggcacttttcggccacagccgggggccaggagcttttggaaaatgcttggagtgagagaggagggagtgggtgaggtgggggttgaagccagaggggaagcagcctcagggatgagaggcctctgtgtggtgggggcggactctgaggaggcctctgccctctgcctggccctcccccagcctcctgcaggtgtccgagcagcaggggccctgcgggcaggggcatgacccttacagcaatggtggctggccctgtcacagctaatgaccctgacggcccaggctgggaaggaggtggggtgtggagagaggaagggaaggcagaggatgcctctgtgtgtgtgagcagggtgtttggggtgagacccctactcacccccgcccctcccccagcctacaggactgtgtgcagcgtgaacgggcccctggtggtgctggaccgggtcaaggtaagactcttctgctgcctccctggcactaaggccaaatcccagggcgcctctcccctgccctgcaggatttcttctaaattaccctttccctccatggcccccagggcctgctctgttctctccatccaggcacccactcccactctccttccctagctgtatccccagccgtccaagctttctcctccctgccttttcagtaaaaaccataaaaaccccatggaggcccagccctgggccttgggaaacctcctactatccctaacaagctgtcctgcctccgtttccctatcagtggcatggacgtacctaacctcctcagaggaaggctggaccacagcacggctgtacctaacctcctcgagggctagactctccccaccctcgactctcacaggatcttcttttaacgggaaagaggaggaggtggcaagtcaatgccaactaaattttctagggatcttgatggcctccaaaggcctttggaatatctcagtctcagcaacatgggtggtaagtgaagtgggccccaccaaaggtaagtgggctgtgggctattttgtagcccctgggaaactggcagacactgacagtatcttgagtcctggggttgggaattcttgagccataaagagccctgcaaaggtacaagatcactctcttatcctccctccaccaaccagccccactccctcagcgtcccaccccacctcctagctgagcaaactggaagtctcggtgcccctttgacccctcttgtcccagaccccacacctgccagcgcccatgtctgtagctccctcccaccccactgctaccttgtgatggcgatggccttgggctcccagcctggcaccctcctatcctgtctccatcctccagcccttcagacctgacccttgcatcaaatttgcccagggctctccagtgccctcagcttacaggtcttttcttttttttttttttttttgagacggagtctcactctgtcccccaggctggagtgcagtggcgcaatctcggctcactgcaagctccgccctccaggttcacgctattctcctgcctcagcctcccaagtagctgggactacaggcacccgctaccacgcccagctgattatttgttttttagtagagacggggtttccccgtgttagccaggatggtctcaatctcttgacctggtgatccgcccgcctcggcctcccaaagtgctgggattacaggcgtgagccaccgtgcccagctgcttacaggtcttttctatgagggtgcctgcaagcctttccactcactctcatcactctcccttccctgtgtagaaaccaacacctgaaatagtgtctgcatggggctgccatttgagatctctgggcacttgcatgtcattttttaaaaatgtgatcagtaatgtatgtttattaacaaattaaattacgagatgtcaccgccagtttcactgctataattttaaagcagtgatgagcacaaatactattttgagatacctgcaacgactgtaatgtggtatgaaaatatctgtgatttctgatggtaacaaagtcacaggtaccgtggaaatgctaattctaccgtggtttgttccttacattcagaactagaggaaacactaaatttgcgtaaacgttaatgaatgtaaaaatgtaactttcccattcaagatcacagaagccctgagttctctctgtagactctgagataggttctaggcaaagaacccttctcacaattagttggacaagaggatagagtatgtagaaaggaatgacaaagaatgggggattgtgtctgtgcattttataatagacacacaataattgtacatattcctgaggtacacagtgatgttttgatacatataatgcatagtgatcaggtcagggcaattagcatatccatcatctccagcatcctttctttgtgttgggaatattagtatcctctttctggctatttgaagagatatatatatatatatatatatatatatatatatatatatagttgttaactacagtcatcctattgtggtatagaacactagaacttattgctcctggctagctgtaattttgtgcacagatttttccctctgcctcctagactacacttccccctattccctccctctgactcatccccagggttgagaggtcaccttctcctggatgcctctccctcttctctactttttgtggttttattagtggcatccactgaggtatttggtcaagatctggccatgtatctcctccctacccttccccacacacaccgtgccctgctattggccatgaactgtgttttgttcatcttcagctccagaagcccaacacagcatttttactgaacacataggctatagtaggtgctcagcatgtttgctcaaaggaaaggtgagtacattaatgagataaatgaatgaataaatgttagcatgactagctatgcacctgtcaaaacctgagccaacaatattaaataaatcagacccattctttgctaacaaacagattctgagttcatacggacattaccacttgaccccccagtgtaagggacgccccaggaggaagtgtggctgagtagttaagtgcagcacactgggtttggattttaatcccagatccatcccactcttttctgctagctacatgccaaccctagatcaacagcattagcactgcccaggaacgtgttagaaatacaaattcttgggctccacctcagactgacagaatcagaagctctgggggtagggcccagaagtctgtcctcacaagccttccaggtgaactgatgctcaagttagagaaccatcaatctcggattgtaaatcccagtttcctcatctattaaataataataggattattgtgaggttcacatcagacaaatgtagtattattctcccttgagaatagccagcaatgtttctgcctggaatgcagaaatgctaataagcctgattcaacagttggtgccacctcctgccccctctccacctccaccacactctccaccagacctgccattctccatgggacccagtgtggcatggagtcggaacctatacaggtgtccattttctccactgtaaaatgaggccgatctaggaaaccagaactaggtccccagacctgtggttttgcgactatcggatgcatctgtagctttggcagagaaaaataattgggtggtggaggcacctctccccatccctctccgttgcccctacccctttccctctaccaggatttggcaaatgctacaattctgtttctacagcgccaccttctgcccacattgaatcacacaggcaattactcttcctgcttccgtcctcaaatgtaagaacatttgagggaagaattttgtgtagatcagaggttcttagcccaaggaattaggcccttgaaattgtgtgcagacctttgaaggtatgcatgaatgtgcctgtgcatttttctggtaggagtttctacagtttcgtctgatttttcagggttcgtgacccagaaaagtctaactctctgatttgtataagttgaacaagcatcagaatatcaggggtgcagggggcttgttaacaggcagattgctaggccccaccccagagctctgattcagcatgcctggggtaggaggcccaagaatgtacatttctatcaagttcctaggtgatgctgctggtatggggaccacacggagaacctctgttctagagaatcttctgactcctgtagtctgtgattcaaattggtccctgtttgagaattggagtaagcactcaccttaaccaccagactccatccccaatgtctgtggctgctttcaaaagagtctgcatcagctctgaagacaatttccaaagaggagcctccgcactgccctggccattgtcagcaggagggaccttagaggcagcattcctgtgcacaaatcccgacaggcttgctaagaacttccagtcctccgtgtgtagacagcagctcccctgtgcctggccacttgctggttgagagctcagttgaatctccagcacggggttacattgcactgagtcatgccctcttcctgcagccctcttagtaaccgacatcaaccgagttgatgggatcaggcctgctcagtatgcggctgggaaatagggccccttaagatacaagctcctggactagctatcccccacgggaattctcccaggtacccactgccataactggtcatgagatcccaccaccaacaacaataacgacgaacatccagcacacacttagagcctggggctcttcctaaaggttccagacactacaccctccatgcctgagtgtgaaaacctgatggcccttccccagatctgaccacaatttctgccatttaaagttcattttctctgattttgtccttcagggacacagaacgcaccactctcctctccactctcctctcctgccaccctccctctctcacccacataaactcacatgaaaatgatcactttttttttttctttttgagacggagtcttgctctgtcgccaggctgaagtgcaatggcacgatctctgctcactgcatccttcttctcccgggttcaagcgattttcctgcctcagcctcccgagtagctaggactacagaaaatgatcacttttaaatcactccaccgcctgatttctttggggcacactctggcctgtgttctgtacagcaacttttcccctgaggttgaaacagccctccgtcacctccagggagatgacaaataatgaggcagggcccgtttcgtatcgaaacacaggttatcagagtgggagaggaaaacgagccgggacgtgtgttccacgcgtttcccaggccctcgctgtccgtgctcctgggctccctcttgtggttgagaacccaagacgcctgggtgttcggagctcctcccacctcggagccctcctccccggccggcctagtgctgaggcccccactccgcaaggctgaggggtggtttggggaaccacaggtcaccttcctggcatcctcttcacaggacaagggaggactcaaggtagcgctcccttccgtgtgattgtcagggctgcaaacctagtctcaagttcgaccagcaggggttccctggcggagtggtccctacttggtcacaccttgctggggaattggaccctccgccccaacccgcaagcccttaaggtcactagtttgtggccagtaggtgatataacgatagtaatgatgatgataatcaccagcactgtgctgtaacatgtcctaaaaatgtattatattttaattgcaaaaataatacatgctccttgtaacttagtgaaaaagaggaaagacacgtaaagttaactatctgcccctaaccgctttattctcagccccgaaagaccctgctgaatacgctcaaacacaggcaaatatgttagaggttgacctcggggtcagtcccttgagagccaagggactgacagtggatccactgacagtgtcagcggatacacattttacgcattcttttggatactggcatagcaggcgatagtatggatgtactgtaacttactcaatagtcccattattgacagacattcgtatgttctcaggttttgccattacaaatagtacaatattgtatcccttttaaacggacgcttttgtggttataggatagattcccagaagtggaattgctggttcaagtacttttttatttcaaattagatattgacaatttggggcaagatggcttgcccagaagggttgtggtaattcatatttccaccaaccaggtatgagaggacccacttccccacatccttgctggccctgaatatgttctctctgtagttttacctatctaataaatgaaaactagtactgtctcgcttttatttacatttctctgataactaggaaagttgagtgtctgtccatatgtttaccattttgattttgcttccttctccgtgaaatcttcctaccaagcaagttgtgcatacgggagctccttgtttattgctcacaggctatcttttgcaacaataaatgaaacaaagatttcatctattgtgtctctgccatacagaagtttgaaatactcatatgatcaaatattttttgtttataccttctgaatttcttgtcttgcttaaagacattgctcatctgtcttttaattggattattcagaaagataggaaagaagaaaagctcttccagtattttttaaaaattgtttttactttatatttaaattttttttacatgcctggaatgtatttgggtttatgatgtggttatcttctaactagatatcctcttatgttctatatattatttcccctctgagaattaattaatatacaacatttgttctataatagtcctataaaatctgggatctccttctggactttttttctttcctactgatccatttgtctacctcatatcaatttactgcttgacttcagtagctttataacaagttttaatatctgaaaaggcaagtcctctatctctgatctttttcataactactttggctattctcagacatttatgtgaactttaaaataattttattaaattttaaaataaacaataatccattagggttggatcaaatttatatacttttcaaaaggattaatgtttttatgctagtaactaagaacattaagacaataatgttcttcattgtttaggacttgttttatgttattccataatttttttttgtacctttcttgttatatttatttctagctattttatgagttttggccctattgcagatgggatggttttctccgttgcctcttctaactggttactactaaaatagaaaaaaaaggagggggggaatgatttttaaatatttatcttataaacagccaaattatcttattcattctaaaaccttctttctaaaccagaacctcttgagtctttctaaatgtataatataatctgcaaataaagggaattatgtctctttttccgtcagtatacttttactttactttttattttgaaacaatttcaattttataaaaatttgcaaagataaaaatagtagtaggaacatccatgtcaccaacggttaatatattatttcatttgctctatcatttgctctccatgtgtgactgtgtgtgcataattttttcctgatttttttttttttttttttttttttttgagacggaatttcactcttgttgcccaggctggagtgcagtggcaaaatcttggctcactgcaacctccagctccccggttcaagcgattcttctgcctcagcctcccgagaagctgagattacaggcgccctctaccacgcctggctaatttttgtatttttagtagagacagggtttcaccattttgaccaggctggtctcgaacttctgacctcaggtgatctgcccgcctcggcctcccaaagtgcagggattacaggcatgatccactgcgcccggccttcctgaatcttttgagggtacgctaagctcaagtacttcagtgtatatttcctaagaattaagatattcttttatataactacagtagagctatcaacttctgaaatttatactgatacaatactttaatctaccatccacattccaatttatcagtttacctgatatcgggtaagctgataaattggaatgtagcattttttttttcactccagtataggatccagtctagggtcaggtattgcatttgtcatgtctgtctagcttcctataatctggaacattttcccacagcccttctttgacttcccacagcctttctttgacatttttgaagaatacagtcaccttcaaccaccacctttaaaaaaatagaacactcggccaggcgcggtggctcatgcctgtaatcccagcacttcaggacgccgaggcaggcaggtcaggagttcgagaccagcctgaccaacatggagaaaccccatctctactaaaaatacaaaacattagctgggtgtggtggcacatgcctgtaatcccagatacttgggaggctgaggtaggagaatcgcttgaacccaggaggcagaggttgcagtgagccaagatcgcaccattgcactccagcctgggcaacgagtgaaactctgtcttaaaaaaaaaagataaataaaaataaatagaacattctctgtttatgtttaattttcttttttctttttctggtcttactgtataaacaaaaacttccaaaacaatgttaggtaacaattataatataggcatctctgttactgattttcattggaaatgaaagtaacgttagcattttaccatgtacaaggatgttgatgttggttttggttaatagtttagtgttcaagtagttgccttccattcctgttttatatagaattgtattagaaacagatgcttggccaggcacagtagctcacgcctgtaatcccagcactttgggagaccaaggtgggcagatcacctgaggtcaggagttggagaccagcctggccaacatggtgaaaccccatctctactaaaaatacaaaaaatcagccgggcgtgatggcgcacacctgtaatcccagctacttgagaggctgaagaaggagaattgcttgatcctgggaggcgcaggttgcagtgagccgagatctcgccattgcattccagcctgggggacagagtaagactctgtctcaaaaaaaaaaaaaaccacacataaaacagatgctgaattttatcagaagccttttggcttctatttacataatcttataggattcttttttaatctatgttgacgaactctctattattatgaattttgttatcaaatattgacaaattccctaaagttgattgctctagtcttgcattcttggattaaatcctacttggtcatacatgtttatttaatgcactgcttgattagactaataatttatttctgcatctatattaataagaaatattgatctatagttttccttttggctctatctttaatgtatttgggaattgggggctttctatttggtagttgtttccttctaattgttattcattttattttattagcttagctagttcctcccgtacaaggctgaatagaatgagaatagcagggattcttgctttgctcctaattttaaacggaatgctttatgcatcgtatcattgaatatcatatttttctgtagggtttgtttgtttgtttgttttttgttgagacagggtccctctctgtcacccagtgcagtggtgcaatctcagctcactgcaacctctgcctcctgggttcaagtgattctcctgcctcagcttccccagtagctgggattacaggcacccactaccacacctggctaattttgtatttttagtagagatggggtttcaccacgttggccaggctggtctcaaactcctgacctcaagcgatctgcccacctcagcctcctaaaatgctggggttaaaggtgtgagccactacacccagcctatgtagggttttttgaggatattctttttggagttaagaaatttcccttttatttcctgttttcaaagagtacttttgttcttttttgttttggttttaatcatggatgggtttttttgacttttttcaaaatgtttttaggtgttcatagtttttaatcttttaatttgttaataaggtgaattacatgaatagattttctcatattagactagccttacttccctaaaataatcccaacttggtcttttaaaatttctgtttatgtgtatatgtttatcttcatttcttttctttactattttggcttataacttggtcttttttatacattgctagattgggttaatattttgttaggatttgtgcatccatgttcacgagtgagattgcctacaagtttcccataattattttattttggtatcaaggctataattgcctcataaaatgagttaaatacagtaccttctcttcctggctttgaagagcttaagtttcaaattatttattccttgactgttagaactcactggtaaaactatctgggattgctatttaatatcttaaagatttcaggattattctggctttcaatatcattttcagttggttctggtttgagttatatttattcatgttatctaatttctcaaatgtgttgcataaaattgttcatagttcatctttttaatattatcagtttatctagttgtgaatttatcccaacaattatttattcatgcctttcttatttcttaatctgtgttgccagcaatttgtctactttattcagcttttcaaaaaaccaattggctttgttggtcttctctattctatatttgttttctgttttaataatttctcctcttatttcctctactttctttggggttttaatgctgttcttttttctgacttctcacattgcatacttttagcttcttcaacatttttcttatctaatataatcatttaaagctttgaatgcatcacacatatattgacatacagcttttcactattatgggagcgaaatgttttctagttctgattataaatgcttctatagctagaatgcttttctttccaaatgtaagaggtatttctaaccatttttttgctgttgttattgatttctaacttacttttatggtcagagaatatggcacagctttatatctttcataggtaatggcacaaaatcatgacctcctcattcttttccagataatctgttatttcagttttgattgcctctaatgacaaggagtaattcagaagcgtgctttaatttctcagaatattaggaatttgggaggaaagtgttgtctttttaccatcaatattttgtttgtttgttgttttgggtttttgtttggtttggttttgtttttcatagagatgggtctcgctgtgttgcccaggctgatctcaacctcctaggttcaagtgatcctctcacctcagcctcccaaagtgctgggattacaggcgtgagccactgtgcctggccccattaattttagttggattatgattatggcttactccctggtaaatcagcgacctgggaagtgaggtgaggagcctaggggatgcaatgcgtttgctccaggactttttccgggaagaaggtgcaggtatggggcttagatctcttggtgctgatgacagctgacgatgagtgtcaatggggatggtgtgctctgctagcccagcttcccaggccaagtctgtgacctcctctagctgtgggtaaagactgggacttggtggctcccagagcgtgcacagacagcagagctcagggattccccggggcaaagctctacctgcccatgtgctgcctgtggtcctggaggaacagcctgatggtttgttggtttggtttttggtttggtttggtttggttttctgagatagggtttcactctgtcacccaggctgacgtgggacatgatcacgcagtggcatgcagtggcatgatcatggctcattgcaagttcgacctcctgggctcaagtgatcttcctttctcagctacctgagtatctgggaccctgatgtgttataaaaattgaaatataactcacatactgttaattcagtagcttttagtatattcacagttatgcaaacatcatcataataaaattccaaaacattgtcatcacctcaaaaagaaacctcatgcccattagtcctcactccagtcctccctctcccagcccctgagcaccaactaatctactttctgtctttatggaattgcctattctggacattttctattaatagaactgtgtaatatgtggcctgctgtgcctgacttttttcacttagcataatattttcaaggttcattcatgttgcggcatctatcagtgcttcttttttttaatgaattggcatatttgtttatttctcaattcgtgaaaatgtccttaatttgttgatgtagcaaacaaatttcaactctgctaggcaaaaaaacaaatccgctttgcagtgaacttcatataattcaactgcatacaggcaacacactatatatgaaaaaagttactaactgaattatgggtattaactactgaaaagagttaacagtttattataattttttttttcacaatctaggaagctggcagccagcagcagttctaacacaatttcgggtgctattgggaattcgggaatcttggtggagctgttactgtagtgaaacttgttcgcaaaatacaagcatacttttactagcacatgtgaaggaatctctctaaaattgacctcattggttttgttctcagcaaactgatctgggccattcaacatagtttttattgtgcctggtgttgatgcctgttctctttttacaatacattcatgaccattggatgatatcaatttgacatacatggcatcagggacttcatagccaccataggttttctcctctccatccattttgttcttatgaaatcctcctttgcttcccaaggaacttgagaagtttttcattagccccacagccaccatagccgggtccccatgtactgccatagccccattccagggctgccccctgacccggctgcctgcccccatgggttccagggcagtcccttcctttttaatgctgaatgatattctattgtatgaatacatcatattttgtttatccattcatcagttgatggacattgagttattttcacttttggctattatgaatattgccagactgctttccaaagtggctgcactattttctattcctcccagcactgtatgagcattcaaatttcttcacatcctcaacacttgttattattattttattttatttttttgagacggagtctttctctgttggccaggctggagtacagttgcatgatcttggctcactgcaacctctgccttcctggctcaagggattctcctgcctcagcctcccaagcaggtgcccgccaccatgcctgactaatttttgtatttttgtagagacagggtttcaccatgttccccaggctgatctcaaactccttatgtgatccacatgcctcagcctcccaaagtgctgggattacaggcatgaaccaccttgcctggcctatcttttttattatagccatcctagagtgtgtgaagtggcatctatctcattgtggttttgattttcgtttccctaataactattgatgttgagtatcttatcttgtggctattggccatttgtatgtcgtctttgtagaaatgttttttcaaatcctttgatcaaatccttttgattattatggtttaaaagttcttcttcttttttttttttttttttggatggagtctcactctatcacccaggctggagtgcagtggcgtgatgtcggctcactgcaacctctgcctcctgggttcagtgattctcctgcctcatccttccaagtagctgggactacaggtgtgcaccaccacacctggcaatatatatatatatatatagcattttcagtagaaacggggtttcaccatgttgcccaggctggtctcaaactcctgatctcaagtgatccgcccacctcggcctcccaaattgctgggattacaggcatgagccaccacacccagcctgagttctgtatatattctggatattagcctgatttttaaaatccttgatccctggaaggactgcgtgagtcaattctagtcccatgccactggtatcgaaggacgcctgagcagagggaagcactttgcgagtgtgtttacccctagtccacagaggcagaaacagatatgctgtccaggatcccgaggcagcccagtcattattacatctttattgaggttttacaaagtgccaggcaccatgctaatggatctgcatatgttatctcatttcctccctgcagcagccgtgggaagtaggtgttattattatccacattttaaagacgaggaaactaaacctcattacttatgacttacgtatttaatgagttactgaaatcgtaaagtaacttccacaaggtcaggcagctactaagcttcagagtttcagctgtaacctggtcttgcaactctgaagtgggtgcaactgcctcccaaacagaattcaaactttcacttcccagccccttgagttcatttccacaagtgtctggacactagaggggagagaacagtttgggactgggtcagggagggccggaggaggagaagggactttgcctccagtctcactgtcacgtggctgctctcccctcctgccagtttgcccagtatgcggagatcgtccacttcaccctcccagatgggactcagaggagcgggcaggtgcttgaggtggctggcaccaaggcgattgttcaggtgagtggggtcaatgggacattggctagttaaatcaatgaattaacccataaagttcccacactatctacaaactctgaaggcaggaaatggtctatttccctgagagcacagaaagtgcccagaatgggtagccccattccctccagcaggccccttagtggagaaactccctcttgttcccacaggtgtttgaagggacatcagggatcgatgccaggaagaccacttgcgaatttacaggggacatcctacgaactccggtgtcagaggacatgctgggtgagggacagggaggggcaggggtgggggtgctcctctgccctcccagcccagcttctctgaccaaaccctcagcacactacactgtcacttcctgtttacttcctgcctgtctctctggtgggctctttgaggtctggggtatgtcttctctctgattcctgaccccagctcagggtctgacatacaggtgttcaataaatgaggaaggtgggttcaataaactagagacacagtaggtagccacctatttggagccaggctgaaagggactgctaagccttgaatatcccctaattctctcccaagacctggcctggccctctcctctctctagtcctggaatcccccattagagtcatggtcctgggccaaggccttgcctgtaaaggtttccaggagaggaaggaagactctcacaggacagtccttgtagctggctctctgggttacctgtgggctgccggggagggggatacagggcactcctgtggggagtgggtgggagctggtggtggtgtggagggtagacagtagtgagggacacagggctagcctgagcaccctgcaacactcctcgtccaccctcaggtcgggttttcaatggctccggcaagcccattgacaaggggccagtggtcatggcggaggactttctggatatcaatggtgagtgactggaggttctggatggcttcgggacccagccctaacaccttccccactcttggaagttctgcccagactcacaagcagatcagatgtgatgggagagcagcaaaggcctctctatccccaaatcttccactgaaccccaacactgccgtcagcactccatgtccatcccctgtaaaatgccatcatcattgggcagtgttccacgcctgcccgaaggccatcatgcccctgcctttggcttcctgtccacaatcctgagaatgggctgcggtgctctgccggctctcgtccattcaagtgggcaccttccccaggcctcaaaccctatcccatctgtttactgaggacacactgggaggcctgtgggagcccgtggcttgccctacgccacacagaaagtcagtggcagagcacagaagactcatctgctcagacaggaggctgagtcacccgcaggccctctgaaccctgcactagtatctggaggtggtgatgagggctctgccctcttgggccctgaagcctcagcctgagtttccacctgcctgccacttccaaagcacaagggcagctctgtccaaggtagcactgggcctgtggctatttaaatttaaactaattcaaacagaaagaaagtcccatttcagagtcacacgtcatgtgctcaatagccatttgtatctagggctacatcaggcagcacggccagagcacgtttctatcatcacagaaagttccgtcaaacagggcggctctggagtctggggtcagtgtcgaggagagcagggaagggtttgaacccctgagcatggctctgtgatcgccctctcccaggccagcccatcaacccgcactcccgcatctaccccgaggagatgattcagacgggcatttctcctattgacgtcatgaacagcattgcccgcggccagaagatccccatcttctcagcagccgggctcccccacaatgaggtgaggcctgcagggccagcaggcatggctgggggagggacagagcagaggctggggctgctggaccagtgaggacagctcctgtgccaagcaggcaggggctggcagggctggggtcgccagcatcgagactggcagctgtccctgggcagctcagggactcaggactgcacaagatttcctccaggtccaatcttcaggctgccccaaatgaggcagcccatggggagctcccagagtagaaagtcctgcttgggggagctcacagcccctaccaccatccctgcactcatctttactcacccgctcctgcttctctcaaccaccaacagtgaacagccgcttcctctcagagcagctggtgtgacaaggtctctagatgctcctccagccacccagcaccctgatcactcaaaatggcctgagtgatcagagggcataagtgcccccaccctactgtgacccttccttcccagctctggacatggtgtcttggaggcccacagactacaggcccagggcaactctgtgtccaaatagcgcccccagcaggctgtggaggggtatggagctgccctatgccaaggtacccagacccataaagaggcagttgctctttgggactgttactctgtcctgcctctcgtgtcaggcacccccagcccactagcagcccacaataactcccaccccccaccccaagaaagactagcacctggggcagccccctcacctctctgggcttggatccctcccaccaaaggccatgagccagtggtgctcagtgggacaggggtcagctccgactctgacgtcctcctgcccaatccactctgccctagattgccgctcagatctgccgccaggcggggctggtgaagaagtccaaggctgtgctggattaccatgacgacaacttcgccatcgtctttgcagccatgggggtgaggagacttagtagactggcaagttctggaggctgtgagcaggcagcctgtctccctcagcccctggcatgacctgatctgatggggaagccatcagtgtcccggccagccaggaggggtgaggatgggagcagtgaccacggccatgtgtccctcagggtgtcccaaaggcaatcacagtggtaggatgggccctgggtggcctgaaggaggggaagccaggggattgggggaaaaaagatagcttcaggaacgggaggcctgggaggccagggaggtgggcagagcagcagctggcgacaggaggggcagggatggcactgagcagagctggacttaaagaagtctcagcctctccagggggatctgacaaggccctatgaggactggggcagcaaacccagtgcctgccctttccagccccggggtcaccccatggccttggtgtcttcacccccagcgactggtagctggtcagtccacaggctttcctgaggacacctgggaggggccaggccttgccctcaggccacagggccctacctccagcccaccctgctgtgtatccaggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcacttcacgtgggaagggttcatagggctggcaagcatagggacgagcacattaggtgtgctttgagcagtgaaagggacagtgagaggagcagtgagagggacgaaaccatccagaggacatgcagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggagtctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtaagctggctagcaaggggtgtcagattcctccctacccctccctaagcctgacaccccagacggtcaccctgcaaatagaggggagctggtccacccaagcctgccccactcccatgagttccagggcttggtctcagcctggccattcctcccctgccccccactccatttctcacagggtcactgaacctcccacccacccttcctagcttcagcctctcatcccctttcttaccccagtgcccatggatattgcaggtctctgctgctagagaggaggtgcctgggcgccgagggtttcctggatatatgtacacagacctggccaccatctacgagcgggcgggccgcgtggagggtcggggaggatccatcacacagatccccatcctcaccatgcccaacgacggtagcctcctcacagcccactaccctccagagctcccctgtcctcccttttccaaccagatacttaaagggcccacgttgctttgcacagatgtgcagcagcgcttttcctccatcgagatagacactgccctttcctccaccatccatgccccccacacatccctatcactcccatgagggaaacagaccccaggtggccctgagtggttggagacctgggcccccacccacactgaggccagtgagttttcttgtagatatcacccaccctatcccagacttgacgggcttcatcacagagggacagatctacgtggacagacagcttcacaacagacaggtactgccctgtccctacccacttcctgctctcagcccagagaaacactgaggaacagatgtttcactgcccccaggcatgaattaggaggggccagccaaagcgaaccccaaacaggagacagccacagggaagactgcatggttcacagacagaagacaggcctgagcagaatctggtttacctggctctgggatcttgagaagataatttcatctcttggatcctaggtttcctcatccataaaatgggaataatcaaatatatcacccagacgcattgtggaggataaaaataagttggcatatagaaagcatctggcagatagtcaatactatttgccttccctttccagttatttgcttcggtgggcagaaaacaacggctaactaacacacatctgtcctgtgtgtaggttaaaggtgacctctatgacgtttttctctttgcttggcaggtatttttttttttttttttttttttgcagctattaaccattaagcttcaaagtggtttttgtccacattatcaaaagttttgaaatactgagccttttattaactaatgccatgtcatcttccccctccactgttctgtctagggccacatataagacagctgatgcccaagccctagaatttgtgggagataagagagggtgggtgtggctgttgacccctcggaatgtaggataagtgaggagcttctcctgagaacaatttggggacagggggagcaaagcttgagtcctgctgtccaccactccctttttcttctccctcagatctacccccccatcaacgtgctcccttccctgtcgcggctgatgaagtcagccattggggaaggcatgacaagaaaggaccatggagatgtctccaaccagctggtaaggagaagagggtccgggggctggtaggtcctctagtttccgaagctgaaggcctgagccccatctgaaggacaagcttttctcctggcaaaattcctttccgaacggggtcccagtgtggccaggttgggggctactggactcccgtggtaagcccgcagcggccaccgacgccttgcccctcccccagtacgcctgctatgccatcgggaaggacgtgcaggccatgaaggcagtagttggggaggaggcgctcacctctgaggacctgctctacctggaattcctgcagaagtttgagaagaacttcatcaatcagggtaaggcgcgtcgctggtgtggagccagtaacctcttcaccctccttccgccccacacacattcctaacactccctcccgctctgtccctaggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagatgaatttaccttcgttgaaaacaagattggcaaaagaaagataaaaatgaaaggaaaagataattgttgaagctgggggctggggttatgagcacacggagttcattaaactattctccctatttaaaaaaaaaaaaaaaaaaaaaagcccaacgcggatgctgagactgttgtcccagctactctggaggctgagacgggaggatcgcttgagctcaggagttctggtctgtcgtgcgctatgctgatatggtgtccacactaagttgggcatcaatatggtgacctcccggagacgggggccattaggttccctaaggaggggtgaacaagtccaggtctgaaaccaaacaggtcataactccagtgctgatcaatagcagaaccgttcctgggaatagccactgcacttcagcctgggcaacatagcgagactctgtctcttaaaaaaaaaaataaaaattaaatttaagcccggcgcggtggctcacgcctgtaatccaagtactttgggaggccgaggcgggggtcacttgaggtccggagttcgagaccagcctggtcaacatggcgaaacccccgtctctactaatacaaaaaaaattagttgggtgtgatatcgcacgcctgtaatcccagctactagggaggttgagaaaggagaatcacttgaacgcggggggcagaggttgcagtgagctgagatcgcgccactgcactccagcctgggcgacagagtaaaactccatctcatattaattaattaattaattaatttttaaaaagctgcattaatgtcttaacagttgacaataaaatttttcttagggagataattatcttccttaagaaatagcttgggccaggagcggtggctcacatctgttaatcccagcactttgggaggccgaggcgggcggatcacttgaggtcgagagttcgagaccagcctgaccgatatggagaaaccgcatctctactaaaaatacaaaaaaaaaaaaaaaaaaattagccggctgtggtggcacatccctgtaatcccagctacatgggaggctgaggcaggagaatcgcttgaacctgggaggcagaggttgcggtgtgccaagattgcaccattgcactccagcttgggcaataagagtgagactccgtctcaaaaaaaaaaaaaaagaaaaaagaaaaaagaaaaagaaaaaagaaagaaagaaatagcttgataggctgggtgtgataattcaagcctgtaatcccagcactttgggaggctgagacaggattgattgcttgagcccaggagttaaagaccagcctgggcaacatagtgagacccctgtatctactaaaataatttttaaaaatcacctaggtggcacacacctgtagtccagctacccaggaggctgaagcgggaggattacttgagcctgggaggtcaggctgcagtgagccgtgatggcgccactgcactccagcctgggctgcagagtgagacagggtcgccccctgtctcagtaacaaacaaataaacacacaaatatcttgataaatttcatgtggaacatgagctcaggagccttggaagggacaaccaaggccacaaaagatgtgtgtgactctaaacagctctgcctgagagatgctaggtagaatttggtttgctccagacaggaagggagaagagttgctagggagagggcctgaaggacttggggggtatgagtgcagaagactgaagatccccagttaagaaatggatgaagagtattctataaattaggctgcctgatgttcctttgaaagctgccaacttttttgtaatatcaatccctcctctgtctcccctgccccatctacagtgaaatcatgaatgcttcctaggaagggaaagaagggtggtttgggaggatagaacttcagcaaagagctgagtttcatttctaggtaaacgtgttgtagatgacgtcagaattattggatcaagagctaggaccaaagga

SEQ ID NO: 16667 - DNA, 57978 bp, Human
  misc_feature (1)...(57978): n = A,T,C or G
gctcagccggggccggtcctgggcctcagtcatcagcacttctggagactctgccgcctcggcgtcaagtgcagaaggaacattaacttctttctcttgtgtacatttgcttttgtaacaaaaaacttgccagattttgtaattctaggatctcttcctttaaactccttttgctgaaacagaacagatgcaagcgtagtgttcagtgagactttaggtaaagcctcacacgtatcaggcaacaagctgggtgccgtgggggcacagagataaaacctcggcagggcacagtggctcacgcctgtaatccccacactttgggaggccgaggcgggcggatcacttgaggtcaggagtttgagaccagcctagccaacatggcaaaactccgtctctattaaaaatacaagaattagccgggcgtggtggcatgtgcctgtagctacttgggaggctgagatgggaggatcacttgaacctgggaggtggaggttgttgtgagccgagatcgtgcccagcctcggcgacagagcgagactctgtctcagaaaaaaagaaaagaaaagaaaagaaaacttctattaaggtgatggggcttaggggtcttttttacctttcagtttctgatgttatgttctaggagtgatatgcaaaacttgtatgaagttggaagttgttctgtgtttttaggacccacaggttgtagtagtgtagtagttagaagacagacttggaagttaaaacaagccaaggttcaagccctgacttggcagcttcttgctgtgtgattttgggccaggcatttcctccttgtttcttcgtctgcaaaagggtgatgttccaggtcaggagatcgagaccatcctggctagcacagggaaaccctgtgtctactgaaaaatacaaaaaaaattagccgggcgctgtggtgggtgcctgtagtcccagctactcgggaggctgaggcaggagaatggcgtgaacctgggaggcggagtttgcagtgaacagagatcgcggcactgcactccaacctgggagacagagtaagactccgtctcaaaaaaaaaaaaaaaaaaagggtggtgttgccagaagccaggagaggatgaggaggttgtagaagcagagtgcttacaagcaggaaagcagagtttcagctgggtacagtggctcacacctgtcatcccaacactgtgagaggccaaggtcggcggatcacttgaggtcaggagtttgagaccagcctggccaaagtggtgaaaccccatctctactaaaaatacaaaagttagctggatgtggtggtgggtgcttgtaatcccagctatttgggaggctgaggtaggagaatcgcttgaacctgggaggtggaggttgcagtgagctgagatggcaccacggcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgagacagggtcatctcggagctgatgactctgagttagcaccatctcggttcactgcaacctccacctcctgggttcaagcaatcctcccacctcagcctcccgagtagctgggacaggcacacgtcaccacacctggctaatttttgtgtttttagtagagacagggttttgccatgttggctgggttggtcttaaactcctgacctcaggtgatccgcccagctcagtcttccaaagtgctggaattgttcaggcatgagccaccgtgcccggccaggtgtttattttctaaatccaaaattttttatcagatctgctcagttttaagtaacatcctcaaaatctattttgctcttctgttttctaacttggtaagaggtgttttataattattttccaaattacactcaaacaccttccatctgtccaaaggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccaggtgagttccctggtactgccctgcagcctgtgtgggaaggggggtggtctatctttctgaccttctctcccagccctgggactggagaggacaagattaagcatggggatctttcctttcttggccagacttccagtaagggaggttgtctgttcctctaaccagaagacttctttgaactgtgacggttttatattcctcacttggtagaggcagaacgttcatctcagccaaccccacgcccatctggagtgtacttccccgggatgatggccccaaatggaggcaccggcctcttctttttgcctaaaccacttctagaaaccttttataaaccacaggccttaatgtgtatctttaagtcactgctgttttattcatcatcagcaactgactttgagacaggtcttctaccttattaattttaaaagaattgggataatttattaagttgccccttaatagcacttcatactattttagctttaatttcttcactttttaacaatatgattcattaaaagtcatattttaaattaatttttaactgtttgcagttgtatttcatgtaaatatttattgactaccctttaaagcataaattttgaatattattagatatcaacagccacatcttaaaaaaaaaaaaaagcaagagttttaatttaaaaagagccttgatataaatgattttcaatggactgaaaccaaaccaaaagtaaaatgggtcatttaaaaaaaaaaaaaaacccttccccgtgcgctggagtctcccgggtcattgtcggggagcgctagctcatggtgatctaggaatgactcgctaattgtttgcctttctatcccgtgcatcttaacctggctgatggatgatgttgggtttggatcagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcaggttagcagctcatgaactcttgaagttcatgagatgaacttaactctgggttcagtgtctgtgttcctttttcttactttatttgtatagagatagggtcttgctatgttgcccaggctggtctcgaactcctgggcttaagggatcctcctgcctcggcctcccaaagtgctgggtttacaagcatgagccaccacacccagcctctgtttctgatatttgaaatttagtaagacagattttagctaaattgagggaatacctttacagatctaagctctcatttctgctatcacctgtatttgatcatcttttggcagatttttttccccattatatgtgccagatttaaatatcatgttcctatataatataggatagattattttttggatgaattttcgttggacagatggtaaagatgaaaatggcagctgggcacagtggctcacgcctataatcccagcactttgggaggctgaggcgggcggatcatttgaggtcaggagttcaagaccagcctggccaacatggtgaaaccccatctctactaaaaatataaaaatgagtcaggcgtggtggcaggcgcctgtaatcccagttactcaggaggctggggtaggggaatcgcttgaaaccaggaggcggaggttccattgagccaagatcacgccactgtactccagcctgggtgacagagcaagactctgtttccaaaaaaaacagaaaaaagaaaaagaaaatggctagtctttttgctgcgaggctctgatgccagtacctgtaataacaacaggaaaagccggtctttagggccaaggagagggtgtgactgatggccccaccagcatgtctgcctacccgggcctgctccggggcagcaaggccaatgggggccagaattccaagtccctcctttccccttccctgcacagctctctccaagccttagaaatcacccaggacactatgttcagttttcttttatgggttcagtgttggttaagaataaagctggtcagtcagtaagtggaattccataagcctgaatattttggtaataaatagcaaatccatattaaccaccaagaacatcctaatagcgtttatcaaatggtaaatagcactacaaggatgaagctggaggattgcttgaggccaggagttcgagaccagccgggtgttggtggcatgcacctgtagttccacctactcgggaggctgaggtgggaggatcacaagcccaggaggttgaggctgcagtgagctgtgatcgcaccatggcactccagcctgggcaacagagcaggaccctgtctcaaaagaaacaaaaaaaattttaaaaactactgcagaagtcacagtgcacataaaaagcatgtcattgatcttacattcaccaaggaacaagttgggctccaaaaagactatgctctttgggtttttttggtgtttgtttgtttgtgacagagccttactctgttgcccccaggctggagggcagtggcacgatcttggctcactgcaacccccgcctcccgggttcaagcgattctcctgcctcagcctctcgagtagctgggattacaggcgcctgccaccacgcctggctaatttttgtattttcagtagagacggggtttcaccatgttggccaggcttgtctcgaactcctgatttcaagtgatccacctgcctcggcctcccaaagtgttgagattacaggcatgagccactgcacctggccgaaaagactatgctctttggatgtgcagggtagaggattgagggtgggcatggcacaggccttgtacccttccctccaggggtgtttggagttaaagtggcacaaaagaaggtgagagacatggaggaaaaagggtccatggcttttccccaaatccccactctgcgtgtttctattgcgcacccacactctctgtctttggtctgtaactagcactgggcgtccctttcagcaagacgatggctgtgctcaggcagctggcgctcctcctctggaagaactacaccctgcaggtgcgtccagactctggagggaggtcagctgcgtgcctagcccagaggctcctggggatgcccttgagggaagggctgtctgcatgcccctgcttctgccttgcagcccatcaccgtgccctattgtatctcttccagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgaggtgagacatgccggggctctcggtgccaggcctagtggtgcctccacgcagctgggcaggcaggggtcgagcccaggatgtgcgaagcagctgggtgaggagttcaccctgtgcagacttggcctctgcttcttcccgcatcactacttcaacctgtaaaaggcactgctgttccttaaacctctgcctgcctgcgagtaaatagcagtctctcctttgggtccgatagcaccatcacagtccccaccaaagggaccctggtgacattttaacccatggggcagaacaggttagaaaatgcacctgcctgcagttgccccaggctcctttctgttccctcattttatgaaagacattactggtctccaggcctctgtgaacagagtccaataagatacataaggaaagtagcagatatttgggacttaaatacgacctggcagaaaaagggaaaaaagaaagtgaggtttttgcttgcctgatggcactaagactaggaagccatcaagcccatctagcatcaaatctcttctcggcggctgagccacccaaggaatcccccagcttctctgtggccatgcctgattgtacaatgggaccagggctggccgcccacctgtgcagagctgtgaggaccccggggagcagcaggtgcagcagccttagcagtaccaggccctggaactgcatctgatggtcagtagggtggacaggactttacagggatgcctgggtggacttgagccagggaaagcccttctgtgacaagggcagggcacagtttgaccgtgtggtgccaagaaccttttctgggacgtggttttgggtgggcagctctgaaaacagtgatgagaaagcctgagaagggaactcccactgtgagtgctgctcaccgttcctaaacccttgctgtcgggatgaaagctgtcctccattttcccctcctcatttgggcatttacctcccgggctttaattccttgtagcaaatactcagaggaagtgccttggtccctcacaaaatgacgacagtaaaaccctttctgaattgttaaggagtgtccagatgatagaaaaagcctttgagacactctgagttagcatccactccatttctaaaaacacaccattctggttttgagaaagagaagccaccccgggctgcagagcccactgcagggtgggtggtgggtttgctcccctgggccttgctgcaggcgctacccggagcctccagctctgctccaaaaaacccgcaccaggagaactcactgcctggggctctgaccctgccattctgccctccttgatggcagcttgtctctctgccaaagatgaaagctgccttgagtctcaggaagggtttacaaagccctagaggatttgccgtctttcatctgccagtgacctgaaccacgcagatttttcaagcaggagggccgattgggcaaccacagctcccgtgctctctctttgcagtgcgcggctttccctccgagaaggactttgaggactacattaggtacgacaactgctcgtccagcgtgctggccgccgtggtcttcgagcaccccttcaaccacagcaaggagcccctgccgctggcggtgagacgtgcggccgggccgagcagtcacagcccatcagcaaggcctccgcttcctcccgcgtcactagttcaacctgtaaaaggcactgctttcccttaaacctctgcctgcctgcgagtcaatagcagtcactcctttgggtctgataatatcatcacagtccccgccaaggggatcttggtgacatttaaacccacgggtcagaacaggttagaaaatgcacctgcctgtggccgccccaagctcctttctgttccctcattttatgaaagatattactggtctccagaacagagtctaataagatagttaaggaaagtagtaggtatttaggacttaaatatgatctggcggaaagaaagaaagtgaggtttttgcttgcctgatggcattaaaattaggaagccatcaagtccatctagcattgtggttggcggccctccagggatcctgaacactcggtggcacttcacaatggaattaggaatggccaagaaccaccccccaaaaggggcccctgtgtggctccctgctcctgctaggacagggaccactcagtgtgacattccggggcctgttggagatactcagaggcgggggagtggtgagttctcgtctgtgacagccccccaagcgctctcccactccaccctgttgtttgcccctctgtctggatctctcggaacagctggttttctctttgtttccacaggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctggtgagaagctcggttagggttcgtgttaccagcccgggctgttgactagtgacagtcatatgggggcagccccactttgcaaaagtatttcttgaagaaatacttttcaggacatttggcttggttccaagtctttgctgttgtgaatagtgccgcaataaacatacgtgtgcatgtgtccttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctcctcatcctctccagcacctgttgtttcctgacttttgaatgattgccattctaactggtatgagatggtatctcactgtggttttgatttgcatttctctgatggccagtgatgatgagcattttttcatgtgtcttttggctgcataaatgtcttcttttgagaagtgtttgttcatatcctttgcccactttttgatggggttgtttggttttttcttgtaaatttatttgagttcattgtagattctggatattagccctttgtcagatgagtagattgcaaaaattttctcccattctgtaggttccctgttcactctgatggtagtttcctttgctgtgcagaagctcttgagtttaattagatcccatttgtcaattttggcttttgttgccattgcttttggtgttttagtcatgaagtccttgcccatgcctatgtcctgaatggtaatgcctaggttttcttctagggtttttatggtttcaggcctaacattgaagtctttaatccatctcgaattaatttttgtataaggtgtatggaagggatctggtttcagctttctacatatggctagccagttttcccagcacaggaaggggaacatcacacactggggcctgttgtggggtgggggggcggggggagggatagcattaggagatatacctaatgttaaatgacgagtaaatgggtgcagcacaccagcatggcacatgtatacctatgtaactaacctgcacattgtgcacatgtaccctaaaacttaaagtataattaaaaaaaaaaagaaagaaatacttttcaggaacatttactcttgtttataggaaaagtaaaacatccagtataactggtttctgaaagactaaaataatccttgaagatagcaaaggccctttctctatatcctggaagacgtgctcttgaatgaaacatttgtatttcagctttttttcttttttttttttttcagacagaatcttgctctgtcgccaagctggagtgcagtggcgcgacctcggctcactgcaaccgctgtgtcccaggttcaagcgattctcctgcctcaacctcccaagtagctgggattacaggcgcacaccaccacgcccagctaatttttgtatttttagtagagacggggtttcaccacgttggccaggatggtctcgatctcttgacctcatgattcacccacctcggcttcccaaagttctgggattacaggcatgagccaccacacccggctgtacgtcagcttttaaaagctcccgtttgagttcatggggcttggtttacattttctttttctgccgggccttctctgtgtacagacttactggcatttttagctccgtggtccttgtgcacctgatccatggtttgacggaatcagtgtggtgttcatggaagccagatcttggttactctgatgccccatcagtgtgtgtcttcgtgtggacctgggcaggtggttggtacgtgtgcctcctctgaagcatggtcttgtcttggaactgagctagggacagccaagaagtgactcggacccaggactaggcttagctgtcaggccaagaaagaccccactgcaggttctgggtggaagtccagggtgttctggagaacgtcgtatttcacgggtctggcaggagacagaactcatggaagtttgccatggaagtcacagcaacgtcccatccctccatgaggcatgattctgagacacaagtgccaggcaggcaggagacagcatgcatgcagccagcgcttagcgatgtcccttactggtgccagggctgtcaccaggctaatgctctagggcaagattttacatctagaactaagatgaacaagacctggtgtggggtgtgtgaggccccagagcgatgcccttgacaggtcacccagcctggagctcaggagaagctatgtccagctgtcacacatgatgcttgctgcctgcagcaggggactgcaggaggggacactggctgctgagactggggcccaggcaggagctgctcagctccctcctgtttttggggaacaattccctaagcttggaagcaagagaaaaccaatctcaaaggaaaagactgacagatttcagcatgtacaaactggaaatttgccagacacgaaaagacctaatggtggtttaaaaaaaaaaaaaaaaaaagcacatagcagactggggaaaacctttgtggcaaatgacacagagtaaatatcttttgttagagaaaaaaagttttgttattaagaatagtcggttagtcctcagcaagacagagaacctgagggggaagaaaagttggctggaaaaacaagctcctagtaaagccccaggagatataacgtgtgtgagactggcatggcacagggactggtcaattctagcctcagttttgcctccagatgtccatgccttagacccactaatatgcctgatgagaattcagccctcaggctgggcgcagtggctcacacctgtcatcccagcattgggaggctgaggcaggcagatcacctgaggtcaggagttcgggaccagcctggccaacatagtgaaaccccgtctctactaaaaatacaaaaaaaaaaaaaattagctgggcgtggtggtgtgcacctgtaatcccagctattcgggaggctgaggcaggagaattgcttgaacccaggaggcagacgttgcagtgagccgagatcgcgccactgcactccagcctgagtgagagagcaagactgtctcaaaaaaaaaaaaggccgggtgcagtggctcacgcctgtaatcccagcactttgggaggccaaggtgggtggatcatgaggtcaggagatccagaccatcctggctaacacggtgaaaccccgtctctactaaaaatacaaaaaattagctgggcatggtggtgtgcacctgtagtcccagctactcgggaggctgaggcaggagaatcgcttgaacctgggaggtggaggttgcagtgagccaagatcgcgccactgcactccagcctgggcgacagagtgagattccgtctcaaaaaaaaaaaaagtgatcatgtgtgtgattttttttgtgtgttgtgttagttacaaagtggaagtgacaatcacatcactcttctcatttgctgtcagtgtgtggtgcgtttccttccttctcccgtgggaccactgagcggccacgggggtcctgagctgaagtcactctgttgccccaagcatctcttcccccatggaccccatgcacgtggccctctgccctcgagagcagctcctcgaggtggctgggccatcctctgctcccgcacccagggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggtgactgcccgctttggctccccaacactctagaaaccgcgctgtcctggggaggccatgtccaaaggcttggtgttttagtattttttttttttttgagttggagtctcgctctgtcgcccaggctggagtgcagtggtgcgatctcggctcactgcaagctctgcctcccgggttcacgccattctcctgcctcagcctcccgagtagttgggactataggtgcctgccaccacacccagctaattttttgtatttttagtagagacgtggtttcaccgtgttagccaggatggtctcaatctcctgaccttgtgatccgcccgcctcggcctccagaagtgctgggattacaggcgtgagccaccgtgcccggccggaggtctttctatattgccaaggctggtctcaaactcttggcctcaagaaattctcccatctcagcctcccatctcattctcccacagtgctgggattacaggcatgagctgtaacacctggctaggggctcattttgaggctgcccagttgttcatctgcttggtgccataaataactttcataaaactatgcagcattgagggagtcagcagtgggctataaaatgatcctgaaaaaaaaaaaagtgtgcacatatgcagatacacagatcaaacaaatagggcaaaacgtgaaacggttactgaacctaagtggtgggaatgtgagagaccattgtgctcctcttcccgctgttctgtaggtcagaaattatgcataagaaagggctagccctgggcactggctcacacctgtaatcccagcaccttgggaggtcgaggtgggcggatcacttgaggtgaggagttcaagaccagcctggacagcaaggtgaaaccgtgtctctactaaaaatacaaaaattagccaggcgtggtagcatgcacctgtaatcccagctgcttgggaggctgaggcacgagaatttcttgaacccgggaggtggaggttgcagtgagccaagatcgcaccactgcactccagcctgggcagcagagcaagactccatctaaaaaaaaaaaagaaaaagagaaaaagaaagaaaaagaaatgaggagctgaatttttaactttatttttaattaacttcagttgaaacggccacacctggctgctggctgccgtattggtcagtgtggccgccccaggactccccaggcgcttttggtcagtgaaggaactgggtttcctcatcaccacgcctgactccttggtggggcaggtgaggaaggaaggtgtggtcagagccgacccatcactgcgcctcgtccttcactgcagaggttctgggcccctcctttcagagtaggggaggttgagggaatgaatggctatggcatccacagctatggtctgatctgtggtcacgtctcacagccatggaggctggtgttgacgtggttgggaactggcagggtctttcggcccacccccagaagggctgggctcctgccgcctgacgtagcttcgggggacgatctcaagtaccaggaaagactggggagcatgcactgggagtgtggaatcgctctacagaatggagggctggccgggtgcagtggcttatgcctataattccagcactttgggaggctgaggcaggcagatcacttgagcccaggagtttgagcaagatgagcctggccgacatagtaagaccctgtcgaatgcagggctgctgggacagtcggactcaggcctgctgccgtccagcctggcacatgccatcatggcgggcagtgacgggcccccagcagcgtgatggcttctctccccaggagtacatgcgcatgatggggctcagcagctggctgcactggagtgcctggttcctcttgttcttcctcttcctcctcatcgccgcctccttcatgaccctgctcttctgtgtcaaggtgagcatggcgtcggtggggctctggtgaggacggggagagccagggcaccccaggagggccctcttgggaagaactttgtggtcagagacttcagagagagtctgtccctcatgggggagaggagctgtcaatgtcccactcctctcggtggagccgcgtccctgtgaccagggatggtcaggagtcctcctggtccacctctgccggcccaccacgcccgactcatgcctgtgccctgcaggtgaagccaaatgtagccgtgctgtcccgcagcgacccctccctggtgctcgccttcctgctgtgcttcgccatctctaccatctccttcagcttcatggtcagcaccttcttcagcaaaggtgagccccagtcatggggcagagtggggttgccaaggggccaagggccatctgcatggaaataacccagaggctgtgatcggaagggagagtggcctggtggagctgcccagggaggagctgaccaggggaaggttggactggaaggaggaaagtcagcgtaatttagggagaaggagaattcagagaaggcaggtgtgtggctggccatgccgagtgctgtccagcagcccaaagggaaggcgagccagaagtgaggacagtgagcccggccatgtgcagagccttgcggtgacagttacgttgaagatcatttttcctgtctggattttgtgtgtcactttgttatcattctcttttgcttctttgttttcctttcctgccttctgttggccttctgtagtgccttttacctcggatggttcagaggctataagttgtgtttctctttttttagtgattacctttaatgtttcacttgattacttacctctaaaattccaaaaagtgaagttattcagtatgcccaggctcctcccaggtaaaactccaacctcaccaccactctaagtacttttagaggttcccagttttttgttttttttttcgagcagtcttgctctgttgctcagtctggagtgcattagtgcgatcttggctcactgcagtctctgcctctgggattcaagtgattcttgtgcctcagcctcttgagtagctgggattacaggcgtgtgccaccacgcctggctaatttttttttttttttttttttttttttttttttttttgcatttttagtagagacggggttttgccatgttgtccaggctggtcttgaaatcctgacctcaagcgatccatactccttggcttcccaaagtgctgggattacaggtgtgagccactgcgcttggcctttttttttttttcttttctttttttcttttcttttttctttttttttttttttgagactgcctcttgttctgttgcccaggctggagtgcaatggcacagacacggctcactgcagccttgaactgctgggctcaaagctatcttccagcctcagccttctgagtagctcacaccaccgttacctgccaccacacctagctttttttttttttttttttttctcaccatgtttcccagactggtcttgaactcctgatctcaagtgatcctcctacctcagcctcccaaagcattgggattacaggtgtgagccaccatgcctgacctcctaacttttgttgttgtctagtttgttttattattaaagaaaacctaagtgaccaggcatggtagctcacacctgtaatcctagcactttaggaggtcaaggcaggaggatcacttgagcccaggagtttaagaccagcctaggcaacatggcaagaccctgtctctacaaaaaaaaaaaaaaaaaaaaaaaagtttaaaaattagccaggtgtggtggcatgcccctgtggtcctagctacttgggaggctgaggtgggagcattgcttaagcccaggtggcggatgttgcagtgagctgagtttgtaccactgcattccagcctggagaacgagagggaccctgtctcaaaaaaagaaaaaaaatcataagcagttacttcctatgtgacattcctgtgctttgccaacatatctgatgtgcacgtgattttcgtgtacctggctttttagagtcactcttctctgtgttgaagcacatctttgagtagttcttctagtgggcattggtaagtggtcagtgctttcgactttgtatgtccaaaggtgtctgtattttgccctcactcctgtatagtattttagctgcctgtgaaattctccacagataggtgttcttccttggcaattttataatgttaccttattgccatccgatactcatcgttagtgggagtctgccaaaagtctaggtgtgatttttctttatgaacatttcgatctgagggctcatgtgtcttcggttcgaatttcaatgagatttcgggtaatatctcatcagactttgctgtgtgtgtgtgtgtgtgtgtgtgtgtgtgtgtgtgtgtgtaaaatacatacaacaatttatgaccgggcaccatggctcacgcctgtaatcccagcaatttgggaggccgaggcgggtggatcatgaggtcaggagattgagaccatcctggccaacacagtgaaacctcgtctctactaaaaaaaaaaaatacaaaaattagccgggtgtggtggcgggtacctgtagtcccagctactcgggaggctgaggcaggagcatcgcttgaacccaggaggcggaggttgcagtgagccgaggttgtgccagtgcactccagcctggcaacagagcaagactctgtctcaaaaaaaaaaaaaaaaaaaaaaaagaccaggcactatggctcatgcctgtaatcccactttgggaggccaaggctggcagatcatctgaggtcgggagttcgaaaccagcctgactaacatggagaaaccctgtctctactaaaaatacaaaattagccaggtgtggtggcacatgcctgtaatcccagcttcttgggaggttgaggcaggagaattgcttgaacccaggaggcagaggttgcggtgagccgtgatcatgccactgcactccagcctgggcaacaagagtgaaacttggtctcaaaaaaaaaaaaattaccattgtggccgctttaagcattcacatcgttgtgcacccacccccatgtccacctccagaatggttttcatgtttcccgactgaaacagtccctgtgaaacactgactcccccaccccccttccctggaaaccagcaccctacttcctgtccctatgagtttgatgaccctggggacttcatgtaagaggaatcgtacagtgtttatatgctgtgcctggcttatttcactgagcatagcatccccaaggttcatctgtgttgtagcctgaattcccctccttttcaaggctagatgatattccataatgtagatggggccacattttgtttacttgttcatccattgacagactcttggatgcccctgtgttgtggctgtcatgagtgtgctgtgctggacatgggtccctgcttttcattctttgggcgtacacccagaagtgaagttgctgaatcctatggcaattccatgtttaacttttgagagagactgtcagactgtctttcccgcagtgtctgcaccgctgcgcattcccaccagcagcacacaggttgccagtctcctgcatcctcgtgaacacctgttgttttctgattgattgttttttatagtcgccatcctaatgggtgtgagggggtatctctcagtctttcacgtctgttaattactttttttttttttttgagatggaatctcgctctgttgcccaggctaagtgtagtggcacaattggctcactgcaacctccgccttctgggttcaagtgattctcctgcctcagcctcccaagtagctgggattacaggcgcccgccaccatacccagctatttttgtagaaaccgtgttttgccatgttgtccaggctggtctcaaactcctgacctcaagtgatcctcccacctccgtctcccagagtgctgggattacaggcatgagccaccacgcctggcctcttaatttctttttttttttaaactatacttttacaaccccctttcttcttttttttttttttttttttgtgacagagtctcactctgttgcctaggctggagtgtagtggcacaatcttggctcactgcaaactctgctgcctgggttcaagcaattctcctgcctcagcctctgagtagctggcactacaggtgcaagccagcatgcccagctaattttgtatttttagtagaaacggggtttcaccatgttggccaggctggtcttgaactcctgacctcaggtgatccaccagcctcagcctcccaaagtgctgggattataggcgtgagctaccacacctggccccagatggtcttatagtgacacccagatgctgcttgccttttccaccatgctgacatttgtagtgacggtgcaaaaacaatgatgagcaaaaccaccagaccctaagcataaatcaagacaccaagccatacttatcactgtgttctccactgccacatactcacagcaagcaaacaaacaaacaatgccagcttattttttaaattttttttgttttgagacatggtctcgttctgttgcccaggctggagtgcagtggcctgatctcgactcactgcaacctctgtctcccagggctcgagtgatccttccacttcagcctccctcccaagcagctggggccacaggtgtacaacaccatgcccagctaatttttgtagtttttgtagagttagggtttcaccatgttgctcaggctgaaaaaaaaaaaatgcaatttcggccgggcatggtggctcatgcctgtaatcctagcactttgggaggccgaggcgggcagatcacctgaggtcaggagttcgagaccagcctggccaacatggtgaaaccccgtctctactaaaaatacaaaaaaaatttgctgggcgtggtcgtgggcacttgtaatcccagctactcgggaggctgaggcaggagaatcacttgaacccgggaggcggaggttgcagtgggctgagactgtgccattgcactccagcctgggcaacaagagtgaaacttcatctcaaaaaaaaaaaaaagaaaaatgccaatttcactcatgaatgtccttgacaaagcagtaaaaaaaaaaactttattaaatctcgactctcaaatatacttcatttagtattctgtgtgacgaaatgggatgtacacataaagtacttgtactgaaccatggattatcttgaggaaaagtacatgtacagttgcttgagttgtcagcaaaactagccactttttccatggggcaccatttttgcttgaaggagcaaccactagactatagttattccccctcgggtgtttggtaggcattttctccagtaggagcctgtctttttaaggaaaacaactggtagtttctgacatcaatactgcagttcaagctttcaggcaaaaaatagaattttgcaaactcaaatctgtgacttcctagtacttaactttttatggagccagtgataacattaacaaatgtaatttttttaatattgtatgataaaatatgccagtgtttggaacatttgtgtaactcaaaaagcagtattttccaaacgaactaatgcatcatgttataaaatcatacaagagtaaaaatccaaagtgtggccaggcgcagtggctcatgcctgtaatcccagcattttgggagactgaggcgggcggattgcctgaactcaggagttcaagaccagcctggacaacatggtgaaaccctgtctctactaaaaatacaaaaaattaggccgggcacagtggctcacacctgtaatcccagcactttgggaggccgaggtgggtggatcacgaggtcaggagttcaagagcagcctggccaagatggtgaaaccccgtctctattaaaaatacaaaaattagtcgggcatggtggcggatgcctgtaatcccatctactcaggaggctgaggcagggaattgcttgaacctgggagtcggaggttgcattgagccaagatcgtgccactgcactccagcctgggcgacagagcgagactctctctccaaaaattaaaaaaaaaatccaaactgcaggataaaccaatggatgttaatgtaacagagcgcaaaaagttcgttggttacttcatggcaactaacctttccgaaattactgcttgttcagtggcgcttgcatggtatagtatcaaagaagaatatccacagatatctgtaaaaaccattacaataccctttacttttccaactatatatctgtgggaaggcagattttctttatatacatcaaccaaacaacataaaagggtaaatagggctgggcgcggtggctcacgcctgtaattccagcactttgggaggccgaggcaggcggatcacgaggtcaagagatcgagaccaccctggccaacatggtgaaaccccgtctctactaaaaatacaaaaattagctgggtgtggtggcgctcgcctgtagtcccagtgactcgggaggctgaggcaggagaattgcttgaacccaggaggtagacgtttcagtgagccaaggtcgtgccactgcactccagcctggtgacagagcgagactccatctcaaaaaagaaaaaaaaagaaaagaaaagaaagaaaagagtaaataggcagatatgaggaccgagctgtaatctgctaagtcagacattatggaggtttacaaaaatgcgaaacatcgttcctgactgaagcaccagaggtggggaaaaagaccaataaagaaaaagaaaaaatcagccggtcaagtgactcacatctctaatcccagcactttgggaggccaaggtgggcagattgcttgtgcccaggagttcaagcccagcctgggcaacatgacgaaaacctgtctttacttaaaaataaaaaaaacattagcctggcccggtggtgcatacctgtagtccgagctactcaggaggctgaggtgggagaatcgcttgagcccaggaggcagaggttgcagtgagctgaaatcacaccactgcactccatcctgggcgatagtatgagaccctgtctcagaaaaaaaaaaaaagaaagaaaaaaaagttggaaaaaccactgctgctcttctcagtaaattgtggaaagtgtgtgtgtgtgggtgttttgtttgtttgtttgtttttttgtttgtttgtttgttttgagacagagtctcactctgtcgctaggatggagtgcagtgacccgatctcggctcactgcaacctccacctcccgggttcaagcgatgctcctgcctcagcctcctgagtagctgcgactacaggcgcacaccaccacccatgcccagctaatttttgtatttttagtagagacggggtttcaccatgttggccatgatggtcttgatctcttgaccttgtgatctgcccacctcagcctcccaaagtgctgggattacaggcatgagccaccacacccagccggggtttttttcataaatgtatgttgacttgtagtggatttgttactgttattcttaaatttaacagaatttttaaatgttcttagtattaatttctcacagaataaatatggatatatatatataacccacatttaaaaagccctttggtgtcgttaataatttttaaggatagaaaagggtcttaagaccaaagattttgatggctgggcacggtggctcagacctgtaatcccaacactttgggaggccagggcgggaggatcccttgagcctaggagctttagactagccctgacaaaatagggaaacccatctctacaaaaacatttaaaaattagctaggcatggtactgcgtgcctgtggtcctagctgctctccctagccggaggtgggaggacttcttgggcccgggaggtggaggctgcagtgagccatgatggcaccactgtactccagcctaggtgacagagggggactcgatctcaaaaggaaacaaagaaaagaaaaccaaacagtttgagcactgctggcatggacagaaaacatgcccatctctccactctccgtaatccactctctcacctcttccggctccttctcacatgtcacctcctcgaagccttcccggccgtcgggagcctcttctcccatcctgcgcctccttgctgcatccagcatgtgtctccatccagcacaccttgctctctgtctccccgctatattccaggcgtgggaggggagggattttctctgttttgtgtggggctgcctcccggtgcttagaacagagtaggtgctcagtgcgtatctgacgaatgcatgaatgaacaaatgagagagatcaggcaacccaggcagaagtggggcttaggcaggctgggcacggtggctcacgcctgtaatcccagcactttggaaggccaaggccggtggatcacgaggtcaggagatcgagaccatcctggctaacacggtgaaaccctatctctactaaaaaatacaaaaaattagccgggcgtggtggcgggcacctgtagtcccagctactcaggaggctgaggtaggagaatggcgtgaacccaggaggcggagcttgcagtgagccgagatcgtgccactgcactccagcctgggcgacagagcaagactccttctcaaaaaaaaaagaagtggggcttaggcgggaatcaggggtttgggatcagccacgtgaggtgtgcagtgtcagggaggcagctggatgggaggtggaggaggggctggaggtgttggtgtgggggtccctgggatgggggcactactcacttggagaaggggctgccggccacacctggtgtccccccgtgctggagcttgtgtctcgtgtagatggcaagtgccaggagcaggttgggtggctcggccccaggagtagggggttgcctgtacctcggggagcccaagccccttttgagggcactgacgctcacgccccccgggtcttccaacacctgcagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggtgagtgtttgccttgtccagcctgttctttccgaatcagtaaccttcgagagcacccaaccacaagagccgccagcagcaaggctccacctgggacggttggcaggcagttgggaccactgaaggcagcagcatccacatacagcgctgagtgtgggctggatagctggacacggccccgggcgagggaagcccagctccacggcacagcaggaggtgatgggagccacagggcagtgggccgaagaagccaaagctcggaggacaagagggttggagcatccagcagcgttggcaccacatacgcatctgactgatggtgggatctaagtcggtgacctgagcctctttcagttttcatttttttttattttaaatattttatagagatggggtctcactgtgttgcccagcctggtctcaaacttttgacctcaagcaatcctcctgcctcagcctcctgaatagccaggattacaggcgtgagccaccacatctggcctcttccagcttcctgagacattcaaaattattacatcagaaaggctgggcgtggtggctcacgcctataatcccagcactttgggaggctgaggccggtggatcacgaggtcaggagatcgagaccatcctggctaacaaggtgaaaccctgtctctactaaaaacacaaaaaattagccgggcgtggtggcaggcgcctgtagtcccagctactcgagaggctgaggcaggagaatggcgtgaacccaggaggcggagcttgcagtgagctgagatcgcaccactgcactccagcctgggtgacaagactccgtctcaaaaaaataaaataaaattattacatcagagatctcaaagtctagggttttgaggactttttttctttttttttgagacaagagtctcgttctgtttcccaggtttgagtgcagtggtgcgatcttggctcatctcaacctctgcctctgggttcaagtgatcctcccacctcagcctcccgagtacctgggatcacaggcatgcaccaccatgcccatctaatttttttgtatttttagtagagagggggttttgccatgttggccaggctggtcttgaactcctgacctaaagtgatctgccctcggcctccgaaagtgctaggattacaggagtgagccactgaggctggctgggtttcgaggacttttcatcaaccactgctcttggtaaagggtagaattagcatcttcccagtgcctcctgtattgattggtgatggcagcagagacgcctaagagagaaacaagtgataaacgacagcattttttttcttttcttttttgttttttgagacaggatctcgctgtgtcacccagcctggagtgcaatggcaccatcacgactcactttttttcttttcttttccttttttttttttttttttttttgagacggagtctctcactctttcacccaggctggagggcagtggcgcaatctcggctcactgcaagctccgcctcccgggttcatgccattttcctgcctcagcctcccaagtagctgggactacaggcgcccgccaccgtgcccagctaattttttgtatttttagtagagacggggtttcactgtgttagctaggatggtctcgatcttctgaccttgtgatccgcccgcctcggcctcccaaagtgctgggattacaggcgtgagccgcccactttttttcttaatttttatgaaattaaattgagtaaaacacttccttggtcagcctttggcctgtgggctctcattctgcaaagcctgctgtgggcaccaaacctggtctgagcccctccagttaggcctcctcccaacattgctgcattgggggtcaagtctccaacacatgaatttggggggcccagtcaagccgtggcaccatgcagttcctagctgcagcttgccaaggtctgggtctgtggaaggaggtgggagtgtccagcgttgctttgtctttcattagaacggttctctacagtcggcagtgtcttctgacactttagcttttacatatctgtgtttccatgtttactcgtgtgttgataaaatgtaaactttgttcttttgctttctttttaacaatttttttttggagatagggtcttactccattgcccaggctggagtgcagtagcatgataatagctcactgtagcctcgacctcccaggctcaagtgatcctcccacctcagcctcctgagtagctggactacaggcacgtgccaccacacctggctaatttgtctgtgttgcctaggctggtctcaaactcctggcctcaagcaatcctcctgtgtcagcctcccaaagtgctgggattacagatgtgagccaccacgcccagctagagtgaatgttattaaaacagacaaatctctggttgtttgaaagtgcaaattcaccaaggctggagagcattatttccatcagggtcctcggccaaacagagggtgtttggacacacagatccccagcactgtcaggactgcaatgttggcaaaccagagagatgatgagaaacacgagctccattaaagagagctttacacgtgtttgaaatatttctgtgattaaaaaagacttatggccgaggcaggaggaaggcttgaggctggagtttgagaccagcctgggcaacatagcaagacccccatcactacaaaattaaaatgtaaaaaaatagttatactaggctggatggggtggctcacacctgtaatcccagcactttgggaggacgggtggattactcgaggtcaggagttcaagacccacctggccaacatggcgaaaccctgtctctactaaaaatacaaaaattggcggggcgcggtggctcacgcctgtaatctcagcactttgggaggctgaggtgggcgggtcatggggtcaagagatcgagaccatcctggccaacatggtgaaactccgtctctactaaaaatacaaaaatcagctgggcatggtggtgcacacctgtagtcccagctactcgggaggctgaggcaggagaaccgcttgaacctgggaggtggaggctgcagcgagccaagattgtgcccctgcactccagcctggcaacagagtgagactctgtctaaaaaaaatacaaaaattagccaggtgtggtgacgtgctcccgtaatcccagctactccgaaggctgaggcagaagaatcattcaaaccccagaggcagaggttgcagtgggccaagattgcaccactgcactccagcctgggtgacagagcaagactctatctcaaaaaaataaaaaataataaacaaataaagacttatactggccgggtgcagtggctcacacctgtaatcctagcactttgggaggccaaggcgggtaggttgcccgagctcaggagttcgagaccaggctgggcaacacggtgaaaccccatctctactaaaatacaaaaaaattagggctggttgcagtggctcacgcctgtaatcccagcgctttgggaggccgaggcaggcgaatcacaaggtcaggagatcgagaccaccctggctaacacagtgaaaccccgtctctactaaaaatacaaaaaattagccaggcacggtggcgggcgcctgtagtcccagctactcaggaggctgaggcaggagaatggcgtgaacccgggaggtggagcttgcagtgagccgagatcgtgccactgcactccagcctgggagacagagcaagactccatctcaaaaaaaaaaaaaaaaaatttagcccaggcatggcagcatgcgcctgtaatcccaactacttggaaggctgagacaggagaattgcttgaacctgggaggcagaggttgcagtgagccgagatcgcagcactgcactcctgcctgggcgacagagcaagactccatctcaaaaaaaaaaaaaaaaaaaaaaaagacttatgctaaatgcacattgacccacgttggccttaccgaaatcatagatgtgggtgcatatgtacgtgtgtacatatgtgcatatatgtcacagattaaatgcaagcctgtctagtcagtgaatgagctgttgctggtctgtgacttaattattttgtaacctgagtttatcttccaggcttgaagaaagctgtccaacttgttataaaaccgggaagggaaaaggcatgccaaccaagcagtggccatgcaaggtcaaatgtgcacacgtgtgccatcaggggcttcgggtccctgggccccccagcctgctggctttcgggccactttcctgatgtgtcttccaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatggtgagttctgatgccctgctcttgagccgccgcctctctgagtgcagaggtgtccccagtacctgctcagggacccctctgagtccccagcatgcagcacctgcgtggggctggcacacagaaccctgccctgtgcacagggagtggcgtgtcccccgagggcccttgggactggttcagagagagaaagaccctccatgcccaagagtaatccttccgcttcagagcctgagacagaggggtgcagagaaccggctgctctggcccctctctgcaagacccacgcacgcagcctctgctgcccacctccctcctcaatcctgcctcctttcttgtgaaaagtatcttattgggttttctacctacaaaatctagcttcttataaaaatgttcacattcggccaggcgtggtggctcacgcctgtaatcccagctctttgggaggccaaggtgggtggatcacgaggtcaggagatcaagaccatcctggctaacaaggtgaaatcccatctccactaaaaataaaaaataaaaaaaaaactagccgggtgtgatggcgggtgcctgtagtcccagctactcgggaggctgaggcaggagaatggcatgaacctgggaggcggagcttgcagtgagccaagatcgcgccattgcactccagcctggcaacacagcgagagtctgtctcaaaaaaaaaaaaaaaagagagaaaaaaagttcggattcctgaaatctatagctcattcccactggtgagatgaacactgttgacatttggtatgtactttgctgggtttccctctctacacttactgtcatagagcacagatggatggacatatagcatagtttcataaaaatgtgattggaggccgggtgtggtggctcacccctgtaatcccagcactttgggaggccaagatgggtggatcacctgaggtcagaagtttgagaccagcctggccagcatggtgaaaccctgtttctactaaagaaatacaaaaaaaaaaaattagctgggtgtggtggcaggcgcctctaatcccagctacttgggaggctgaggcagggagaactgcttgaacccggaaggcggaggttgcagtgagctgagactgtgccattgcactccaacctgggcgacagagcgagactccatctcaaaaaaaaaaaaaatgggatcggggtggacatagtcgctcatccctgtaatcccagcactttgggaggctgaggtggaaggatgacttgaggccaggagttagagaccagcctgggcaacatagtgcaaccccatctctacaaaataaataaaaaatttaaaaaattagccaggcggcacatgcctgtggtcccagctacttgagaggctgaggcagaagaatcacttgagcccaggaggctgcagtgagccatgttcacaccaccacactccaactttggtgaaaaaatgagaccctgtctcaaaaaaaaaaaaaagaatcatattgtaaaaaatgcttacaagttgcttttcttaacctaacagtacaactcagatatcttaaatacatatatatgtttgtctatttataaatatagttttaaactattatctaaacatattgatgaatgttgttatatttataaatatatttctacctaagtattacctttttaagaatcactgccgagaccagctcggtcggggagaccttaacccagcggcactagaggaattaaagacacacacgcagaaatatagaggtgcgaagtgggaaatcaggggtctcacagccttcagagctgagagccccgaacagagatttacccacatatttattaacagcaaaccagtcattagcattgtttctatagatattccattaactaaaagtatcccttaagggaaatggatggatgggccgaattacttgcagcaggaacacgcccttaagacacagatctctcaggcttttgtttgcggcttaagaatgcctttaagcggttttccgccctgggcgggccaggtgttccttgcccacaaccttccagcttgggtgttatggccattatggacgtgttacattgctgcagagattttatttatggccagttttggggccagtttatggccagactttggggggcttgctcccaacaaaccaccttcatttatagtgacacacagtgttccattctgtgggcccatcaacatatacttaactgattccctaccgatggctagttaaggtcatttctttttttttttttttctttgattcggagtctagctctgttgcccaggctggagtccagtggcgcgatctcagctcactgcacccttcacctcccaggttcaagtgattctcctgcctcagcctcctgagtagctgggattacaggcacccaccaccacacgcacctaattttttttgtatttttattagagacggggtttcgccatgttggccaggctggtcttgaactcctgacctcaggtgatccacccgcctcggcctcccaaagtgctgggatgacaggcgtgagccaccacctccagccgaggccatttctgttttcattctttgcttccacaagtagttatcaagtgttcactactgtaatccatcaactgtaagatgacactgaccgttagaggtaatggttactttgtctatcactaagaaagaaaaatgccacacttacactatggcattttatagtttaagatgcattctgattttttttttttttttgagacggagtctcgctctgtcgcccaggctggagtgcagtgtcgccatctcggctcactgcaagctccgcctcccgggttcacgccattctcctgcctcagcctcccgagtagctgggactataggcgcccaccaccatgcccggctaatttttttgtatttttagtagagacggggtttcaccgtgttagccaggatggtctcgatctcctgacctcgtgattcacccgcctcggcctcccaaagtgctgggattacaggctcgagccaccgtgcccagccaagatgcattctgattttaaaatcactttacatatgagagctgtgtccctgagaaccagtggagtgcagtgtgtgccagatgccgttccaggtgctggaagtgcactgggcgtggagctgcgggtaaacgagtccccgccccgcagctgccctggcactgatcctgccaaggcactgcttccaccttccctgctgctctgcccgcaccactgtgtcgactgcctccatgtaggcaccaggctgtcctcgagggcactgtgtgaggtgtgtgcctgtgttcttaccccatgcactgagttatttctgtgatggccacagagaagatgggaagaggcttcctcatagtagagggaggcgtggcgccttcggcttctcttgcttacagtcatgaactcatgtggggcttgagcaaagaaacagccgagtggcatggggacacagctttctttccattttggctccaacatccctctggactggagcgttagataacttctgtctatgaaatttcatagctgacaaactccctttgccctgtatcggatctgagttcatcttcacaagcctgtatgtaaccattacacccacttaccaggttaggaaactgaggcttagagccttcacagggatgaaacaagttgggactctctggggctctccctgagtagcgccttctccacagcagtgcctcgaagtcctgggacagaggctgcatggctgtgtgcatctagtgtgtctgctggttgttgctttgctcgtcacaaacaaaacaaactgacagctgtctgcttccctcccagccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgccgcctcctgtggggacagggagggccggggctgccaggaccatgggaagacttaccagcacggcagtgagacctcatagcccgtcaggcgctccctctgagccttgctccctcctgccctgaaggagggcaggaaccctccgctgccctctaaccggttccccagggcacagaccacatctccagcttctcaggaaatgccagactcagccgtccagcagtgcctcggcctcatgggcctcccagggttgcagagacactgagggtgtctgggacgtgttggggctgggggagaccggaggggagcagccaggagcagcatctgcccgaaacgtccctcccctctgcacactgatggtgacgctaggcttggttccttctgagacggtcgggcaggggagcaggagaggccttggccgtgggcctcggggctgtgggtagcccagggcagcctctgcctttcctgcaggtgttcagggtgggaaataaggacagggcggccgtcagagacctgaacctcaacctgtacgagggacagatcaccgtcctgctgggccacaacggtgccgggaagaccaccaccctctccatgctcacaggtgagggccaggcgcctcacgccctgccaccagcaggcccccctttaacaccatctcagcgccagcgccgcctcactccctcaatggggctttcgggccttccccaaccacagcggcaggagatgcacctcagccctgcaggcccaggggcacaagcagggactgcctcctcaccgcctctgtccgggacatgccgggggaccccagggaccctgccctcctcaccgcctctgtccgtgaatgcagggggaccccagggaccccctgccctcctcaccgcctctgtccgtgaatgcagggggaccccagggacccctgccctcctcaccgcctctgtccatgaatgcagggggacccccagggacccctgccctcctcaccgcctctgtctgtgaatacccaagcttgacagggtcagtgaaaacagaggccaccacgcaggagcagctcaaccccatgctaattctgtcaccaaacccctctctgagagctctcccctgtgcaccacaccggccactggcatttcactctgtcttccccaagcaccaaagtgtctggcagtggcacaggctgggacccggggcgggggctgattgtggtgactctgtgtgtgtgtgtcgtgggtttctcctccctgaccagctgtgcgtcccagtggcagggctgtttccatgccgcttctttttcccactggcccagccaaagcccaccccagtgggagtggggttccgtgccctctcatgggcagggtcctcagaggaaattaggggagacagagagggggtggggggtcattaccgcgggtgctgacgagcaggatcttcatgctgaatgtggggtctcctgctgggccccaggtctctttcccccgaccagtggacgggcatacatcagcgggtatgaaatttcccaggacatggttcagatccggaagagcctgggcctgtgcccgcagcacgacatcctgtttgacaacttgacagtcgcagagcacctttatttctacgcccaggtgagttgggggccaggggtgtgcaggggtgtttccactgatgtgctcgagtttctggggcagtcttccgaggagctaaactggaggaagggagccaggagggcaggagccagggttctgagtccagctacgtcaaggagaggttcctctcaccagaacctcgctggccagggtcggcgtcccgccaggagccctgcatctccccagctacgtcaaggagaggttcctcttaccagaaactcgctggccgtggtcggcctcccgccaggagccctgcatctccccagctacgtcaaggagaggttcctctcaccagaaccttgctggccgtggtcggcctcccgccaggagccctgcatctccccagctacgtcaaggagaggttcctctcaccagaacctcgctggccagggtcggcctcccgccaggagccctgcatctccctgcgtcccctgtcgttgcagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgtggcggtgggactggaggcagtgggttcccctcctgctcgacctgggatggcccttccgccatggcccgggcaccttggcccttgacaccccagacaaggccatcaccatccttggaggactcaagccggctccgcgaacccctcgatggggcctaccgcaaggccagcctgggcccggggtgtggctctaccagcgtcgcgagactgtgtctctccctccaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgagcggtggggccagcccgcgacagggtcggtgtcctggctgccgtgctgagggaatggctgctaccttcatgaagggccctcagatcaggcaggggtggccttttctagacttcctgtctgttgcctctgggtggagagcccaaccaggcaggggggcttgtgagagggaagaggcaggaaatggagctgaaagtctcaatttggttaggatgtggttcagccatgaccagaagaacagaggccaagcctagtgccactaggagcagcactgcccttggagaggccaacacacgcaccaacatggcagctcccacgtgagagcagctcacagcatggccagggccagcaggggctgacaggatctgggcccagacctctgactgtactgtgcaactacggcttccctttcaaggtcacctcctggtccagcacgatctgggtgtgccagcgtcccccacattccaacggggtggagcaaagacataggagccctcctcccctcaggacaccccccaagttcacgtcccacttctgccccctagtgactgagtggcaacccagtgtggtcagcagtaggctggaggggatggcctttgtcctgggcagccacatgctcagccaagataccagggttttgttaccaagagggaggacagcaggcgttaggagatgaggaaccatccaccacggcctctgagagtttcactagccacttcctgccccactgcccagttggcagagccattgttcttcctgggcctggcatccttgtctctaaagaggacatggggccaggcgtggtggctcaccgcctataatcccagcactttgggaggccaaggcaggcagatcacttgaggtcaggagttcaagaccagcctggccaacatggtaaaactctgtctctactaaaatacaaaaacttaaccaggtatggtggtgcatgcctgtaatcccagctacttggggaggctgaggcaggagaataagtacttgaaccaaggagggagaagttacagtgagccaagattgtgcagctgcactccagcctgggtgacagagtgagacttgtctcaaaaaaaaaaaaaaggacatggaattccatctcctgcacggtgacgttgggaaagaggtgagatgcatctctgatagtgccgtgcagtgcggtcttgcagccggtagctcttgctcctgctcctgctgacagtcccttcctagaaccacaccataaccatcagtgttaaccccacaagacagaagccctcacacgtggtccgtcgctgctgatgatatccttccctggtgcttgtatagctggggggagaccccaccttccagcaggtgcccctgacagtgctcagcaccctagatccccagcagctcttcccagcaggagcgggaggtgacacccttgggacagcacagggagctccaagacacattcattctgcttcagctgcccacctccggttctctagcctccttcccaccagcttgcctggtgtgagccctagagaccccggggtgggcatgaagagacctgggggatcagccaaagatctcacacgtggccctgtattccaggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtacgcctcccagggagggcacgcacaggtatacatccaagatgggatccccatgggccatgagggctttgtgctcagaggcacctgctctgcccctctctggcctggccagtcggcactcttagaccctcagcctgggcaccatcagcccagatgaatctgcttggctgggtcctaggtgccaggcctcctagcaaggagaaacataattaggacctgaaaaggagaagcacgtatctgactcaccaaaagggtgctcagcgctgatgcagggctcacactcccccttctgacaccaggctcaacacgtgctgcggctgcactcagaactactcgtgaaaccgagtctgtatttgtatgtgggtggtgaatttggtctcagtgtcagagctggagatgttaccacctgctcatcactgtctcacacacacggcagaaccagcaaggggagggaagccagtgttccatgacactatctatcagtctggatattatctggataatatcagtttattgcacttttctccagtttgttgtttgattttgtcagatttttttccattttacatttatttattttatttgttatttatttattatttgttttgagatggagcctcactctgctgcccagtccagagtgcagtggcacaatctcagctcactgcaacctctgcctcccaggttcaagcaattctcctgcctcagcctcccaagtagctgggattacaggcgtgcaccaccacacccggctaatttttgtatttttagtagagatggggttttaccatgttgtccaggctggtctcaaactcctgacctcaggtgatccacccacctcggcctcccaaagtgctaagatgtcaggcatgagccaccatgcctggccacatttgtttattttaaaaacaaggtcttgctctgtcacccaggctggagtgcagtggtgcaatcacaactcactgcagccttgaattcctgggctcgtgatctcccacctcagcctcccgaatagttgggactacaggtgtgtatcaacatgtccggctagtttttttattttttttgtagagatggggtcttgttatgttgcccaagctggtcttgaactcctgggcttaagtgatccttccgcctcagcctcccaaagttctgggattccaggtgtgagccactgcacccggcctagattttgtacttaatgtagcaacatcctttctcttgtgacttcttctattaattttattcttagaaagtgtttcgcagctgtgcatagtggcgcacgcctgtaatcccaacactttgggaggccaaggcgggcggaccatgaggtcaggagatcgagaccatcctggccaacacggtgaaacctcgtctctactaaaaaaaaaaaaaaatacaaaaattagccgggcgtggtggtggttgcctgtaatcccagctactcaggaggctgaggcaggagaatcactgaacccaggagcagaggttgcagtgagccgaaatcacacccctgcacccctgcacccctggattccagcctgggtgacagagggagactccatctcaaaaaaaaaaaaagaaagaaaaaaccagggaatcaaaccatatgaacctcacttttagccaggcatggttgctcatgcctgtaatcccaacactttcagaagccaaggcagaaggagaaggagatcagcttgggcgacatagtgagaccccatctctacaaaaaaattaaaaattagccacatggccaggcacggtggctcacacctgtaatcccagcacttggaggccgaagcgggtggatcacgaggtcaggagatcgagaccatcctggctaacatggtgaaaccccatctctactaaaaatacaaaaacaaaattagccgggcgtggtggcgggcacctgtagtcccagctactcgggaggctgaggcaagagaatggcatgaagccgggaggcagatcttgcagtgagccaagatcgcgccaccgcactccagcctgggtgacagagcaagactcagtctcaaaaaaaaaaaaaaaacttagccacgtgtagttgtgcacacctgtagccccagacacttgggaggctgaggtgagaggattgcttgagcccgggaggtcaaggcttcagtgagccgagattataccactgcactccagcctgagtgacagaccaagaccctgtctccaaaaaaaaaaaaaaaaaaaaaggcattttggccaggcacggtagcttggtagctcattgcctgtaatcccagcactttgggaggtcagggcaggtggatcacagggtcaggagatcaagaccatcctggctaacacggtgaaaccccatctctactaaaaatacaaaaaattagctgggtgtggtggcgggcgcctatagtcccagctactctggaggttgaggcaggagaatgccatgaacctgggaggcggagcttgcagtgagccgagattgtgccactgcactgcagcctgggtgacagagcaaaactccatctaaagaaaaaaagaaaaaaaaaggtatttcaaggaattaacctcctgtggcccctgccccattctatagggggattaggggggtgattcattttagtttagtttagtttagtttttggagacggagtcttgctctgttgcccgggctggagtccagtggtgcgatctcagctcaccgcaacctccgcctcccgggttcaagcaattctcctgcctcagcctcccgagtagctgggattacaggcacaagccgccatgactgggtagtttttgttgttgttgttgtttgttgttttgttttgttttatttattttagtagagacagagtttcaccgtgttgctcaggctggtctcgaactcctgagttcaggcaattcgcccacctcggcctcccaaagtgctaggattacaggtgtgagatactgcacctggcctccttatttttttaattttatttatttatttatttttttgagacagagtttcactctgccacccaggctggagtgcagtagcgcaatctcggttcactgcagcctccacctcctgggttcaagtgttctcctgcctctgccttctgagtagctgggactacaggcacctgctaccacacgtggctaattttttatgtttttaatagcgacaggtttcaccatgttgactagactggtatcgaactcctgatctcaggtgatccgcccgccttggcgtcccaaagtgctggggttacaggtgtgaggcactgtgcctggccgagggggggtgatgctttaggaacaaattatctagaaagtcactgagaagtgactcataatgctgggtctgtttttcaggtttgaaggtctctttgctaaactggagaagaagcagaaagagctgggcattgccagctttggggcatccatcaccaccatggaggaagtcttccttcggtcagtaaatgcgcatttccgtccacctaggactgggctccgtgctgcagaggactttttttttttgagatggagtttcactctagttgcccaggctggagtgcagtggtgcgatctcggctcaccgcaacctccgcctcctgggttcaagagattctcctgcctcagcctcccgagtagctgggattacaggcatgtgccaccacacccagctaattttgtatttttagtagagatgggttttctccatgttggtcaggctggtctcaaactcctgacctcaggtgatccgcccaccttggcctcccaaagtgctggtattacaggcgtgaggcaccgtgctcagccgaggacttctaaaaagtgcagtgataaacagtcacctcggttatgatctcaaatgcccacgtgaggctggaggaacagcctggggtggggcgggcagtggccgccgtcagagccccaagtgcagattgtgactgtcagcaacattggtgtgcgtgggaaacggcggcacacgtgaggggcctgcactgccttggggtccctcctagacccgccacgggtctagctggcacacggcgtcagaggcgtgcccagctcttcttgggcttagatcgtccttgggagatacctgtgtcgttaatgaagatgggaactatctcatccagaccctcagaactgcatgggggctgggcgtggtggctcacgcctgtcatcccagcactttgggaggccgaggcaggcgatcacttgagccaaggagtttgagactagcctggtcaacatggtgaaatcccatctctttttttttgagacagagtctcactctgtctcccaggctggagtgcagtggtgcaatctcagctcactgcaacctctgcctcccagattcaagcgattctcctgcctcagcctcagtagctgggactgcaggcgcacgtcattacgcccagctagtttttttgtatttttaacagagatggggttttgccatgctggtctggaactcctgacctcaggtgacccacctgaagatctgtgctgggattacaggcgtgagccaccacccccagccaccatctctactaaaactacaaaaattagccgggcatggtggcacacacctgtaatctcagctacttgggaggctgaggcaggagaatcaattgaacctgggaagtggaggttgcagtgagctgagattgtgccactgcactccaccctgggggacagagcaaaaccctgtgtcaaaagaaaaagaaaaaaacgtgagataggttttcctccttagggagcccacagcctagaggaggcgacagaataggtgatcatacatgcaggacatggtggtgcatgctctggggacacctgtgcaggggaccatgtgtccaggaacagacccagggaaaaaggccaggcaaggcggcggagggagggagggactgcccgctgacctgtgtcccacacaggaccgagcactgactgactgattctgtgaatcctggttgaaggaaggaaggaagcatgaacataagagaaagaaaccacgggctggcctggagtcagccggctctgagggtagaacccgggttgatcctgctgcgtctcagcagccacagggcctcttgtctctcaaggtctcaggcctctctggccccatctcatactcaccacacggcccacctgtgactcagctccaggccccacacctgaccctggcctctctgagctcctggtctcaagagaaaaataatcagaagcttttcctggtttgtctaggacctggggagagctagccaggctggtaagcgcccaccggagctcagaccatgggcaggaaggcttttaatcagagggaatactgacgagatggcaacacttggtgtctctgagcagatcatgaaagatgagtgggactgggagaatccagtgagggagaagggctctgccaagggccagaggagcaggtacttaggcctcacggcagcctgcacacaggagcaagaagcaggcagacagggctcacacgggctccaagtgtggcctgacaatgttgctaagccagccggggggtgcctcctgcctgctgcagcctcagttgtgtttcctaatcggcggggagctctaggaaggggtgtgtgtgtgtgtgtgtgtgtgtgtgtgtgtgtgtgtgtgtgtgtgatgtaattcacataatattaaaaaatcacctcctctgccagccttggtggttcatgcctgtaatcccagcactttgagaggccaaggtgggtggatcacttgaggtcaggagttccagatcagcctggccaacatggtgaaaccctatgtctactaaaaatacaaaaattagctgtgcatggtggccggagacactgatgagtgaggaaacacataagcagatgcatgagcaagccaaggactgcggcaacactgctcccctcagtgcctctaaccatagtccctccctccacccacccggggagctgggtcctgaccggtccctgtgtgtatcggcacagggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactggggtgagtgcccaggtgggtgggcgggtggcgggggaagggcgagcagcccccaaacgcctcatgtaagcccatgcagaggagagtctgcgagggcgcaaacagggtccgggagagtcagcacaccgggcagagggcgggcagcggctcacaccgcatgggtcggcagggagaagcgtttgaatggagcaactggaatttctcatgctctacctcaggcacagcaccctgctcaacaggagcttgtcgggtgcccagctctgtgttgatgaggctctctagcagccaacgacacggaggttggttgatgcactcggttcacagatgggaaaccgaggcctgggccaaagtcagatgtgacagagtcacagagctcattctgatccctggtcagcctgatctcaaagccctgacgctctctgtctcggaggaccaggaaggaaagaagctggagaacgaggcagtcaggctggttgggaggctcggccatctgtttcctgtgacctgtgtggtggtgtctccttgtggcagggggagggcaggggatggcagctggtcctctactgtcctgagacaatgaaacagtgtctgggccgggtgtggtggctcatgcctgtaatcccagtacattgggaggccaaggcgggcagatcacttgaggtcaggagttcaagaccagcctaggccaacatgacaaaaccctatctctactaaaaatacaaaaattagttgggtgtggtggtgtgcgcctgtaatcccagctacttgggaggctgaggtaggaacccaggaggtggaggttgcagtgagctgagatcacaccactgcactccacccccagtgacagagtgaccctgtctcaaaaaaataaaatagtgccaacgtgcagggccccatggagacctgcagagtctgcacaggtgaccctgccatgtggtgcactgagctcctcccacggccgtttcaacgctctgggagtctccggtgcaacctcagctgcaggcccccaggctggcgtcacacagaacagcacctgccgcaggtgggtgggggtcaggcgctgggccccaagcgctgccggtgtcacctgcgtcccctctgccgcagctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtaaggggcatcccgggggcgggacgggggcatcgggggccagtcctgcagccagagttcgccttcctgactgcagcagggtcgacatctggggaggatggttcttggctgttccgaatgtactgagggaggttcagcagcatccctgaccttgccccaccccatcatgaccatcaaacatgcctggaaacattgcggatgtcccctgggtggcagatcacggcactgagtcaggggaagtgccctggaggtgccagagacactggcatcctggggccaggctttgtcaggcgtctttttactgaagctgtgtctttcaggatcattcatgggcaaaatgcagaagcatagtgacttcaagttacctttgctttgtgatgatgctggccacagtgtgccttcgtgtgacagggtgttttctttcaacatcttaaaactcacagttcttggccaggcacagtagctcacacctgtcatcccactactttgggaggccgaggcaggtggatcacttgaggtcaggagttcgagaccagcctggtcaacatggcaaaactctgtctctactaaacacaaaaattagctaggtgtggtgatgggtacctgtaatcccagctactctggaggctgaggcaggagaatggcttgaacctgggcggtggaggctgcagtgagccaagatcgcaccattgcactccagcctgggtgacagagcaagactgtctcaaaaaaaaaaagaaagagtcttggtagtcatagttggatactgccccaggctcagaacagggaccgtgctctggttaatggaacctactggaaggttttcttattttgcagctcctttcccggttcctgactggcattcaaagttccacatactgaatgatgacaaaaccttgccagaaattatactctccttaggagaagggtgatggggcgggcagctcagaggatgctggcaccactctattgggtccctgattagccatgctcaggtggcagggggtgcccaggtgtcacctcttcctgtgtcccctgactctgccattgctccccaggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagtatgtgcactgcccgtccctgtctgccctggccagagcccccaggactgactgccctgggcactgccacgggcccatagatagagcattgtgtctgccctcccaaagcccctgggtctggtgggaaacccctgccacatcctcctccaccatccacagccccaactccctgtgacagcagatcagctgtgggccatcccatgcactgcggtcctcacggggacccatgaaggctcggcaggcagccctgccttctcctcctaaatctacctggctcctgtcagccactgtcctcgctccacactgctctctccagcagtgtgacctgctgggcacatgagctgaggtgatggagggtgagcagagcaggacttggcaagaactgccgtccctgttcctcagatggccgcacgtcgggagcctgccatgccattgtgtgggcagggctaccccctatgccggccacagagcccccagagctcctggaaccacccagaggaggccaaaaattctgttaatttcagaatagccactcctcctcagggcagtgtcgtctccacccacattccaggctaggcctaggcctggcgatggctgcgtcccagcttctggctccatccctgccccaagagcagaaaagcaacagccctcgatctgctctccttgccatcaactcaggatcctagaatgacacacagaggccaggagaggctttccctttgccacactccaggaggaggtggggctcgggacctccacacctgggcaaggtcgccggcagccgtggggctgagggctgggagcggggtgatgagggagagtgacgctgccattgtcacatggtcagcataggaattccagaggaaccgttctccggtgggggcagatgttcccggtatggaaccatggtgcttgtgctctcccataagcccctttagtggttgggctgctgccctgcatgccttgggcggtcataaccgagaacccgacctctcctgccacccagacgtgctgtgctccgtccctgaccttctctgtcccccgcaggggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtgagcgccggagggtgctggatccgttcccctgcagaccgcagagggcttgccctgggacccctgtgcagaaccggaaccagctgggcagcccctaggccggcagctcggcccgactcagggaggacagctggaatcccctggcggctgccccctcgcctcctccctgcaccctcagcctttaccctccatgcatgggcagcacccggagcagccatcctggttacagctccgggtgcaaggggacgaggggaaactgggacagagagggtcctggggctgaaagccaccgcgggggccagacgtggcctgtggggctgatggacatgggccagctgaccgggaggggtctgaggacctccaaatgctcctctcaccccttccctacccgtgagctcctctcagcttggcatgcacagcagcgcctccctgtgccgccgcaggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccaggtgggcacctggagaccacccgcagcccccatggccatccacggagccactccgcccagacagggaggcaccagccacagccgaggcgggactcaggcaatgggcccagttcatgctcaccagcccctctgccccagctggccctgcccggctagccatgactggtgggcaggcgtctgcggcgtccttgccctgtgcagagccggcaggggcgtccctgggaggagccccctcactccacacagcacggataaggccctgtgcccgccctgaccaggcccgtcctggaggtgggtgtggtgtgccctccagcgcagactgatcttacctccccaacgcagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatatagtgagtgtcccagccccgaccccgggcagcacccctgcgtcctcaggacgtggtcactgcagaggggcctcctagggcaggggctcctctgcgtctgagtggcctggggctggtgcgttcctctgtaccgccttgccccacctcccacagcagccccctcgcgcccgctcgctcccaggccctgtacctgagctcccactctcccacctgcctcagtgtctgggcatctgtaacaaggaaccacagaccagcgcttagcacgaggagtgaatcccccatggctcaggggaggacccttcctgcttctcccatctcctggaggctccaggcatcctgagctcctggctgcacctactccccaccaccgcctccatcctcgcatggcagctcctgtctcctgtctcaaatctccttctgcatttctcttataaggacacttgctgttgggtttaaggcccacactaatccagtgtctcaccttaagatccttactaatcacatattcaaagaccctgtttctaagcaagatcacaaccccaggtccagggggacagaacttggacctgtcctgtggggcctcctcagcctcccacacacccctcggtgcttgtaacggtctctgtcctggtcaggaggcagcccaggattcacgcagagcctgtgcctctcaggcgggctgttgctgccctgggtctgccatgtcgctcatgggactgcattggattgttacgtgcctggcccctctctgagctgtggtgcctcgagaggcagctgtgacctactggccttcacatctccccatggaggggacattgttacaggcgccttgagcagcctggggaggggagtgggggccgggaacctggaaggggaggagggtgccccaggcctcggggcacagtgactccctcgccccacagacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactggtgagtggctccgggagcccaggacactggcgagatgctccccacgtctctgcttgggcccagcacaacctggggcagctccacctccttctccaccaggcagctcctgcaccagatggtctcccactgtacggcctcagcaccagccggcacttacagccagggcggggcacagccctcgccactcacaagggctgtcgagttgtgagcccctgccgaggagtcagcctgggggcccagggccgtcctgctgaggagaggtggtgcccagggacacccagtgcctggaggaggggatgtggggctgaggggtgcccagtcctgctgagcagaggtggtgcccagggacacccagtgcccggaggaggggatgtggggctgagggttgcccagtcctgctgagcagaggtggtgcccagggacacccagtgcccggaggaggggatgtggggctgaggggtgcccagtcctgctgagcagaggtggtgcccagggacacccagtgcccggaggaggggatgtggggctgaggggtgcccagtcctgctgagcagaggtggtgcccagggacacccagtgcccggaggaggggatgtggggctgaggggtgctccacgtgtttattgaaaacgttcattttctcaggtctccatcccctccctcaaacaaacaaaagcaaatgtgttgacattgcattgcacatacagcttagccgagggggaattcacttctttaaaatagtcagacttctctaaaaagggaactgtctccacgtgttaaaatctttggccaggcatggtggctcacacctgtaatcccagcactttagaaagcagaggtaggtggatcacctgaagccaggagttcaagactagtctgggcaacatagtgagaccctatctcttctaaacagttttaaaaattagctaggcatgatggcacacacctgtaatcctagctactagggaagctgagacaggaggcttaagcctgggaggtccgggctgcagtgacctatgattacaccattgcatcccagcctgggtgacagagcaagaccccatctctaaatctgaaaacaaaaatcttactttcaggccagccatggtggctaatgcctgtaatcccaacactttgggaggccaaggtggacggatcaccaaaggtcaggagttctagaccagcctggccaacacagtgaaactccatctctactaaaaatacaaaaattagctgggcgtggtggcgcgctactcgggaggctgaagcaggagaatcagttgaacctgggaggcagagtttgcagtgagctgagattgcgccactgcactccagcctggacaacagagtgagactctgtctcaaaaaaaaaaaaaaaattgtctaaaaatcttattttatattccccagcagatttatgatttttctccatgagtcccgcacagttctttttcctcagatagtttatgtctcctggatgctagtttagccccgtaagaccactgtgtcttctagtaaaaggtctgagtcgcacctgtggggcctgagattgggacgagaagccttgaaggccttagtcccaccagacctcccacatccacccccgcccctcccttctccacggaagccgccctgcggctgggttcacgcatgcggtctttgtcctggtcaatcagacagaattatacacccggatgcctgtgcttcctgaggaccaagatgtagcggacgagaggacccgcatcctggcccccagcccggactccctgctccacacacctctgattatcaaggagctctccaaggtacccttgcaatttggggtggagtccttcctgccagctgactacctggctgtccccagggtccgaccccatccctggaagctttcggcgctgaggctcagactgctctgctttgcgtccaggcctccgcattccgtgttttctgttgggtgcctgcaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgggtgcagccagggaggctctgaaggggtgagacaggcatggctggagggggcaccctggaggcagggacagagggatgctgtccccaaacagctgctgcatctgtggcttgaaatgggcccagcacatgcctctggacagcgagacaaggtaatgagctaaagctaagcttcgccagaactagcaggtgatgggaggggagagagatgggtgccaacatccgtgagcccagagaggcgcattcagcactgacagccacctctgtgcagaggccattctgtgtccaggcagctcaggtgtggggttagaggccttgctgagtgaagggatggaaggccctgggcccgcccagctttcccatgttgagctgagccccaccagctcccccgcagaaggaccagaggcagccctcctgcacctctgcccggggcctgcatgggaattcaagtgtgccaagcagagcaggggaaatggtaagcagggcctggggctgagaagtggccgcggagtcctctcctgagctcacaccaggggtgcctggacagcagaggccctgggccagagcacatgcaggccctctcgggaggaaagcctcatcctaggctgcagactcccccatagagggttccagggcttacaggcaatgcacagcaaacaaacagaggagatggtaccatggctggaagcaatagacacaggccccatggggggacaagcacataggcgttagatctgcatcatcaggccagattataaaagattataaactcactgtgtctacagaaataaattatgcaattgaaaatctatgcaggggagagaaaaccgtatgtgatctagcaatggaggagagggtcagaagtccccagtacatgtaatctgagttccagaaggaagagagagagagagtggcagggggtagtagccaaaaaggtagtggctaagactttccccaaactgattaaaaacagattctgggctgggagcgtggctcacgcctataatcccagctttggaaggccaaggcaggcagatcacttgaggtctagagttcgagaccagcctggccaacatggcaaaatgctgtctctaccaaagaaaaatacaaaaattagcagggcatggtggcaggtgcctataatcctagctactcgggagcctgaggcatgagaatcacttgagcctgggaggcagaggttgtagtgagccgagatcatgccactgcgctctaccagtgtaagggagacagagtaagactctgtctcaaaaaaaaaaaaaaaaattctggaagcttgagaaccccaaagaaggaaggtaaagaaaaagaaatccagtctctggaatccacagaacccaggcactcctgcccccgaccagctgctgaaggtagctaagcagatggcagcaggcacgtcttaattcagctggacgtggtcacttgtgcagagaacagctgctgcaccatctgaccaagcagtactcaccccaaacgtggtgcccacaaatctttcttcttagagggagaagaaagagtcctagcacatcagatgtcccaggtgtgaatgagtgggtagccagctctgagtctgcttctacgtaaaggccattcttgcaccacctaaccccatggctgcctgtcctggaccaggctctgagagcagctctggaagcctccctgcaccaggcacatccttcctgtgtccctgttccaagagcttccactgtgggcagccaccacggcctgtgcatagctccagcgcccccgtgtacacacactggcaggaaccacagacaggcgcagtggtgggcacctcaagggtagtccccgtggtcctctggaggaaggaggcttccctccaacccgcctccctccccggctatgctccgaccccaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacaggtgcacctcccgagccctggcccttcccagagtggagtcagaatcaaggtccccatagcatagagctgggagtgaccgctcaggtcagcagccagagctcctgcttgtggctccaggatggagctgggatgtggtggtgtgacccaggtagcttcacgtaggaaagggactgccctgacagtgcctgccacctagggacaaagccagcagtgagagatgtcagggtcggcaggtcccctttaggtgcaggcagatgtcttcccatgtaggtgcgtgcaccgggcccctgggaaaagccttctctggggcctccagccctatgcggtgggctttccaggtgcacacacagctccttcctcttcactagggctgttctgcaattgctgggtgtgggccgctgctgggacacgggcctccactgggacatgggagccaatgctaactctcagccttattcccccacctggcaccctcctgcctctagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacaggtagagcctgggtctgtgggttactggaagtttcagcaccgggtgggccatggaggagccaggtggccaggagacccatcagcatctggtgcagagtctgcccgtgagccacactgagcatgggtatcaggaacagcctgatcggagagccaatgccttcctgtctgcacaagcctttggcaccccaagccctatctgaggtcccgccctctccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggtgtgtgccggccccggcagcccccactgggtgggccctgggcccctacctaggcctctcccatctgctgtgcggagcgtctgtgcctcgccccgccaagtcccatctccccaatccctgggacgaggactccagtgctgagcacccaggcaccctccccgatcctccagcccggcgctcacagcaacaccgtctctcctttgtgcaggcagcgtcctggaagatgagcaccaaggcatggtccattaccacctgccgggccgtgacctcagctgggcgaaggtgaggcagtccctggggccccactgggcactcatggggcagggggaggtccctccaggggtctctccctctgtggtgactgcaggctctttccacagaggagtcactttccatttctcccctaacactcagcctgatacgtgctggtttgggggttttatatccaaaattatcagtggtaaaaggaattcagtgtaaaacaggaaaggggtcagggatggtggctcacaccataatcccagcactttgggaggccgaggagggaggattgcttaagcctgggagttctagaccagcctgggcaacatagaccccgtctctacaaaaaatttaaaaattagccaggtatcatgcatacctgtagtcccagccactcgggaggctaaggtgggaggatcgcttgagcctgggagttcgagactgcagtgagctatgattgtgccactgcactccagcctgggctacagagcaagactctctctaaaaaaatatgggggaaaaaaagaactggctcagaaagggaacatcactggctcaaggttgtaatctgagctgggaacagcacagggaggaggctgggccccatccccgctggctcctgcttagccagcgtcctctacctgggagcacggtgccgtcgcagggctgacctctctggggctctggggtggcgctgggcaggggtaggattgtgggggcctcatcagcccctattgccagaggactcccaggtcccgcagaggagcctgggccctgttctctcctaccagtgacttttctgctccccaaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacacagtcacagtctgtgggtcacacgcgcgagcggtcacagggctcaatcactcgcccacaatctagacatgaggctctcctttcacatttcaatcacacaaacgtgggacgttgcttttcccagaagggagcacacgcagagaatacactgaggtgaaggaacaggcccataacacaaaggaaaaagccggctagatcaacgcccggtgacaggctcttagtctaaagacaagagcaggtggggctgtgtgggaagcacaggtctggtgggagagaagctgctggcatcagggtcacccgtgggcatttgccatttcccagaaataactcctcatcagctccctttttagttatttatggagtcttgctttgttgcccaggctggagtgcagtggcgcaatcttggctcactgcaacttctgcctcccgggttcaagccattctcctgcctctgcctcccgagtagctgggacaacaggcacgcgccaccacacccagctaatttttgtgtttttagtagagacggggtttcaccatcttggtcagcctggtctcgaactcctgacctgaagtgatccacccacctcagactcccaaagtactgggattacagccataagccaccgtgcctggcccctttttatgcactgttttgtgttttgtcttttggagacaggatcttgctctgctgcccagcgtggagtgcagtggtggtatcacagctcactgcagcctcaaacacctgggctcatgcaatcctcccaccccagcctccggagtggctgggactaagggcatgcgccaccatgcatggctaaattttatttttagtatagacgaggtctcatgttggccaggctgctgccaaacccctgacctcaagtgatccacctgccttggcctcccaaagtgctgggatcacaggcgtgagccaccatgcccggcgaatgcactattatttcttatggttttctaaacccgatttgaacttctgcattttacattcccttagaattcagagttttagaaaagacttgttttcatcactttggctcatttgggacaatttcaagtctgtgtttttatcagtctctggaaatttatgaaagctgcaaatcgtctccagtagctcttttattccctttaaacttctgccatctagttccatgttataaaaaatataacgtgtttgggcagtgtttaggccacagcacccatgtgtagccacccctacacatgggtggctgtggcctaaacactgcccacggaaagttctgaagtgggcccttctggccccacagcctgtccgcaggggctgtggcctctaggtcgggcctggggctaggaagagggaaaggtcagtgcacgaggccacccagctccatgtccatgcccatggcccttctgcagggcatcctcagacttgttttcaagcccatgtgttagagatttaggaatgtgtcatttttctcctgtgacaccctaaaagagggttggggagagcgtataggactgagggcacagcccgcatgaggcacacacgtgtgaggccagcgtacacaggacacgcacaggagataccatccttcccggtagcacgctgccagcaccagcaggggtctttaagtaaggactggcacaagtagaatgccttcttaggaaaatgatccgcagctcaggaggctgctgcgtggggaccgggaggggcaggtgcattcagggcgtctgtggcaggggcccagggctgcacccaagcctggagcttagatgaccccaggagcagcaggaagggcccatctggcatcccagggacatcctcaaggcctctggaaactcagtgctggagctgggtcaccaggggtgccctaaggagcctgggactgaagcctcaggaccctgccctggccgatttttgtctgagctgtggcagttcccagcccacgggagggcaggggaaaagagccttgggcccagggataggagtgaccggcctatccacgctcc

SEQ ID NO: 16668 - DNA, 10134 bp, Human
ccagtgcaaaccctccctcctccagaagccttgccctcactactgatcacacttgccttaaatctttgttagcaaggacatgtcctcctgaagtgaggcctgtgtttctaagtcacatttctttctcttttcttttctttcttttttttttccccagagtctcgctctgtcacccaggctggaatgcaacagcacaatctcagctcactgcaacctcctcctcctggggtcaagcgattctcctgcctcagcctcccgagtagctgggattacaggtgtatgccaccaggcccagctaatttttgtatttttagtagagacggggtttcaccatgttggccaggctggtctcaaactcctggcctcaagtgatctgcctgctcagcctcccaaagtgctgggattacaggcgtgagccaccacacctggcctctttcaccaatttaataactgcttatggaggcccagagctggctgctggggacagcagttgaccaagacaagctgcttcctgtgcccggagagcttacactccagagggtgaaacagatggcaaacacagcaaccaagagacataatgatcaaagattccgaggcctgctggaagccaagagaggggtctgtgatgcaggcacccagagctccccattttcaagagaaaccagagacttggatttttatgtaaactctcctaattttaaaggttgccagcgcaagcccgtttcctctgctctctcaaggctcccctccccgcctggcctcccactttctccagcgcgcctgcctccttctcttcctgggggccccatccgcactcctccccctgcaggatgccctacttgcacccaactcctcctgctgcccgcgccctgggggtacctgagcagcagctggcaggacggggtccactggactgggagtccactgcccaggaccctggggccagtgcacagcagctgctgaggcccccagctcagaccctgggccagccatcctgaaagaggccttgtagcgcgggtggacacctggagtccccagggctgcagctgcagaagctaaatgcctctacccaggcccagtgcacacacactgggggttggtctggaagagctggggggccagaggagtgagacaaggaagggttctgagagggcttccgggtttgacccccagctctgccaggttcctggggattaagtctacagggatttctgccatgggacggtttatgttctctggagctggagatcacaggaacaaatcctagctctgcccttcctagcctgctgaccttgcacaggctccttgcctttctgggcctcggtttccccatctggacactgagggcagtacccaccttgcaggataactttgaagaggtcgtgtgcctggcacacaacagtgcttgctgtagggcaggcttccacggcctctgccaggccctctcgaggaatcactctgctgggcagtgccccccatctgtgttttctcaggcctctgacccgagaggcagccaattgtttggactctgggcactgccagctgggagggctcaggtctctgaagggcccaaggtcctggtgacagctgtcaggtctccggggacagctgggtcatctctccagctcccaaagaaacaccaagaagcccctgcatgccaaggacaccacccctctggaccactgtgccccagctctgaccactgcagtcccatcttctctgtgagagggggtgacagagctccagtgcagcccaggttggggaggtgggtctgccagggaccagcttaggatttggagaatcggccctggccacctgaaggtccgaacctggaggagaaggacaaggggccagccacacagcctgggcaggggcctctgctttccacctttcagaccctgagggcagagtcccgtgggaggggaccctcagggggccgggggctggctgccacagcgacttcctccttcccgcagatccccaggcgtgcacagcaggcagaagctgtgggggagatcgcagcgcccgctgtgtcctcccggtgaccagctgtcacctgagcccagggcgcctgccccagcagcctggtgtgtttgccaagccagggctgcagcttcctggacccgcctaccctggaggggatggagcagtgaagggcaccgggccaagcgctaggcatctggggctaaggagacagaagcccgcggtgcccgtccatgcgggccctctgccccagcacccacatctcaggacaccccttcctcccaggtctggcggtccagtttgggggtcaccgagctggggtggtgtgcagccagcagaggggattcaggatcccggggtgactcctggcccaggcctgtcaccccacagctggctcctggccccaaggcagccacgggcaggggtcgtgatcgggggcgggacggggcccggacctcctgaccgccccccaccccccgccgagcgggggtgtatttgcatgtccccgccccacgcacggcattggcggcggcggcgggaggccgggcctgagtggctgcgcgcccgtggagcggcgggggcggggcgcgagccgggcgcccgggatgatgccgccgccgccgccgccgccgccgccgccgccaggggaagggttcgggtccgggtcgggctcggcgggcgcggggtgcgggacggcccagggcacggcggctgcagcgggagcacactgagcgcccgcccgccatgtccaggaagaagacccccaagagcaaaggggccagcacccccgctgcctccacgctgcccaccgccaacggggcccgaccggcgcgctccgggactgcgctttccggccccgacgcgccgcccaacgggcccttgcagcccggccggccctcgcttggcggcggtgtcgacttctacgacgtcgccttcaaggtgagccaggcacccgccccccaggccagcgcagcaggtggcgcccggcctgagccaagggttgggggtcggacagggggtgcagggcccgcggccccagggcgcggagccgacgcgggaggaaccccgtggggcttgcacggtgcatcgtgcacacacagctgtccatcccaggtctggggtatccaacagctggcagggcctgtcccccaccccccaggcggcatggtggcacaaggggtcccgcgccccagtgccctggcccccgcccggggtctcaccatttcccgtatgctgccctccctcaacccagcggctgtgggccttttttttttttttttttttttgctggggggaagaggtttgccagatggatggggaaccctgggactccagaccaaggcagaggctgtgtggacttggcagggggctgggaggaccattttgggtttggtagcacaggtttcggggagaaggcctgactgctgcccacttgcacctccccccaacctcagacttggcccaggtccctcttcagatcgagatctgatcctaatggggcaaattcctcgagccttgctggggtcatgtccctactgggatgtggagaagcccccggcagaggcctccccaagtctcttaggaggtacccagctgccaccccacctgctcccctcccagatgctgtccaccgtgtgggggtatggacgttagggagggtccgggatgcaggtggctgccctcactccccgctgactgagacggccactgtgcagaaggacagagcagccccagcctttcagaggcagacgctgggtgtccagcccatcggggtccctggccccgctgagcctgcaggcctgggctgcctccctccactcctgctcctcacctgcagcccccttctgaccaggccagctcagggcagaccagactccccccaaccctcctgcttgtcctaggtcatgctggtgggggactcgggtgtggggaagacctgtctgctggtgcgattcaaggatggtgctttcctggcggggaccttcatctccaccgtaggcattgacttccgggtgagtggaggccctggcctggccccacatcagagtcccgccggtacccgagcagcaagttctctctgatccccatggtaccaacaggctcgaggcctggaccccagaagctgcctgcctcgaccttccaacacctgggctggtggctgcacccgacaagcatagttagttgccctatgccaggggctggcattaccgagggaccatatcctgtgccttgggggaggcggacactgttgcctacagggtggtgggtcagaggaagtcaagggccacgtccacttggggccagcagtgctgcctcggtacagaggccttactgggccctagaagcacatgctccctgcagagcctgagcgagggtttccagggcttgcctaggggagaggaccctgctcttgggtgaggagcgcccacccccacccccaccagctggaattcctcgtgctgaggtgccggcttgtcctcagcaaatcttaaatttgcatttttctcaccctttaattagagccagttagagggaggatggaggaagggctgttccagggacaggaaaaggggctccctccagtctggggagctgttctctaccccgtctgggggttccaagtcccctcaagtcctctgggatggagtgacgactgaagtgcccgaggggggcaggccagtcctgtctggtccccacttccccacctccctcttggctctcgggcaggtggtaagaggtgaggccatttggttcgcactctcgttcagggtgccagggaaggcggtgtcctccccagcccagcagatggccctgcctggttcccgggagacccagaagcactctgacagcaggagctcaggctgaaggaggtggcacaggttccagctgcccagggcctcagactgcggctgaagccccccgcccccaccccaacagatgggactggggctagaccactccctgccttacgtctaatcgttaactgggagggcccggctggggacgctgccaggcagttctgggatctgcggttactgccttgggtcagacaggcccaggcccagccctgacaatcccagcaaggagtggctttaattttttattcttttgaagcagggtctcactctgtcgccctggctggagtgcagtggtgatcatggtggactgcaacctccaacttctgggttcaagccatcctgagtctttcaaattagcaaaaagagctactgggaaggctgaggcgttgcagctccttagttactgcacccatttgcagatgaggaaaccgaggcagtgtcagtaagaggcctggtggggtcatgagttcaaataagtcagcgtaagaggctctaagcaggaatagtgcagaggctgccgggagaggcctgcacttgcaggtgtgggtgaggtcaaattggcttaagggaagcctgcaggggctgggctggacctgggagctgggaggtctcaggggacaggaaggcagtgaagctagtgggaccagaggctgggctgggcccatgccagagctgcctggttctgtctgtttcagaacaaagttctggacgtggatggtgtgaaggtgaagctgcaggtaaggtgactggcagaggacaagttgggggacaggggacaccagggaagggctggacagcctgaccagtgcctgtcgctgcagatgtgggacacagctggtcaggagcggttccgcagtgttacccatgcctactaccgggatgctcatggtgagcccctgggtacctgggctggttggggcgggggtctgagcacctgagggtgcaggtgatggtggatgtcctcactgccctctgtccccagctctgctgctgctctacgatgtcaccaacaaggcctcctttgacaacatccaggtcagtggctttcctggtggggtgaaagggccctgatagggcctgacccatcccaacctccttctggtagatggcatcagggttccaaaggaccccgctgagagaggggagggggaaatgacagccttctgggctggaggtggcccaagtggacctgagtgccattccagctccctcagcaggaggctttgtgtaagggacctgtaaggtgggcttctgtatgtggtacacggggggttatcacttctaaagacaggtatcctggccaggcatggcggctcacctgaggtcaggagttcgagaccagcctggccaacatgaggaaaccccatctctactaaaaatacaaaaattagccgggcgttttggcacacacctgtaatcccagctactcaggagactgaggttgcagtgagccaagactgtgctacggcactccagcctggacaacagagcaaaactgtctcaaaaaaataaaatgggctgggcatggtggctcacacctgtaatcccaccaccttgggaggctgaggtgggcggatcacgaggtcaggagttggagaccagcctgatcaacatggtgaaaccccgtctctactaaagatacaaaaaattagctgggcgtggtggtgcgtaactgtaatcccagtcacttgggaggctgaaccctcccaaggttctctgaaccccaggagaatagcttgaacccaggagatggagactgcagtgagtcgagatggagccattgcactccagcctgggaaacagggcgagactcttgtctcaaaaaaaaaaaaaaaaaaaaaaaagataaagacaggtgccctctacagtgtgacctggagggccaaagttctggggcatggggcaagccatgcagggagccccagcctggtctgctgcctcccacaggcctggctgaccgagatccacgagtacgcccagcacgacgtggcgctcatgctgctggggaacaaggtgggaggcccggctgtcctcacctgggccacagggcagggcaggtgagggggcaggggccaaccatgggccagctttcaccaagaccctgtgcctgggccaggtggactctgcccatgagcgtgtggtgaagagggaggacggggagaagctggccaaggtgagtcagggcaggggggtggtgagggggtgcccctggaggctgcgagcctaggctgtccccgccaggccaccacctggctggcagcagctgtttacaggagtatggactgcccttcatggagaccagcgccaagacgggcctcaacgtggacttggccttcacagccatagcaaagtaagtcctgccagtcaccaggactcccccagcccagggcctgaatcctcattagagtccaggccatcgtgtccccttgtcacccccactccgcagggagttgaagcagcgctccatgaaggctcccagcgagccgcgcttccggctgcatgattacgttaagagggagggtcgaggggcctcctgctgccgcccttgaacctggctgagctcagtcctctggaggaagccgcccagtccctagaaggctggacagagggtctccaggcccttctgactttgttgcccagtggccaacgcccgagtgtctgttttcaggagccccaggtcaagccttgtcccttcctcctcccagcaacagtcccaacaagcaggcttctgagagcccgtggccgcacactggccgccacggaaaagcagtcttctgcacgggacggggagcggcaagtggacagactttgccacggtgctctgctgccccctcctgggcacgtccaggtgagggagggctggggctggcaccacgcacagtgcctaaccctagaaaagccatgtcttcagccgcacatgctcaggcagctaagggaggacgcctgcccacgcctgggacagaaggcttcactgctaatcacatcgtgcatctgtgtgtcctgggagctgcctgctcccggcccaccctctaggaggctctggctcaaacagcaatagggtcttcctcactgaccttggaggatgcctgtggccttgtgataaaatgtgggaaatcacagaaaacaccagaaacaacaactgccagcccggcctggccacaggtgaggtctgtgatttccgagcacgctccaccttgcactcaacttggccttttgattgcacaagcctttgttttcagtcctagtgaataaagttgtgttttctggagcgtctgtctcatctgttgaaaaaaatccacttctagagcaggatgctggagtttgagagactcagcaaggcccagaaccctcagcaggtgtgtggctaccattcctccatggcccatggctgcctccctaaggaggcacatgggaaccctaggtggtgtcaacttccctccacaaatctcaaaagcctttttggactcaccctggggcaaaaggcatgaaaaacagtatttgactgggcgtggtggctcacacctgtgatcccagcactttgggaggctgaggtgggcagatcacctgaggtcaggagtttgagaccagcctaacacggagaaaccccgtctctactaaaaatacaaaattagccgggcgtggtggtgggcgcctgtaattccagccatttgggaggctcaggcaggaaaatcgcttgaggcggaggttgtgccatcgcactcccgcctgggaaacgagcaaaactccgtctcaaaaaaaaaaaaaaaaaatcacgggcagaaatggagaaggcaatcccaagagatgaaaagtcactggtaacgagcttccgttttcatgtctgtacccttttccaagattgcctgtggatcagccagacctctggggtgccagaataggaaaataaagacacttgagagaaaaccgaatcaactcactacctttctttattgctaagcacctcaatagacacagcgcccaccttaccgctaggccctccggattgaggtttacttaggttcaaaacttgcagccggctcgcgacgaaacctgaaagtcagcgccaaaatacagacattaagtccccactccttcgtttcgggcaacacctgtttccactctcagctccccgtcaggagtgcgcaccctcaagcctcagtcttgctaaataatcagactgcacgtgcagttttcatacgaggtgtcagaagtcaaagcaattcatcacagactgggagaataagggaacccaagcccggcccagtcttacctgcaggtagctgagggcctgagattcgggaagaaacctttaaacgctaagggacaaagtggtgcgtaggccaggcctggacgcccagggacctggccggcctgcagcgttcggacggccctcaaagccacgctcgtggctcagttcgtcccaagatcgtagcacatggcgaacgtattaacaaacctcttccccctcggactcgaccccgaaaagacaggggcgggcgaggctcaagcttttatagaaactgtcccacctctgtcattgggctatcctggcggaagtgcccgccttcccccgccgctggtacgctccgctccctgccgcgttgtttccaccaatcgtaccgtggcatttcttttggagacggtctctcagacccagacccgaagctcctcccttatgcagagtccgtgaagcctaacggtgagtgacggatgaacaaagccaatcagacttcgatctgcaacatagagtgattctgaagctgccattcccgccccgcgacgacgaggccgccggaagtcgtagtttcggaagtgcggcgcgtgaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggtgagtgtccccgcggcgcgcccgacccggggctcgcgcctcgggaccgcgcggtggggcgggatcgggcgcgtggagatcgaggcgaggcgaggcgaggcgaggggtcgggccggggcggggaggggggggcggggctgagacggtcggggtcggggtcagggtcggggtccgcgtcgctgtccgtccgccagtcagtagtccgtccctcgctccgtcctgttctcgcgcagttctttactcattccttcttcctgcattccccgagactcccgggtgccaggcactgttctgggcgccgggagac

SEQ ID NO: 16669 - DNA, 16154 bp, Human
tttgccatgttggcctggttggtcttgaactcctgatgtcaggtgatccacccacctcagcctcccaaagtgctgggattacgggagtgagccactgtgcctggcccacaattttttaaaagtatgtaagagggctgaggcaggcagatcgcttgaactcaggagttctatagcagcctaggcaacatggcaaaaacccatctctacaaaatatacaaaaattagctagtgatgggcacctgtagtcccagctacttgggtggttgaggtagaggctgcagtgagctgagatcacggcactgcactccagcctgggcgacagagcaaggtgctgtttcaaaaaaaaatctggccaggctcggtggctcatgcctgtcatcccagcactttgggaggccaagggggacggatcacctgaggtcaggagttcaaaaccagcatggccaacatggtgaaactccgtctctcctaaaaatataaaaaaattagccgggtgtggtggcagttgcctgtagtcccagctactcaggaggctgaggcaggagaatcgcttgaacctgggaggcggagattgcagtgaaccaagatcgtgccgttgcattctagcctaggtgacagagcgagactccatctcaaaaaacaaaaacaggccgggcgcggtggctcatgcttgtaatcccagcactttgggaggccgaggcgggcagatcgtgaggtcaagagcttgagaccatctaggccaacatggtgaaaccctgtctctactaaaaatacaaaaattagctggccatggtggtgcactcctgtagtcccagctactcgggaggctgaggcaggacaatcatttgaacccaggaggcggaggctgcagtgagatcgcgccattgcactccagcctaggtgatagagtgagactctgtctcaaaaacaaacaccccaaacaaacaaaaaccaaaaacaacccccatctccaaaaccaaaaattcaacgtggctgggagtcgtggctcacgcctgtcatcctagcactttgggaggccgaaatgggaaaatggtttgaggctaggagtttgagaccagcctagtctaaacagcaagaccctgtctctatttaaaatacataatgcaaataaattttaaaaaatttaaaaagtggctgggcacggtggctcacgcctgtaatcccagcactttgggaggccgaggcgggcggatcacgaggtcaggagatcgagaccatcctggctatcacggtgaaaccccgtctctactaaaaatacaaaaaattagcctggcgtggtggcggacacctgtagtcccagctactcaggaggctgaggcaggagaatggcgtgaacccgggaggcagagcttgcagtgagccgagatcgcgccactgcactccagcctgggcgatagaaagagactccgtctcaaaaaagaaagaaaaaaaaattaaaagtatataaaagaataaaacagcttcgcagagctacccatgagccatccccgacccgtgttcttttcccgtgacccgggtaaccatcttgggaggctctaacaccctaggcggtcagtgggcagcaggcaccacacccctggttggagctgtggcggcttcccagcagcagccgcgggcggggcgacctgtccttaggtacggaagcgctggggcgcggctgcctagcagccgccagtccgctcgcccctcgcgttctctggctctcaaatccgagtgcagcctcgaacataggtccttctgccgccccgccccctggctggcaatctgctccaccgtaaccacgccctccccacagtcccgccccatcttcgctctcagcgcgcccggccccgcctctgccctttaaggccacaccgctatccaggcccggctccccgcctgtccgtcaatccgctccggttctgccccgccctcctcttgccgttccctcacgctggcctcggcgcggcccgttgttatgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaaggtaaccgggccgacccggagggtgcggccggggtgcgggcagttcatcccgggctggcagaggcccggatggcccgagctgcgggctcgaccgaccctcccagacccagacacctcgcggatctcgcgggaccctcacagccctccacgaaacccccaggtttgctgcgaccctcacgggcctctcctgcggggcgcctgtcatcccccctctctggtgtgcgtccacaagtgctcgcgggttgctgagcccccgggcgcccggtgtagacattcgcagacgccggcgtcccggcccttctctgcctccgatgcctgagcctggccctcccctcctctgggccccttcctcctgcacctgatgggcgtctagggccctgttggtggttccaagagggtggggcctcggtttctccaggatctgggctctgggcctgtccgtagggaggcagcagagcctagtgcaagagggctggtgcactgcagccagcctgtggccccttccagtcccacacttgccgctttctagctctttgatcctgggtaggtgaccctacctctgtgaacctctatttcccctacagaatggggcggcggcttctgccagtaatgtaacaagcccttatcctgctttaggttttttcattctcaaaccagtcctgacaggtggatgttattgttattctcattttggggatgaggaaaatcgaaggttggagacctgaaagtgaccgggtgggctgggtgcggtggctcacgcctgtaatcccagcactttgggaggtcgagacgggcgggtcacgaggtcaggagatggagaccatcctggccaacatggtgaaacccgtctctactaaaaatacaaaaaaacaaaattagccgggcgtggtggcgggcgcctgtagtggggaggctgaggcggagaatggcgtgaactcgggaggtggagcttgcggtgagccgagaccgcgccactgcactccagcctgggcggcagagccggactccgtctcaaaagaaaagaaaatgaccagggtcacccaggtagttaagtagcaagggttggattggatctcagcactgtgaaggccttcacagcccctttaacttccgggctctgctgcctcatagaagcatcatgggaattaaaataaagattgtggccaggcgcagtggctcacgcctgtaatcccagcactttgggaggccaaggtgggtggatcacctgaggtcaggagttcgagaccagcctggccaacatggtgaaaccccttctctactaaaaatacaaaaattagctgggcgtggtggtgcgcgtctgtaatcccagctacttgggaaggtgaggtaggagaattgcttgagcccaggagacggaggtcgcagtaagccgagatcgcaccactgctctccagcctgggtgacagagcaagactgtctcaaaaaaagaaaaaagattgtgtgtcatgtgccgagagcagtgttggggatgcactaagggctcattcctgggggcactgagagcttttggagatggagcttgggtctgtaccctctgagcttgtcctatgaggctgcagatggctgggcactgtggctcatacctgtaaccccaacactttgggaggctgaggtgagaggatcacttgagcccaaggagttccagaccagcctgggcaacatagtaagaccccgtctctattttctttttttttttttttgagacggcgtttctctcttgttgcccaggctggagtgcaatggtgcgatctcggctcaccgcaacctccgcctcccgggttcaagctattctcctgactcggcctcctgagtagctgggattacggcacgcggcatcacacccggctaattttgcatttttagtagagactggatttctccatgttggccaggccggtcttgaactcccgacctcaggtgatctgcccgcctcagcctcccaaagtgctgggaatacagtcgtgcgccaccgtgcccggctcctcccagtctctgtttaggaaaaaaaaaaaaaaaaaaaaaaggctgggcgcaatggctcgcgcctgtaatcccagcactttgggaggctgagacgggcggatcccgaggtcaggagatcgagaccaccctggctaacaggtgaaaccctgtcttactaaaaatacaaaaaattagctggccgtggtggcaggcgcctgtagtcacagcttctcaggaggctgaggcaggagaatggcatgagcccaggaggcagagcttgcagtgagctgagatcgccccactgcactccagcctgggcaacaaagcgagactccgccttgaaagaaaaaaaaaaaagatgcagattgggtcagacaggaagggaggttgttaatgattgggttgagggtggtcttgtctttgtccccataggattcatagtctctgccttttttccttgccccttctcgttccagcttggagaagggcagtgccctcatggcgaggagtccctttagaggttgctgggcctgcttgtggccttgtctggtgtgaaatgggctgggtgtgtccccttctggggtagggggttcttcagtggcaatgccctggagccgagtgagacacaggagtagggtgggaaggggaagagggtggtgggcaccttagagcttggtttgtgactgggagccatcaggagaggacgactctgttgggtggcccctgcaggcgagtcatagctgtggtttggccctttctccgccctcaaattcaacagtaaacatttgcccagctccttcgggcatcaggcctgggtttgatcctgccgagggactgaaggtgaatggtcagagctggcaggcttttatggaagcagaagaaacagctcctatccctttgtgtaaacaggcactgtccctgacactcagccgtttggtgaccttgaacttcaggtcattttcctaggatgggaatagttctctccatttccacagggtgctggcaagatttggtgacgtccccagtgaggtgcttggcacacagtgagggggtggtctcttctgcacgaccggggtccggcacagcaatggtgacgggctcaaccttgggaaccagtaaagtcccaagtcagtgagcagagtggttgtgggtcagctccctgcatttgcctctcagccagagccagtgggcatcagtctcctgggccccagcccattttacagatgaggagatggccactcacatgctccagggcacgctcaaactcccgcagtttttgtttgtttgttttgtttttgtttcttttaaggcagggtcttgccctgttgccctggctgaagtgcagtggtgtgatcatggcttactgcagcctccacccctgggctcaatcaatcctcctgaatagctgggactacaggtgcatgccgccacacttccacgcttggctaaatgtttgttttttggttttgttttttgagatggagtctctctctgttgccccggctggagtgcaatggggagatcttggcttactgcaaccttcgcctcccaggttgaagtgattctcctgcctcagcctctcgaatagctgggattacaggcatgcgccaccaagcctggctaatattgttttttttgaaacggagtctcgctctttcgcccaggctggagtgcagtggtgtgatctcggctcactgcaagctctgcctgccgggttcatgccattctcctgcctcagcctcccgagtagctgggactataggcacctgccaccatgcctggctaagttttttgcatttttagtagagacggggtttcacggtgttagccaggatggtctcaatctcctgacctcatgatccgcccgcttcagcctcccaaagtgctgggattacaagcatgagccaccgccctaattttgtatttttagtagagatgggatttcaccatattggtcaggctggtctcgaactcctgacctcaggtgatacacctgtctcagcctcccaaagtgttgggattacaggtgtgagccaccacacccagcctaaatgtttaacaatgttttaaaaacttttttttttttttttttggtagagatgggtcttgctatgttgaccaggctcgtcttgaactcctgggctcaagctatcctcccaccttggccccttaaagtgctgagattacaagtgtgagccaccatgcccggccccagcagtcttaaatcctggtcctttactgtccccaaattagcatggaggagtccctctgcctcccagcccctctctgggcctctcgcctgtcagtcgctgaggtgggttttgagcatggcagccttagcaggtccctgcagcctaagcgtgctgtcagggccaccctctgctgggtgctgacctcctgagggtgggtctggcccctgcagacctgcagaggataggggctgtaccttgggatgaccttgttttgggcccgagtgtgttctcagcagcctggggaagtagctctgcttctgatggcctcctgggggaatctgttctagggctggaggaaaagccagacggagccctggctgcccagcctccgccttcccaggccctgctgacagcaggctcgttgcagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtgagccctcacccactcccccatcccctcccgggttcacctgacaggtgggggaggtggccgcgcttcaggatggacctgtgcagccggttccgggggccacgtgggcgggcagagggcaggcacctggctgcggtgtgggagggtccgggtgtgtgagcctgtggtgctctggggcgtcctggagggcctgcggtggcccagccttcttggcagcctctggtcgaagcccgtgctgttgggggccgggatctcttctttcttggagctggagggtctcctttggctctggggtaccatggcagcttctgtctctttggcttatcttctgtcctgtgcacacagtccctagggacttcacacgtgaagtgtggccctggggggtcccgccatctcatcagcaaatggccacctttgctgagccccacgcccagcttgggctggatacacaggcctgtgaaccccgcacacgccgcagcgggcgcttgtcatccgcattgcacggtcaggagagcaggctcagaaagtggtcagtggcctctggccaccagtgggccgtggcccagatgatgctggaccctggacaccccactctgagcctgtgctctttacctgctcctcccagaggtgccccctcctccaggaaggcctctggcccacacctccagggccctctcctcacaccgctctgccggatgtggcgggctgggactgtgccattgttcctgcagactggcccagcttcctgccagagttgctgctccctccctgcaggcgccctgtgctccaggtccagcccacgtggccagaggtgtgagagtgacggcgctgaccctggcccgggggtgaagggattggactgggaccggtggtcgtgttggggaagaggagagcccccaccccagccgtcccaaggacgtggacccaggcctgagcaccacaagtcacacctccacagctttacactggcagagcccaggcctcttctctgagaactaactctggagcatacagacgactcccctgttttcttccccctttggcaggtggtgccggcagcaccaggcccagaggagcccatcactgtggcccacatcgtggtggaggcggcctctctggcagcagacatcagccacgcatctgaccttgttggtaagccgacttccatgaatcgctggcctgatagaccttcgtggttggggccagaggatggggcccctgctgcctgtatgctcgtctctcccgagaccagggcctggctgggaggggccgcggcctcgtggcagcctttctgcgggcacagcctgcaggaggaggaagcgttgggcactgggccttcctcaggtgtccacagtggccgggggcacacccaggcaccagggagtcattgggctgtgctctctcccgtcagctttcccgggtggtctctgccgtgtccctcccagaatcttccccacttccctgccaccccctggttcctgctccctgcccgtaggcagcaacatccaccaggcacccaccagaatggcccactcgcccagcagcggctctggagggtgggtacagggtggacgggactctcccgcctctctagctgggctcggacttgctgctggccgtggcctgccctccccagtgctccctctggtgtgggagtggtgattgctacactggtcctcatggggcttttatgagcgtgcaatgccaggactctttgatggctactttttaagtgaagatgtctctctccctaatgtgctgtgggaggggctgttgcgaggtctggatgggcaagctctcatcggggacagatgcttgtgcaggggggcattcagaggcagccagggcctgggcaggttgagggagctaggggctgctggggttgggggtgcggcaggggcgagtggctaggtgtgcagacgcgagggaaggagctgtctagggacctgatgctgtgggaggtggggcggggcatggctgctgcctggggagcctgctggaccggggctgaggcaggcggggagtgggcagctggacaggaagtaggtttgggcaccaggcggaacctggccttgggcagccctggggactggctgcagcaggaagagggggtggaggagccgtggcggaggccaacccggggcctgggaagggcacctgtgagcaggctgctctccaggaggcagccagggcacctgtctcacctccgtgctgcctttccctggcattcctgcgaccaagacactcatcaatgccactcagagctcggaatgttcatgtgggaggtggggcgggctctggccttgacctggcgtttggtttctgggatggtggcgtcacctgggagcatgaactccttaggttctggcggggtctctgggctgggtctctggccagccaggcccctttccacccacctaaactctagcagcctccagccctaggctcagcacccctccctgtgcttcagcagcccctcttggcacccctgccactctggcacccctgggattttcccctttgcgggcatcctgggtactctgtgtgtgcccttggccagtcagcaggcccggtgggcttagtccagggctgctagctctcctgttggcctctagtggagatggcacagggtcctgcctgctggtggccaagggctggggcgtgccaggtcctgtctttgcgggtgcaggggtgcggtcagctgtgtgggcagttggaacccacctccaggccctcctgccgcttcgcggaaaaagttcgcgtctcctctggcctcgcagcagccatgttcccccaggtcctccccatcagaggcctctgtcctttggaagatcactcctggggcatcgagcgtgtaagggctcgggcaggagaggctcttaattgtttctgagtcaccacgcttttgtcgtgtttcaagagaacagcttgtcaaaacaagacgccagccggactgaggtggtttctaagcagtggcttcacagctgtttcccacttgtcatctttatgagcagaaaacctgaactgtgtttacaacctagctttgcacattgtcagatttttcccagcatcctccagaagtgcaaaagcccagcttcctcgcctcaggctgtcccgggtgtctggagagcgttcactctcccaggccaagcctgccttgggacggggctctggccaggcctgcctgccctgctgcagtggcccagcccatctcctccgatggaagagtggccccggacgcacatcctccctatgttggtgggagcagtggcaggagcagtggcagcgagcaggacaggcggctgtctcttcacccaaggaccttgtcaccaggattcgcacgtcctcctggctttggggatggggcatctgtgctccatggtgggtctccctgtggacacatttaggggccctggagcatctctgggcagcctgacagagtcgggaggtgtctctccacctctcactctgacctggagaggtgaatgggaccttggctgttgctcggacctgtgtgttgagggctcagtgcaggttgggtccagggtgtggctcagagcagcaggtcccctcccctggagccagcagtctctggggtctctggacaggggcaggtcctggggcttaggcccagatgcttctcctaggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacggtgagccggcgtgcggggagccagtgtgtgggtggcaggccccctcctgttcccccaggagggccctgagctgccacgccctcccccacagggcagcatcctcaaggcccacatggtcactcacagcagccgcaaggaccacgagtgcaagctctgtggggcctccttccgcaccaagggctcactcatccggcaccaccggcggcacacgggtgagctggccgcacctcgggctggagcccggtagcaccccgatggttggccctggggtgccccagcctcgcattccccagctttgggggatgaggcgggggcccctgcctgccttcgccttgtcaccttgtcgccagcctgctggggctgcccggggctgactaggttctctctgcagatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggtcagcatggtgcgggcagctgcctggtcctgggggctggctgtggacgcagccgccactggggtgtgtgagggatcttcactccctcactccaccttgaaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagaggtgggggcgacggggggccccggagggctgctctgtcttctgcctgctcggtgccagtctttgttctgggcactggctccaggggtctgagccaggcaggcgagggctgggcttcccacagggagagcagggccagtgggagcgccatgggggtctgagggtttgcacaaggctcctggcgtgcgtctgccccatggggtgggtgctggatgccaggctgcctggccagcctcctctctctgcctcccctgcagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacagtaggtgccagcaccacctgcgggctcctcccagggctggatcccaggggctgtccccacgctggccttcgcctccctgaagtggctttctgcagtgactttgtccattgatctgtttactgccttccctggggccacaagggagcctgccagggtggggcccatggttgtgttcttggtactgccagggcacagcctgccccgggtgctggagaccttcctgtggttccccagcaggtggccagcgaggcctcagcggtgcccaggacccacccatgtcctcagtgcagtgagaccttcccgacagcagccaccctggaggcccacaagaggggccacaccggtaggtgatgggtgggtgtgtggcccatggcagtggatgggctataggtggccggggtgcttctgggtgtccagggtgggtccatagacagcagggagccaggggatctgtgggcaggtggcaggcggcctggcgggcccgcgggtgatgggcttggcctgatgctgtgtgtggctgcagggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaaggtgggtctctggccgcaggaccctggcgcctgatccccccatcctgctccctggccgtggcccaggtgcacccccttccctgcctccaccatgctcagtcttgacccagcccctcccttgggccacaggcgggaggggagagctgtagtctgttgtggccaaggccaggctggcactgacaggtgtctccacagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaaggtctgggccggtggaggtgggagggggaggggagggggccggggcttgcctagccctgaccgagtccccacccacagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggtgggtgtggggccctggggccgtgctgggacccaggggcagccaaggctgacctctgtccttctgcccatctgcccaggccactgcggacgatgcggagaccagtgaggccacggagatcatcgagggcacccagacagaggtgaggggtagggcaggcgggggcggggaggctccctggcacagccgctcttgctgagccgtggccctgcaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccatcgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgcagcttgtgatgttgtggcagtggcagcctccgcggctggtgccaccacctttgcccaggcccccgcagcagcacctgcctcccaggccactcctagactcacgtgcctggccgccccacccaggggcttctgccagccctggcggcgccttggtgctgtgtgggtgtcattggcatgttgaccaacagcctcctgccctgcccagctggagctgtgcccccagctgcgctgcctgaggcctgtgggtgggtgggaggaccagggacggggacagggagatctgggagcctcggcctccaccgcagggtgagcaggtggagcagcagcaggagatgctgggtagggagtgtggctggtcctacctgcgctgccttgctttccctgaagggattctgctcagggaggcagagtctaggcgacctaatttctaggggcgaggacaagaacacagccgcaccgggatgtggctgaccgtctacctccctcctagggggctggcaggggcttctgggacggttttgggacaggtctggggcaccagaaccggctcaggcaggtctcccaccccttaccctgggggtctccatgggaatgaaagccaggagttcatcaggcacccagctgagtcgagggggcgggacccagtgcagcccggcccctccctggcccaggacctcaaataccggcccctgccttggtgccagagctactgccagagggagtcagtgcagtcctgtgtcggacacgcccgcagcctggacccgggatccccatccccctaggatctctgagcctcgggcctctgcacccacatccaaggtgagtctctcggctgccctgagctggggctggatgggccggaccctccattccggctgcagcttcccgcgcagtgagaaggcagcggtccctgagagcccagcagtgccctgggagcctgcagaacgcaggggcggattccgcgtcgcactggccgtcaaggggcggccgcggagggaaggggtgggtcggtgggtctgacagcgggtctgcgtaggcggcagcgtctgtccctcccagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaaggtggggcccgggccggggcggggcggcgtttaggggtgctgaccgcgctgacccccgcacccgccgctcctccccagatcctggctggctatgacctcgcgctggtgcaggaggtgcgagacccagacctcagcgccgtgtccgcgctcatggagcagatcaacaggtgtggtgggcagggcccctcgtcgcgaccccccgccgggatctcgccccggcgcggcgccccgaccctgagcgggcccctgtctccgcagcgtgtccgagcacgagtacagctttgtgagcagccagcccctgggccgggaccagtacaaggagatgtacctgttcgtgtacaggtgaggggcgggccgcagggaggggcgcgcggggccgcaggtcgggggctcagcgggtcctccccatctcctaggaaagacgcggtgtcggtcgtggacacctacctgtacccagaccccgaggacgtcttcagccgcgagcccttcgtggtcaagttctcggcccccggcaccggtgagcgggccccgcccctcccctcccgccgagctctgacgcccccaccccttcccgcagcagcacagaacctggtgctgatcccgctgcacgcggcgccgcatcaagccgtggcggagatcgacgcgctctacgacgtgtacctggacgtgatcgacaagtggggcaccgacgtaagcccacccctcggtcccggggtccctgcaggcgcgccccgggggtctggttcatgagggcgggacctcgacggctcctgcggcggctc

SEQ ID NO: 16670 - DNA, 5886 bp, Human
agtgcggccgtggcttcgccgagcacggcacgctgaaccggcacctgcgcaccaaaggtctgggccggtggaggtgggagggggaggggagggggccggggcttgcctagccctgaccgagtccccacccacagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggtgggtgtggggccctggggccgtgctgggacccaggggcagccaaggctgacctctgtccttctgcccatctgcccaggccactgcggacgatgcggagaccagtgaggccacggagatcatcgagggcacccagacagaggtgaggggtagggcaggcgggggcggggaggctccctggcacagccgctcttgctgagccgtggccctgcaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccatcgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgcagcttgtgatgttgtggcagtggcagcctccgcggctggtgccaccacctttgcccaggcccccgcagcagcacctgcctcccaggccactcctagactcacgtgcctggccgccccacccaggggcttctgccagccctggcggcgccttggtgctgtgtgggtgtcattggcatgttgaccaacagcctcctgccctgcccagctggagctgtgcccccagctgcgctgcctgaggcctgtgggtgggtgggaggaccagggacggggacagggagatctgggagcctcggcctccaccgcagggtgagcaggtggagcagcagcaggagatgctgggtagggagtgtggctggtcctacctgcgctgccttgctttccctgaagggattctgctcagggaggcagagtctaggcgacctaatttctaggggcgaggacaagaacacagccgcaccgggatgtggctgaccgtctacctccctcctagggggctggcaggggcttctgggacggttttgggacaggtctggggcaccagaaccggctcaggcaggtctcccaccccttaccctgggggtctccatgggaatgaaagccaggagttcatcaggcacccagctgagtcgagggggcgggacccagtgcagcccggcccctccctggcccaggacctcaaataccggcccctgccttggtgccagagctactgccagagggagtcagtgcagtcctgtgtcggacacgcccgcagcctggacccgggatccccatccccctaggatctctgagcctcgggcctctgcacccacatccaaggtgagtctctcggctgccctgagctggggctggatgggccggaccctccattccggctgcagcttcccgcgcagtgagaaggcagcggtccctgagagcccagcagtgccctgggagcctgcagaacgcaggggcggattccgcgtcgcactggccgtcaaggggcggccgcggagggaaggggtgggtcggtgggtctgacagcgggtctgcgtaggcggcagcgtctgtccctcccagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaaggtggggcccgggccggggcggggcggcgtttaggggtgctgaccgcgctgacccccgcacccgccgctcctccccagatcctggctggctatgacctcgcgctggtgcaggaggtgcgagacccagacctcagcgccgtgtccgcgctcatggagcagatcaacaggtgtggtgggcagggcccctcgtcgcgaccccccgccgggatctcgccccggcgcggcgccccgaccctgagcgggcccctgtctccgcagcgtgtccgagcacgagtacagctttgtgagcagccagcccctgggccgggaccagtacaaggagatgtacctgttcgtgtacaggtgaggggcgggccgcagggaggggcgcgcggggccgcaggtcgggggctcagcgggtcctccccatctcctaggaaagacgcggtgtcggtcgtggacacctacctgtacccagaccccgaggacgtcttcagccgcgagcccttcgtggtcaagttctcggcccccggcaccggtgagcgggccccgcccctcccctcccgccgagctctgacgcccccaccccttcccgcagcagcacagaacctggtgctgatcccgctgcacgcggcgccgcatcaagccgtggcggagatcgacgcgctctacgacgtgtacctggacgtgatcgacaagtggggcaccgacgtaagcccacccctcggtcccggggtccctgcaggcgcgccccgggggtctggttcatgagggcgggacctcgacggctcctgcggcggctcagacacggctccgcggcgcccgcaggacatgctgttcctgggcgacttcaacgccgactgcagctatgtgcgggcgcaggactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattcggcctggaccagactcaggcgagtgggccgtggggcggtgctggtcttgggtccccaccgcccgggcgcacgcaggcagcagggagggtccagcgcccaaggcagggccacctcagcttcctccctgcaccagggctcgtttccaaggaccctggagagcccggcccaccccatgtggagctctgggcaggcagggtaccttgcctttccctcaaagggccaatggtgacaccctctgccccggcccctgcccctgccccaccgcaggcagcagcaggggtgggcacccaggcctcaccggcccctcccatccctgtgggtggggtgcacttttcccctgaggctcactctgtccccacaggctcttgccatcagcgaccactttccagtggaggtgaccctcaagttccaccgatgactcgaggcctggctggggcatgccacctgcagaccctggctctgaggaatggcccaacagtggccccttcagggtggcagccacccttcagtgaggccccaaggcagagtcggctgggcgtggaccaggggccatggacacgtgatgtgctgctctgtacctccgttccccatctgtgggacgggctgcatccagcgacctcatggggtgttgtgagccccatgaggggtgcagggggcactgcccggcagatgtctgctcaataaatgagctgctcccggtcgggccccacagcttggctcccaggcctctgtccttccttaggacccagcctcagctccttaggggcagccatggcctgggctgcccaccccatgtcctggtgggacgtggctgcccccggagcctgctggccccagaaggcagctcagggatgctccttgctcatcctctgtggaaactacaaacgctcccaggagcctgtactgtgagcacagctgggacagggatggcgccaacacaccagcctcctgggccctcggggctctcagaacagctctccccaggcccaccccgcagcccccattccagggccctgcaggggcccccaggcacttgtctgtctcaagagcccggtcttacccagcactgcaaggggaggccagccccagctagtcagcagccctggagcttttggagagcctgagagcagtgggcgggctggactcctccctgcccaggcaggtggcttgggactaaggtcccgtgcaaagaaccgcccagctcgccgtggctcagcccttcaaggctgctgccctgtgcctgggcaaggacacattaggatagggaaaaggcaggcccacgggtccactgggtcactgactggggcccgatgaggtttctggtttttgaaacatcacatcttagcaagatgtggtaacttggtctgaatcgcatgggaggaaaaacctttgtttcaagggtttggatgagtttggttcttgcaaaatccttcttaagggacatttggatccctggcagcacagctgcctccagagtcccactcccgctggctcaggatcccccagttgctctgattcactgtgcgctcttcatcctgatgagtaagggcagtgaccaaagggcttttccctggggagttctgtgtgggtcatgggggccaagaccacctggccttacacctaagagcaggcagtccaaaggccagaatggatgaccagggacttgacttacgattctgccttgggaacagagacactccgtggcaacctcaccaggtccagaatggcatcccctgccagtcacaatcccaagtcaaaaggctgccctccaactccccttgcctgacgggcacaggcacccatgtgtgtttgtgtgtggctgggccttgggccactgggctatgaggaacaggaacttctacgtaacatcagcaaaatgaaacgctggcagtacttttaagttgaaaaataccttgtttaagacctccctgggacccacaggggcacgtgtggccgtaagcctgtggcagcccaatcgttagcctttttcttctttgagcctctctaagtacatctgcagggacttctggatggagtctttggagatgaagctgacgaagttctgcacgtccgcatcgcgctgcgtgaccaggcggctggccgtggcctttcgcatcatggccttggtcagctgtcgagcatggtctaaagagaatgggacgtgccactgaaatcccactttcaggggcagtggggtgattcccaacttattttttatttttattttttgagacggagtcttgctctgtcgcccaggctggagtgcaatggtgggatcttggctcactgcaacctccgcctcccgagttcaagtgattctcctgcctcagcctcttgagtagctgggattacaaccgtgtgccaccacacccggctaattttgtatttttagtagagatgggatttcctcatgttggccaggctggtcccgaactcctgacctcaggtgatccacccatctcggcctccccaagtgctgggattccaggcatgagccaccacgcccggccctaatttttttttgttttgttttgtttttaaagagacaggatattctctgtcgcccatactggagtgcactagtgatcacgactcactgcagccttgaat

SEQ ID NO: 16671 - DNA, 16112 bp, Human
ccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaatctagttctgggttcactgccttctcacttgtcccctcgcccctagtaactttctgttcctcaccatccgcagtggcacctccgatgctttcagccaggagaacctagggtttgtgtgctgtggggaccaggttgctcctagggtggacaaatagaaggagatggttttatcgccaccttggaatgtgtgtgtgttttcagacagactctcgctctgtcacccaggctggagtatgtaccatggtgcgatcatagctcattacagcctccaactccttcttcagtgtccagagtagcaggggctaatttttttttaattttttaattttttttttgagacagtctctgttgcctgggttggagtgcagtggcgcaatattggctcactacaacctctgcctcctgggttcaagtgattttcctgcctcagcctcctgagtagctggaattacaggcacctgccaccatgcccagctaattttttgtatttctagtagagacggcgtttcatcatattggcccggctggtctcaaactcctgacctcatgatttgcccaccttggcccccaaagtgctgggattacaggcatgagccaccgcgcccagcagcaggagctaatttttaagaattttttgtagcaacaagttgttgctatgttacccagctggtcctgagtcactggggttacaggtgtgtgtcaccatgccaggcttgcttcctcctccgttaagtggccatttttccacctcaaaaattggtttgggacacaaggaagaattggaaatgcttaagatgagaacaaaagttgagaccacccaacacagctgggaccttactgcccagtgctcccagtggtctgaccaaaaccccacaccagacagtacaaaggcccactcccgagctgccgcttacggcccagcgggaacagactgtattcttatctttcggcatttctctgcaaataaaaaggtgccactgcggtccggcctttgtgcacttgcccttgtgctgagcaaggcgggtggcctgttcttaccgctgggttctgctgcccccacccccatttcggtgactaaacctgcagctctgatcctgttcccaaaggggcaggaggccgggctcaccccaggcagcccctggcctccctgacggccccctcgggaggggttccgtgctttgatcgcctttccagcgccgatactgcagtagctgggcccggccgagagctcgcggtcacgaacaccggcagcctcttgcctacagtgtcccgcgctgtagaagagcctgccctggcgctgagctggtcgtggctgcttcagcagtgggcctgcgcctccttgtaggccagccctggcccagatccaggtgcctgccccggaagcgcgcggctgcccggggtgaagccggagggcggcgagcggctgtttcggccggtaggtggaggcgttgaccagcctctgggaacggggcgggacctagttgggggggctccgccccctccccaggaggcgagctcagcccgcgacctttatcccgcgcgttgcggtcaagatggcgctggtggcttctgtgcgagtcccggcgcgcgttctgctccgcgcgggtgcgaaacccggggtgggcagggatcgggccggggccggggccaggaccgggaactaacgggctcccccacgctgccttcgcaggggcccggctcccgggcgcggccctcgggcggacggagcgggcggccggcggcggagacggcgcgcggcgcttcgggagccagcgggtgctggtggagccggacgcgggcgcaggtgagcgggcggcgccgagggagggcgggcgtggggtcaggacccgcgggggtccgcgctcgcggggtgctgtcggagaaccacgtctgtcgacgctcggtttgtgtttagaacccaagtttcgaaacagaaccttgccgctctacctgggttcgttcgtcatgagataaaagtttctgtttttaaagttggcggaggccgggcgcggtggctcacgcctgtaatcctagcactttaagaggcagaggcgggcggatcacctgaggtcaggagttcgagatcagcctggccaacatgatgaaaccctatctgtactgaaaaatacaaaagaaaaaaattagctgggcgtggtggtgcgtgcctatgcctgggaggctgaggcagaagaatcgctggaatctgggaggtggaggctgcagtgagccgagattgtgccactgcactccagcttgggccacagagcaagattccgtctcaaaataaataaataaataaaaataaagttggcggggatatgagctgttatctaagttattcaattggaagtggaaaagaattggaatcttttggaataaaattacgtttgttaacactcccatgtggcacagaacctcgtacctacccgcccgtcagaacccttggtaaaacccactggaaaggatagaaaaagtacttttggaagagaagcctgtgcgctccctccagacaggaggccgagctgagggcaccgagagggcacgcctaggcgccagcagttctgcttccaggacatgctgacctggacctcccggtgcagcagtccctgctgtggctcctgagaggaggccctccccctccgcaagtaagtcacagcccctgccctccccaaccccccagactcagggctgtgcccaactttgcacagcttcaggactccaggctcctggtgcctctgaacttggttccgtcctctctgtctgggctgagggagctgcctgggctctctctacaaacttgagagggacaaactaagaccaacttcaaactgactttttttttttttttttttttttttggagatgtagtcttgctctccagtcgccagactggagtgcagtggcgcaatctccgatcactgcaacctgtgcctcctgggttcaagcgattctccctcctcagcctcccaaatagctgggattacagggacccaccactatgcccactaatttttgtaaaaactgagtttctgaagggatcatttctgtagcatatttgaatatatctcaacaaaatgcaaaaaaaaaaattattatttttttttttttgagacagaggctccctctgtcacccaggctggcgtgcaatggcgcggttccggctcactgcaatctcagtcaggcctgactttctgactccaaactctactttgtctttttttttttttttttttttttttttttttttgagacggagtcttgctctgtcgccaggctggagtgcagtggcacgatctccgctcactgcaagctccgcctcccgggttcacaccattcttctacctcagccgcccaagtagctgggactacaggcgcccgccaccacgcccggctaattttttttttttggtatttttagtggagacggggtttcaccatgttagccaggatggtcttgatctcctgacctcgtgatccacccgcctcggcctcccaaagtgctgggattacaggcgtgagccaccgcgcccggcttacgttgtctttttatatggtaaagtggggaggcactcgagtaaaaaaattgtcattgtacgaacacttttccttttttaccggaggtaatgtgtgtgtgtgtgtacataaaaatctttaaaatatgcctcacatttaccattctagccattttgcaatgtacaaccccgtggccgtaagtatattcacaatgtgtagtccacactacccattccaataccttaagataacatgtttttgagtccgggcccggtggctcccacctgtaatcccagcactttgggaggccagggtgcgcggatcacgaggtcaggagattgagaccattctggctaacacggtgaaaccccatctctactaaaaaatacaaaaaaaaattagccgggcgtggtggcgggcacctgtagtcccagctacttgggaggctgaggcaggagaatggtgtgaaccccggaggtggagcttgcagtaagccgagatcgcgccactgcactccagcctgggcaacagagcaagaatctgtctcaaaaataaattaattaattaaataaaataaataaataaataaataggaatgacaaccacatggatgaaccttgaacacatgatactaagtggacaaagccgacaacaaagcccggcggtatcccagtgatatggaatatggctggagcaggaaaaccgcagacacagaacgcagactggcggcttccaggggctaggggtgggatgaggagcaactgctcatggggacagggattccttttgggacaatgaaaaggttctggaactaggcagcggcgatagttgcacaacacagtcagtatactgaattgtgtaagtgcctgacttgtttacttaaaaatggctaatttaggctgggcacagtggctcatacctataatcacatcactttgggaggccgaggcaggaggatcacctgaggtcagaagttcatgaccagcctggccaacctggtgaaaccccgtctctactaaaaatgcaaaaattagccaggcatggtggtgtgtcctgtaatcccagcttctcaggaggctgaggcagaagaatggcttgaacccaggaggcagaggttgcagtgagccgagatagcgctgctgcactccagcctgggcaacagagcgaggctcttgtctcaaaaaaaaaataaagatagaaaatggttaatttggccgggcatggtggctcacacctgtaatcccagcactttgggaggccgaggcgaggtgttcacgaagtcaagagatcgagaccatcctggccaaccaacatggtgaaaccccatctctactaaaaatacaaaaattagctgggcatagtggcgcatacctgtagtcccagctactcaggaggctgaggcaggagaatcgcttgaacccgggaggtggacgttgtagtgagctgagatcgcgccactgcactccagcctgggcgacgagcgagactctgtctcagaaaaaaatgatagagagagaaagagagaatggttgatttaaaaagcatgcagtttatatagaataaataaaattgttaatttatgttatatcgatcttacttcaatgtaaaaaaccaagggctcactcctgtaatctagcactttgggagcctgaggcagaaggaccacttaagctcaggagttcaagaccagcctgggcaacaaaataagacctcgtctgtactaaaaaataaaaaagattaactgggtgtggtggcgcttgcctataatcccagctactcagcaggctgagttgggaggatcgctggagcccaggaggtcaaagctgcagtaaccagagatcacacccctgcactcctaggtgatagagtgagaccctgtctcaaaaataataataataaaaaaataacccccaggccgggcgctgtggcttacgcctgtaatcctggcactttgggaggccgaggcgagcggatcacctgaggttgggagttcaagaccagcctgaccagcatggagaaaaccccgtccctactaaaaatacaaaattagctggatgtagcggcacgcacctgtaatcctagctactcgggaggctgaggcagtcgaatcgcttgaacccaagaggcagaggttgcggtgagccgagatcgctccattgcacttgaacctgggcaacaagagcaaaactccgtctcaaaaaagtaaataaaaataggaccaggcgcgggggctcacgcctgtaatcccagcactttgggaggccgacgtgggcagatcgcgaggtcaagagatcgagcccatcctggctaacacggtgaaaccctgtctctacttaaaagaaaaaaattatccgggcgtggtggtgggcacctgtagtcccagctactcaggaggctgaggcaggagaatggtgtgaacccggaaggcagagcttgcagtgagctgagatcgcgccactgcactccagcctgggtgacagagcgagactctgtctctaaataaataaattaataaataaaacccccaaaatgcacagctatcatggcttagttgagggtgcaggctggtcaggctgcttttccagtgccaggtgtgagctttctcttctcattctttaaattaggggtcgctgtgatgaaattcaagaaccccccagtgaacagcctgagcctggagtttctgacggagctggtcatcagcctggagaagctggagaatgacaagagcttccgcggtgtcattctgacctcggtaggtgctagttcagctccctaccccagcccgagttcttggcctgagttctctgatgtgagcccaggcctgttgcacatggaagaggcagagcctgccaacgtgtggcacaggccagccggcagccccaccaccctggactccaggcgccttcacgggaggcttccaggagcaccgtctgggtgtgccccagcagggacccaaactgccatgggcctcaagcagatcattcccaaaggtgaaggtggaccagtctcagagacagccttcccaggagacagctttcccaagagacgcccttcccgggagacagccttcccaagaggcagccctcctgggagaccgccttcctgggagacagccttccctgcccgggccgtcgtccaggcggacactggggagagctgtgggcagcgagtgagggagagccatgcatctatggggtcaccttggaccctaagcacacctggtggtgggttcctggagtgctccccactaggatcacttgggtgccctgagccagtcctgcgaacaatacccatgctctctgatcctctgtgggccagtcttcagggcgagttctcaagggtgaacctctttggtctgagttcttgtgcaggggactctaaatgttgcctgagtgctggcgaacgctaggcgtgtcatctgtgggaacggtgtcattaccaacatcgccgaggggcagtaagcagtgtcaggcccaggaggatgggacccttgaggagaagcgggcattggctgaggtgaggggagtgaggggtcctcggaggctggcgtggctttacagggcctggcctagaactcctgacctcaagtgatctgcccacctcggcctcccaaagtgctggccacgtccagccttatatatttattgagacagaatctccctctcttgcccaggctggagtacagtgacgtgatcttggcttactacaacctccgcctcctgggttcaagcgattcttgaatcttgaaaatttttaaaatttttgggagagacagtgcctttattgcccacgttggtcttgaactcctgggctcaagcactcctcccacctcggctccccagtgtgctaggattacaggtgcgagccattgcacctggttaatttttttgcttaatttttacttttttgtacaggcggggtcttgctatgttgcccaggctggtcttgaactcctggcctcaagcagttctccaatcttggcctcccaaagctctgggattacaggcatgagccaccacgccaggcctgggttttgagtaacggaagtagaacgcgttttgtagaaacaaaggaccggcctacccattctgtgcggcaccagctcacacctgtttgggaacagcggagctgcgttgcccacccgcaccgttcctggctttttcacatcgcctgaggatgtggaggccatcccatctgtcccagccgcctcctcctcgcacacattaggtggctgtcgccctccttcctgcagacagggcggggtaaacatccacccagctctgcttgtgtgagtcagggtgagctgggttcagctgcaggaacaagttcacccacagccttggggggtctggccctcgggaggaaaacgtgccgtgttgtgcagaggggaaggtacccttgtcatttgctcagggggctgtgaccatgcagggtccccagggtgggttctccactcctccccgagcccgcctccctggccggcagccctgactgggagtctgaggctcctgtgctggcgcccgctactccagccgtgggagggtcccttccacctgtgctcacccctcgcccttccttggtagctgctgagaaacccacacattccagatcattctcccaccctagcacttcctggtccacacgggggtccctggcttgcttggccctttgcgggtaaatgattcagaacgtgcagctcctctggattctcaggagtcttcaccacacctctgggttcttctgcccgagccaggcgtgcagagccagagggccggcgcacttatgtccctgagaggtgcctggcgctgcctgtcctctcctatccagtttgaagcgggaaagggaagaatgttctgggaagtacagggaagccaggtccaggagaagccttggccgagtccctggagcgcctagtcctggctctgtggggcagcacccacaccctgagcgtgacctggccctgctgtgcgtcgtgcacctgggctccccagccctcctgctgtgatgccagctgggaggtggactctgatgggcatgtggccccggctccccctgcaggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacgtgagtgtccccactcccaggtggcctcgctggctgttctgggccagcgccagggggtgggacagacactgtcctgcccttggaatctctcacaggggaaggggacggttggagaggccctgagatgtgcacaggtgagcgccatcgcagaccacggggcgtgttgagaaaggtgggcctcgggtgagggccctggcctgggtcaatcagacaagacccagaaaagagccagtgggtagggaccagggcctggggttgatgccagcctgggtggaggctgtgtgggtgagtgggtgatcggacccacattttggaaacatcactccatcccttctgggggaaggccagggaagccgagaacaacacgggggcttaacctcaggaaccagggtgtcctgcggggtggctgtgacaagccgggtgtgggccggagcctggtggaggggagggctggtgtgagaggaagcctcaagggtgcacggccatgcagacaggatgggtcctgcgcggggcagtgggtacctgcagtgaccacagggtgagtgtggggttcccaggacatcctggttgcgctagctgctggggtggtatcggggcccccttggggcatgacagttatgactaaatgcttgtgtggcattttagcattgagtaaaagcactgagaggacaagcgacttgctcccctaactgaatggtttttaaaagtgatttatctgttgccgaagaactaatgaccctcggctgaggacgagcctcagaccctccttgccgagcgctaaggggccagttccttcctcatccatttcccagtgcacacccagcccagcccagaccattgtgggtgttgaaccctgcgggggtcggggtgcgccaagggcacaggccctccttccttggacctggccctctggaatgtggttgggaccagcagcacctaagagccctgtccggcctctccctgcagggagcctgccccgctggaggctgcctggtggccctgacctgtgactaccgcatcctggcggacaaccccaggtactgcataggactcaatgagacccagctgggcatcatcgcccctttctggtaaggccctgggctgcagccacgctccatgcttgttgtggagggaacagacccgcctggggccatgtggtgagtgggtgtctgcatttccaggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccaggtgaggcacggggcatggcgggcgcccgatgatgctggggagaccagaaggttctccacccaaaggttttctgtggacatcgtgacttcgggagactgttgataatcacagccatgtgggtgtcaggaggctgctgtaacaacgcagcacagaccgggtggcccagaccgcagaagctcatctcacggtgctggagaccagaggtgcaaaatcaaagtgtgggcaggactgcacttcctccctgcgttccagggaggctccttcctgccccgcccacttctgctggctccaggcctccctgggcttgtgggcgcctcgctctaatctctgcctccatccttacgcagctttctcccctgtgtttctgtgggtctcaggtctctctctcccttctcaggacacctgccatgtgatttaggacctaccttaaatccaagatgatcccaacttaattacatctgcagagactctttccaaataaggtcacacttccaagttccagagcagtggttagggcttggacctatcttttggggcacacttttcaacctactacaaagacaattgtccacttcatagaaaaagagctggtcatatcagcgatggtatagaccagggcccagcaaattctgtctctaaagggccaggtggcttgtgggctctgtaggtaagacctttgtagcagaaagcagccacagaggagacgtaaactgacaggtatagctgtgttccggcaaagctttatggacagtgggccaggtgcggtggctcacgcctgtaatctcagcactttgggaggctgaggcaggcagatcacttgagatcaggagttcaagaccagcctggccaacatggtgaaaccccatctctactaaaaatacagaaatgggccaggcgcggtggctcacacctgtaatcccaacattttaagaggccgaggcgggcggatcacaaggtcaggagatcaagaccatcctggctaacacggtgaaaccctgtctctactaaaaatacaaaaattagccaggtgtggcggcgggcgcctgtagtcccagctactcgagaggctgaggcaggaggatggcgtgaacccgggaggcggagcttgcagtgagctgagatcgcaccactgtactctagcctgagcaacagagagcaggactctgtctcaaaaaaaaaaaaaaaaatgagccgggcgtgatggcacgtgcctgtaattccagctactgggaggttgaggcaggagaatcgcttgaacttgggaggcagaggttgcagtgagccaagatcatgccattgtaccccagcctgggtgacagagtgagactctgtctcaaaaacaacaaaaaaaattttatggacactgaaatttgagtttcacataattttcacatgtcacaaaatactaaccttcttttgattttcaactattcaaaaatgtaaaaaccagcccggcacagtggctgaagcctgtaatcccagcactttgagaggccaaggtgggcggatcacctgaggtcaggagttttagaccagcctggccaacatggcaaaaccccgtctctactaaaaatacaaaaattagccgggtgtgggggcaggtacctgtaatcccagctacttgggaaggctgaggccggagaatcacttgaacctgggaggcggaggttgcagtgagccaagatcatgctactgcgctccagccaggacgacagagtgagactcctctcaaaaaaagtaaaaactattcatagcttcagggccttgagaagccagatttgccaaccctgatacaaatgactgaaggctgtgctgccatttcctgtgctgtaagacagtatttaatatagtgccatggaaatttttttatttttattttatttatttattttttttgagatggagtctccctcttgctcaggctggagtgcagtggtgcgatctcagctcactgcaacctccacctcctgggttcgtgccattctcctgcctcagcctcctgcgtcgtggaaatattcttcataatatagttgagtgaaaatgacacgttaagtcgctgggcgcggtggctcacacctgcaatcccggcactttgggaggccaaggagggtggatcacctgaggtcaggagttcgagatcagcctgaccaacatggtgaaaccccttctctactaaaaatacaaaaattagccgggcatggtaatgctcctgtaatcccagctactcaggaggctgaggcaggagaagtgcttgaacttgggaggcggaggttgcagtgagccaaggtcacgccactgtagtccagcctgggtggcagagacagactccatctcaaaaataaataaataaataatacaaaattagccaggatgtgtgtgcacgcctgtagtcccagctactcaggaggctgaggtgagaggatcacctgagcccagggattcaaggctgcagtgagtcgtgatcactagtgcactccagtatgggcgacagagaatatcctgtctctttaaaaacaaaacaaaacaaaaaaaaattagggccgggcgtggtggctcatgcctggaatcccagcacttggggaggccgagatgggtggatcacctgaggtcaggagttcgggaccagcctggccaacatgaggaaatcccatctctactaaaaatacaaaattagccgggtgtggtggcacacggttgtaatcccagctactcaagaggctgaggcaggagaatcacttgaactcgggaggcggaggttgcagtgagccaagatcccaccattgcactccagcctgggcgacagagcaagactccgtctcaaaaaataaaaataaaaaataagttgggaatcaccccactgcccctgaaagtgggatttcagtggcacgtcccattctctttagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggaggcagctgtgctgccagggatccaaatgtcccttaagaaggattttgcaagaaccaaactcatccaaacccttgaaacaaaggtttttcctcccatgcgattcagaccaagttaccacatcttgctaagatgtgatgtttcaaaaaccagaaacctcatcgggccccagtcagtgacccagtggacccgtgggcctgccttttccctatcctaatgtgtccttgcccaggcacagggcagcagccttgaagggctgagccacggcgagctgggcggttctttgcacgggaccttagtcccaagccacctgcctgggcagggaggagtccagcccgcccactgctctcaggctctccaaaagctccagggctgctgactagctggggctggcctccccttgcagtgctgggtaagaccgggctcttgagacagacaagtgcctgggggcccctgcagggccctggaatgggggctgcggggtgggcctggggagagctgttctgagagccccgagggcccaggaggctggtgtgttggcgccatccctgtcccagctgtgctcacagtacaggctcctgggagcgtttgtagtttccacagaggatgagcaaggagcatccctgagctgccttctggggccagcaggctccgggggcagccacgtcccaccaggacatggggtgggcagcccaggccatggctgcccctaaggagctgaggctgggtcctaaggaaggacagaggcctgggagccaagctgtggggcccgaccgggagcagctcatttattgagcagacatctgccgggcagtgccccctgcacccctcatggggctcacaacaccccatgaggtcgctggatgcagcccgtcccacagatggggaacggaggtacagagcagcacatcacgtgtccatggcccctggtccacgcccagccgactctgccttggggcctcactgaagggtggctgccaccctgaaggggccactgttgggccattcctcagagccagggtctgcaggtggcatgccccagccaggcctcgagtcatcggtggaacttgagggtcacctccactggaaagtggtcgctgatggcaagagcctgtggggacagagtgagcctcaggggaaaagtgcaccccacccacagggatgggaggggccggtgaggcctgggtgcccacccctgctgctgcctgcggtggggcaggggcaggggccggggcagagggtgtcaccattggccctttgagggaaaggcaaggtaccctgcctgcccagagctccacatggggtgggccgggctctccagggtccttggaaacgagccctggtgcagggaggaagctgaggtggccctgccttgggcgctggaccctccctgctgcctgcgtgcgcccgggcggtggggacccaagaccagcaccgccccacggcccactcgcctgagtctggtccaggccgaattcctcctggaagtcgtgcacggtggccgactggggcttcaggctccggcgcaggcgggcgccacaggccacaatgcggtcgtaggcgcagtctgagttgcccaccgtggtgtcggcgctgtcagggatgagccacttgaagacctcactgctcctcagacggatggcggcccagtcctgcgcccgcacatagctgcagtcggcgttgaagtcgcccaggaacagcatgtcctgcgggcgccgcggagccgtgtctgagccgccgcaggagccgtcgaggtcccgccctcatgaaccagacccccggggcgcgcctgcagggaccccgggaccgaggggtgggcttacgtcggtgccccacttgtcgatcacgtccaggtacacgtcgtagagcgcgtcgatctccgccacggcttgatgcggcgccgcgtgcagcgggatcagcaccaggttctgtgctgctgcgggaaggggtgggggcgtcagagctcggcgggaggggaggggcggggcccgctcaccggtgcc

SEQ ID NO: 16672 - DNA, 37269 bp, Human
  misc_feature (1)...(37269): n = A,T,C or G
cttaccttttctgcagagacccctggtttcctttgatttaaaattatatttacaaaccaagatctggtactagatatgctcattattactactaagggtgtatacatacatatccatatctatttctattttttaaaatattattaggctggttgtggtgactcatgcccataatcccaacactttgcgaggctgaggcaggacgagtgcttgaggccagttcaagctgggagccaggcttggtgtctcacacctgcaatcccagcactttggtaagtcaaggtgggcagatcacttgagcccagaagttcgacaccagcctgggcaatgtggagaaacctcacctctacaaaaaatacaaaaaaattaaccaggtgtggtggtgcgtgcctgtagtccctgctccttgagaggctgaggtgggagtattacctgagcatgaaaagttgaggctgcagtgagccgtgatcacgccactgcactccagcctggggaacagaatgagagcctgtctctcaaaaaaaaaaaaaaaaaaatagtcgggcgtggtggctcacgcctgtaatcccaacactttgggaggctgaggtgggtggatcacctgaggtcaggagtttgagaccagcctggccaacatggtgaaaccctgtctctagtaataatacaaaaattagccgggtgtggtggtcgacacctgtaatcccagctgctcgggaggctgaagcaggagaattgcttgaacccgggaggtggaggttgcagtgagctgagatcgtgccactgcactccagcctgggtgacagagcaagactccatctcaaaaaaaaggctgggcacacagtggctcacgcctgtaatcccagcactttgggaggctgaggcgggtggatcgcctgaggtcaggagttcgagaccagcctgactaacatggagaaaaccccgtatctactaaaagtacaaaattagccaggcatggtggtgcatgcctgtaatcccagctactcaggaggctgaggcaggagaatcacttgaacctgggaggtggaggttgtggtgagccaagatcgtgccattgcactccagcctgggcaacaagagcgaaactccatctcaaaaaaaaaaaaaaaaaagaccagcctgggcaacatatcaagactccatctctataaaaaatgaaaaaataattagctgaatatagtggcgcatgcctgtactcccagctgctggggagactggttgaggtgggaggatagcttgagcccaggaggtcaggctacagtgagccatgattaggtcactgcactccagcctgggtaacagagtgagaccctgtctcaaaaataattaattttaaaaatgaaaaaatatatacatctaggtttgtgtaaggatgctttacgatactcgcacaatgacaagatcacctaaccctgtgtttctcagaacttacccccattgttaagtgactgacattctactgattgtgtatacagtagcttacttcagaattcctcgtgttctgttcagtgctttagattgctttcacatatgctttagtgggaatctttgtgcattgtccctttttctgtagttagggttatttagtctgattttcattagaaggatagtagtctaggtcattatcaagaaaccactgtactttgttttcatctgattgttaatacattactttgggtctttgatgtttatttatttaggccttcttagatgttcagtaaggcatgtagtggattatactgagaacagttgacgtgtaagttgagcttaaccctattcttttctctaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaaggtaaggttgtgatcagcttaagacaaaagacatggtggctgcaaagtcaaaatgtttaatattgtcatatgacagtgaccataccctaggggaaataatgattgctcattgttgtagctgttgtagagacaatgttgacagcaccattcagtgttctctttagacagatccagagggagaaaaatcccctctattcttagtaccgagaatagtataactaatttcatgagcaattggatttttttttttttctgatgaacgctgcgtctgtttaactgatatggtctccctttttgtgttatctgctggaagaaggcttagagtgaaatgtataccttctctttaagtttacatgccttctctcattggttctgtaggagattttaccctattcctggctctgttttgtccctgcctctgtttttttgttatttctcccacttaaaaatgctaaactggggccatttcctctcagaagacccctctctctcactagagagagaactattttcctttctctttctcttgcctattaaacctccactcctaaacgcaaaaaaaaaaaaaaaagttaaattggacccaacacagtggctcatgtccataattccagtgctttggaaggccaagacaagaggattgcttgagcccaggagttcaagaccagcctgggcaacatagtgagaccttgtctctccaaaatacttaaaaattggctaggcatggtggctcgagcttgttgtcctagctacttgggacattgagatgggaggatcacttgagcccaggagtttgagactacagtgagctgtgatcaagccattacattccagcctaggcaacagagtgagtccctatctcaaaaaaagttaaattttggaagttttttaaaattactttttatatacttctagaggtagtttgtgtatatacaaatatacgtgaacatgtcttcttcttcaccctcccttttttttgagctgaggtctgtctctgtcaaccaggatggagtgcagtggcatgaacatggctcactgcagcctccacctcccaggctcaatccaccctcctgtctcagcctcccgaatagctgggactgcgtgtggacaccaccatacttggctattttctttttcttttttttttttgagacggagtcttgctctgtcccccaggctggagtgcagtgacgcaatttcagctcactgcaacttccgcctcccggcttcaagcgattctcccacctcagcctcctgagcggctgggattacaggcacccactatcacgcccggcttatgtttgtatttttagtggagatggtgtttcaccatattggcctggctgttctcaaactcctgaccttatgatctgcccacctcggcctcccaaagtgctgggattacaggtgtgaaccaccacacccaggctttttttttttttttttttaagatggagtctagctctgtcacccaggctggagtacagtggcatggtctcggcttactgcaacctttgcctcctgggttcacgcggttcttctgcctcagcctcccaagtagctgagattacaggtgtgcgccaccatgcctggctaatttttgtattcttagtagagacaggattttgccatgttgtccagtctggtctcaaactactgacctcagatgatctacccacctcggcctcccaaagtgctgggattatagtcgtgagccactgtgcctggccagttttttttttttttttcttttttacatagaaagtattttttttctatctagtagttcatcttttaaaatattagtctttaaaaaatattctttgtggccacgtgtggtggctcacacgtgtaatcccagcactttgggaggctgaggcaggtggatcacttgagatcagtagttcgagagcagcttgaccacagtgaaaccctgtctctactaaaaatacaaaattagctgggcgtcgtggcgcacgcctgtaatcccatctacttgggaggctgaggcactagaattgcttgaacccgggagacggaggttgcagtgagctgagatcatgccattgtactctagcctgggtaacggagcaagactcagtctcaaaatatatgtatatatagagactgagtaaataataacaacaaaataaataatatatatattataaatatacataaatatatatatttatgttgattttgttgttgttgttgttgccagaaaaggtctaggtactttaaaatatatatttttagcaactgaacgtcttaaggaaaaaaaggaacctccacctaaatgtcataccttatataaaaattaacttggccgggtgcagtggctcacgcctgtaatcccagcactttgggaggccaaggcgggtggatcactaggtcaggagatcaagaccattctggctaacacggtcaaaccccttctctactaaaaataaaaaaaaaaattaggcgagttggcgggcacctgtagtcccagctactcaggagnnnnnnnnnnnnnnnnnnnntccatctcaaaaaaaaaaaaaaattaacgtgatcatggcacttaaacataaaaaaaaaactgtaagccttttagcaactaaaacataaccagaatctagggctgggtgaagatttatttctttatttatttttgagacgaagtctcattcttgtcccccaggctggagtgcaatggtgcaatctcggcttaatgcaacctccgcctcccaggttcaagtgattctcctgcctcagcctcccgagtagctgggattataggcgcctgccaccatgcctggctaatttttgtacttttagtagacggggtttcaccatgttggccaggctggtctcgaactcctgttctcaggtgatctgcccaacttggcctcccaaagttctgggattacaggcgtgagccaccaggcccggcctgggtgaagatttatttatttaacattcctgaattagcagaactgtagagaaggagaatagcttagagatgagggatgggggaggaagtggtgaggctataaatataggtgtgacatggggtggttggtggtgatagaacagctttgtatcttgagtgtggtggtgtttacatgaatctacatgtgataaaattacatagaactatacataagcacaaatgaatgcctttaaaactggtgaaatctgaataagctctgtggattgtaccaatatcaatttactggttttgttattttattgtatttatgaaagacattactattgggggagactgggtgaaaagtacatgcgaccttcctgtatgtatttttgcaaccttctgtgaacattaattatttaaaaattaaaatttttaaaaagtatttttatgagcagcttcttggcaacagattctgatctgatcctgccaatattgtggcgtgccctcaggtgggcctcttttcctcagtggacttcagtgtctttatctgtaaatctcattctggaccaaattgctgaggtcttttttttttttaatatggagtttcgcttttgtcgcccaggctggagtgcaatggcgtgatctcgactcactgcaaccccaggttcaagtgattctcctgcctcagcctcttgagtagctgggattacaggcacgcgccaccatgcctggctaattttgtatttttcgtagagacggggtttcaccatgttggtcaggctaggtgacctcaggtgatccacccgccttggcctcccaacatgctgggattacaggcatgagccaccgtgcccagcccgaggttattttcacgtataaaattccgtaatttttggagccactgcgcctggcctaataaattattaaatggttttatgtaatggattgtcacattatttaggaatttttggtatttacgtaagaaaaacccagtttggcttaagggactgagggaagtattaattagttcatgtaactaggaagtctaggagtgcatttggaatcacctagatctaggaacatctacattctgcatctttctgcttgacattatttattattatttttcaaacatctcccccacataggattgattatttttgactcaatctagtgtcccaaacatggggctttgcctctccatttctcagttattggtttcattgttgagatagattaggtggcaagatggctactggtagccctggactcagcatcttcttaggttagcattcccagatagcttcatcagaaaagttcaaagatatccatgtcaggtgtgttaatgaaaataaaaaagctgggtgtggaatcccaggactttgggaggccaaggcaggtggaacatttgagctcaggcattcgagactagcctgcgcaacatggggaaactccatatttacaaaaaaattacctgaacatgatggctcatgcctacggtcccagctactcagaaggctgaggtaggaggatccttgatcctggaaggtcatggctgcagtgagcctagatagcacgactgtatgccagcacgggtgatagagtaagaccctgtctcaaaaaaaaaaaaaagaaaagaaaaaaggcggggtgcggtggctcacgcctgtaatcccagcactttggaaggccaaggcgggtggatcacgaggtcaagagatcaagaccatcctggctaacatggtgaaacaccatctctactaaaaatacaaaaaaaattatcctggcgtggtggagggttcctgtagtcccagctacttgggaggctgaggcaggagaatggcatgaacccgggaggcagagcttgcagtgagccgagattgcgctactgcactccagcctgggcaacagagtgagactccatctcaaaaaaaaaaaaaaagaaaaagaaaaagaaaaaaaataggccaggcatagtggctcatgcctgtaattgtagcactttgggagcctgaggtaggaggcttgcctgagactaggagtttgggaccagcctgggcaacatgacaaaaccctgtctctacaaaaaaatacaaaaattagccaggtgtggtggcgtgcgccagtggtcccagctacttgtgagactgaggcaggaggatcaattgaagctggaaggtccaggctgtaatgatccgtgatcacgccactatactccagcctgggaaacagagtgagatcttgtttcaaaaaaaaaaaaaaaaaaaaacttagaaaagttcaaagatgaactctggccttcaggtcatatttttcattcctcaagtccatactgggtgtaaggagggatagcagactttttttttttttttttttgagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactgcgcccagcatgtatttttttttaattaggaaagcaatgcatgatcttgtaaaaatgtttcagagtacaggaatttagaaaatgaaagtcttggccaggcacggaggctcatgcccgtaatcccagcactttgggagggtgaggcaggtggatcacctgagataaggagttccagactggcctggccaacatggcgaaaccccatctctactaaaaatacaaaaattagccgggcatggtggcacatgcctataatactagttactggggaggctgaggcaggagaatcacttgaacccgggaggcagaggtggcagtgagccaagattgtgccactgcactctagcctgggcagcagggcaatactttatctcaaaaaaaaaaaagaaaaagaaaatgaaagtcttctaacatcttgcctcattggtcattgagtcaataaatatttgctgagcacctatgtgctagatgctgttccaggtctagataaaacagtaaacattatagacatagagcttatattgtggtgggaagagacagaagtaaacaagagaaataagtaaaatatttggaacattgttgtaatctgggtgaaagatggtggttgcttagagtagggtggtagcaatggagatggtgagaaacgactaattctgcatatcagagttgttttaattcaaagatttatttcctgcatctttggaaatttttccccttgattagttcacctctccattgcctaagttaatcctctatatgtcctattctttctttcattttccttttgtcttattgttttgttttctagaagatttctatattttattctccacctgttgattgaaaaaatatatatgtatttattatgtctaattttcatgagtttttttgtattctccacttcttcctttttcagagcatcttattctcatttcttatcatattcagagctctttttcagattcacttgtgttccttgatatacatgtccttctggattcattattttttatttgttcatcttgatcccttttaggatatagagattcctcagttatctaaagatccttattgctagtaatcagatcagagattcaaggggaataatcagaaacaaggttattaagctttaggacttcctaagtgccagcatattgttttggaatactagttcccatactgattagctgtttctggacagtttattcattttcttaaaaaaaactcacgtgcctggcctatttttttttttttccgtattctgttagtcacggtagtcataaagtccactcaggttgaagtagagggtatggaaggattgtcagacaatttgcagatctgttttaaaatcattacagcacagggccgggcctgttggctcacacctgtaatcccagcactttcggaggccgaggcaggcagatcacttgaggtcaggagtttgacaccagcctggccaacacagtaaaaccctgtctctactaaaaatacaaaaattaggcaggcatagtggtgcacgcctgtaatcccagctactcaggaggctgaggctggacaatcactcgaacctgggaggtggaggttgcagtgagccaaaatcgcaccactgtactccagcctgggtgacagagttgagaatccgtctctaaaaaataaaaaataaaaataaaatagctggacatggtggcttgcactggtaatcccagcactttgggaggccgtggtggatggatcacgaggtcgggagttcgagaccagcctggccaacatagtgaaaccccgtctctactaaaaatacaaaaattagccaggcatggtggcaggcacctgtagtcccagctacttgggaggctgagggaggagaatcgcttgaacccaggaggcggagtttgcagtgagccaagattgcaccactacactccagcctgggcgacagagcgagactccaaaaaaaaaaaaaaaagctgggcactgttgcgggaagtcagggaccccaaatggagggactggctgaagccatggcagaagaacatggattgtgaagatttcatggacatttattagttccccaaattaatacttttataatttcttatgcctgtctttactgcaatctctaaacataaattgtaaagatttcatggacacttatcacttccctaatcaatacccttgtgatttcctatgcctgtctttactttaatctcttaatcctgtcagctgaagaggatgtatgtcgcctcaggaccctgtgataattgcattaactgcacaaattgtagagcatgtgtgtttgaacaatatgaaatctgggcaccttgaaaaaagaacaggataacagcaatgtttaggaaacaagagagataaccttaaactctgaccgccggtgagctgggcagaacaaagccatatttctcttctttcaaaagcaaatgggagaaatatcgctgaattctttttctcagcaaggaacatccctgggaaggagaatacgcgcctgggggtaggtctatagatggccccctgcatgtggccgtcttttatggtctgtagactgtaggggtgacatagaccccagtctcccatagcgctcccaggcttattaggaagaagaaattcctgcctaataaattttggtcagaccggttgctctcaaaaccctgtctcctgataagatgttatcaatgacagtggtgcctgaaacttcattagcaattttaatttcaccctggtcctgtggtcctgtggtcctgtgatctcgcgatctcgccctgcctccatttgccttgtgatattctattaccttgtgaagtacttgatgtgtgtgactcacaccctattcgtatactccctccccttttgaaactccctaataaaaacttgctggttttacggcttgtggggcatcacagaacctaccgacatgtgatgtctcccccggatgcccagctttaaaatttctctcttttgtactctgtccctttatttttcaagctggccaatgcttagggaaaatagaaaagaacctacatgactattggggcaggttccccaatagggcacccgtggcttacacctgtaatcccagcactttgggaggctgaggcgggaggatcacaaggtcaagagatcgagaccatcctggccaacactgtgaaaccccgtctctactaaaaatacaaaaattagctgggcgtggtggcacatgcctgtaaacccagctacttgggaggctgaggcaggagaatcgcttgaacctgggaggcggaggttgcagtgagccgagatggtgccagtgcactccagcctgggtgacagtgtgagactgtgtctccaaaaaatatatatatatatgtatatatgtgtgtatatatatgtgtatatatgtatatatgtgtatatatgtatatgtgtgtatatgtgtatatgtgtatatatgtatgtgtgtatatatgtatatatgtatatgtgtatatatgtatgtgtgtatatatgtatatatatgtatatatgtatatatatgtatatatatataaaaaatacaataaaatcattatagcacaaatgcttggctcttggctgttttgatctaatgactaggggaagacagcaagagttgactgttttgtctacaaacatttagccggtagctccgttttcagcctgatgaggcccacctatatgagtcgtggcatttcccagtcttgagactctgcagttcggctggtagattggctttctgctcccgtgaggcatcgtctgcttctcacacacatcgtgtgtgtgtgtgtgtatccttgggttttctcagctctgctctatcatttattgcttctccactatttttttttttttaaagacagggtctcgctccgttgctcaggctggaatacagtggtgcaatcaccgctccttgcagccttgacctcctgggttcaggcattcctcctacctcagctctttctgctttctaaataactgggactgcaggtgtgcaccaccacagccagataatttttaaatttttggtagagacgggggtctctctgttgcccaggctggtctcgaactcctgggctcaagtgatcctcccactttggcctcctcaagtgctgggattacagatctcagccagtgcacctggctatttctccactgactgttttccagaagtatgtagaagatttttccctgctggtgacatctctcatgctctatgtggtgttatgtcttttttttctttccaattctcactttaacagagtcccagaggagaggacatatatgcttgtttagtttgccttctttcgctggaagctttaaaataagttttaagactgggtacagttggcttatgcctataatcccagcagtttgggaggccaaagtgggaggatagcttgagatcgggagctctagaccatcctgggcaatatagtgagaccctgactctataaaaaatttaaaaattagccccgtgtgatagtggacacctttagtcccagctactcaggtggctgagttgggatgatcccttgagctcaggagttcaaggctgccgtgagctataagtgtgccactgcactctagcctacatgacagggtgagaccctgtctcaaaaataaacaaataaacaaaataaaatataattatgttttaaaataaaataacataatgtcttaacagtagattttgacatatctccatgctagctggcatctcgtcatctttaagggctgcatagtattctgcagtatgactgtactataatacgtgtcgtcattccccagttaagtggttttaaatgtattgctgttatcaacagggctccagtgagcattcttgtacatatatctttgcacacacatacaagcatttcctcaggataaattcctgaaatggaacaagtgtcaaaggatatagacacttcaaattttgatagttaaaatgtcaaattgcctttaaccatatgtgagtactctcatgaaatgataaattcaatatctgatacccttaggtactaaggaaaaggactttccttagtggaggtccaggagaaaatcttcgaggcagagattaacaaaatcagtgagataggaatgtgtatagcttgtttatggaattagaatgaggatttccgtaaattaccaatgaaccccataagactacacaggatggaagcttaatagtgcatggctgtttgatgtcatgttgctaaattcctgtccgttcccaacttgtactggagtgacataaaccatatggggcaattggaagagctttccaaaacagctgagcttaaagatcaagcaaaaggagaaaggatattcctgcaaaggttctgattccatgcccttaagtatctctgatggtgttaggggccgatgggcaggtagcccgcaggggtaaatgatcaaggtgttgaaggcgctccagagagcaggtgttaaacattttcggccgggcgaggtggctcacgcctgtaatccgagcacttagggaggccaaggcaggcggatcacaaggtcaagagatcaagaccatcctggccaacatggtgaaaccgtctctactaaaaatacaaaaattagctgggcatggtggcaggcacctgtagtcccagctacttggggagctgagacaagaatcgcttgaacccgggagttggaggttgcagtgagctgcactccagcctggcgacagagagagattccatcttaaaaaaaaaaaaaaaaaaaaaaccttttcaggagggcctgaggctatggcaggaggagcaggagaggaaggtgcaagccctctcggagatggcatctgaacaactgaagcggtttgatgaatggaaggaactgaagcagcataaagaattccaggacttgcgggaagtaatggagaagaggtgagtctccctgaattatgactgggaatgttgatgtgttcaactggaactctttcccaagaggaattccaaagggaaagagttgaacaacttctgagtccttaaatatcaaggtaaaataggcagagaattttataacctggaaaaaagaccaaacttggagagacaaccaaaggaacacaaagagggaggcttttaggagaggtaaaacaattttacgggcgtggtggaacacagctgtagtctcaattactagagaggctgaggcaggaggattgcttgagtccaggagtttgaggctgtggtgagctatgctctgcagcctgggcaacataacgagaccccatctctaagaaaaagggaaggaagggaagggagggcagggagagggagagaaaagaaagaaagaaaaacaatttcaggaagtatccctgactattcctccctgccatttttcatgcagctccagagaagccttgggacaccaagagaagctaaaagctgagcaccgtcacagagcaaaggtcagagcctggcagaattggtgtgggtgttttggtgtctgtctgtaacctgcctggagagccaggttttggcagatggccaccatggaggatctgggccgtattatgcctgtgtatgactaaccttgggatgtcctcttcctgctctgagcccatctgtgaaaatatgtagcccacgtagaatttgaggactgtagaaagaagaagcccaggaacccctcagagagaagtcactcagcccttttctacagattctcaacctgaagctgcgggaagcagagcagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagaggtgaggggggcttcagagtgactctttgctgtctttgaaatggaagcctttaaaagcaaaactgttttctgacttaaaaagtaatacctgctatctgcttattgggggaaataccaaacattacttgttatctccatatctctttacctagaagtaaccactgttaacattttattttgtttcttttatttatttctttatttttatacctgcttattctggagtcttttttttttttttttttttgtgatggggttcccctttgtcacccaggctggagtgcagtaacacagtctcagctcatgcaacctctgcctcccgggctcaagtgatcctcccacctcagtctcctgagtagctgggactacaggcgcataccaccatgccctgctaatttttgtatttttttgtagagacagggttttgccatgttgctcaggctggtctctaactcctgggctgaagtgatccccctacttcggcctcccaaactgctgagattacaggtgtgagccacggtgccaaactttttttgtttcgttttgtttttaaattagcaatagagatctcactatgtttcccaggctggtcttgaactcctgggctgaagtgatcctcccaccttagcctcccgaagtattggggttacaggcacgagccattgtacctgccctgtttctttgctttgcttttttttttttttttttttttttttttgagacagggtctcacactcttgccccggctggagtgcagtggtgtgatcatggctcacttcaacctccggcttccaggttcaagcgattctcggattacttgaggctaggagttcgagaccagtaggtttcagccaacatggtgaaacccagtctctactaaaaatacaaaaattagctgggtgtggtgacgcacacctgtaatcccagctacttgggaagctgaggcacgagcagcacttgaacctgggaggcaaaggttgcaatgaccgagatcttgccactgcactccaacctgggcaatggagattctgtctcaaaaaataattattattataataaaacagtattatttttgtctaacatattgtcacaaactttttaaaaaattacgctggcccttgttgctgagaatacagaccaatttatacttagaaactatggatgtgacagtaagttggaattattaatacctttaagagaacagggaaagaagtatcaatttgttgaatgtggatactccattggtgcaacaattccaattgcaggaaatttattgacttgtatgaggtatgatttacctagggaatgaccactaagcaccatctccgtcactctgacagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaaggtgggtttcagtatggatgtggtcctttaactcgtaagtttcaaatgtgaagagaaacaagagcatgttttgaatgttgtgttaaactgtaggacagttaaccagaattttatgtaatgtatttcattcagttttggttgatgtagagtctgatttacgattccaacactttgcgtgaggacttgaaattctgtataactctagcagatacattatttcaattattgctgctgctgagtattttaaataaatgcgcacagatatgtgttggtgtaatacgtataaggggtcaggagttcgagaccagcctggccaacatgccgaaactcccatctctaccaaaaataaaaaaattagctgggcatggtggcacgcacctgtagtcccagctactcgggaggctaaggcaggagaattgcttgacccaggagctggaggttgcagtgagctgaggtggtgccactgcactccaacctggtgacagagtgagactccgtctcaaaaaaagaaaaagaatcagtgtaccatagtgtttgagagtgctgactctggagccagatcagtgggagtctggtttttgttgttgttgttgttgttgttgttttttgcggggaggggatggagatttgctcttgttgcccaggctggattgcagtggcgcgatcttggctctctgcaacctctgcctcccgggttcaaacaattctcctgcctcagcctcccgagtagctgggattacaggtgcctgccactgtgcctggctaatttttgtatttttagtaaagatgggatttcaccacgttggccaggctggtctcaaactcctgacctcatgatccacccgcctcggcctcccaaaatgctaggattacaggtgtgagccaccgcacccagcctgggagtctaatttttcttttttggtgtgttttgtttttgtttttgttttttttgagacagagttttgctcttgttgcccaggctggagtgcaatggcacaatctcagctcactacaacctccgcctcccaggttcaagcgattctcctgcctcagcctcctgagtagctgagattacaggcatgcaccaccacacctggctaatttttttgtatttttagtggagacggggtttctccatgttggtcaggctggtttcgaactcccgacctcaggtgatctgccagcattggcctcccaaagtgctgggattataggcatgagccactgcgcccagcgttttttgttttttgttttttttttgagataggagtctcactcttgttacccaggctggaggagtacagtggtatgattatggctcactatagcctcaccctcccaggctcaagtgatcctccccactcagcctcccaagtaactgggactacaggcatgcgccaccctgcctggctaatttgtgtattttttgtagagatgggatttcaccatgttgtgcaagctggtctcaagctcctgggcctgtcttggcctcctagagtactgtaattataggcgtgggtcaccacacccagccttagtttttctacttagtagtaatgtgaccatggcaaatcacttaacctttttgtgcctgtttccttttctataaaatggagataataatagtatctatttcatagttatggtgacagttaaagcagtcagtacatacataaagtgattataacagtgcctgcctcatattacatgttcagtaaatactagctattactaaaacctctcttttatttctcagacctccaggtgaaggtacaagacattacaatgcagtggtaccagcagctgcaggatgcttccatgcagtgtgtgttgacctttgagggcctgaccaacagcaaggacagtcaggtaggggagaggtatatggcagtaattttgtggacttgatggttctcagagaatgatcacttcgtgtcccaaaggaatgtagctggcatgtcactttacctgattctaagtgacatctactcagctcttcagaacactgctttctcactgttctcttctggcaggccaaaaagataaagatggacctccagaaggctgctaccatcccagtgagccaaatctctaccattgcaggttggtcagaggggttgagaacatgacctttcatttcattgtattatctttcagactccaaatctatgtatctgtaaggttcctataaaagtatattcaaacaaatgtttacagttggatcgggtacatataagtgacatacatcttgtttccctgatataatcatggctgggctcacgcctgtaatcccaggactttgggaggccgaggtgggcggatcacgaggtcaggagttcaagagcagcctaaccaacatagtgaaaccctgtctctactaaaaatacaaatactagctgggtgtggtggctctcacctataatgccagttactcaggaggctgaggcaggacaattgcttgaacccaggaggcggagattgcagtgagccgagatcacaccacttcactccagcctgggtgacagagcgagactctgtctcaaaaacaaaaaaagaagactcttttttttttctttttttcttttttttttttttgagacagagtcttgctctgtcgcccaggctggagtgaagtggcgtgatctcggctcaccgcaagctccgcctaccggcttcacgctgttctattctcctccctcagccttctgagtagctgggactacaggcgcccaccaccatacccggctaattttttgtatttttagtagagacggggtttcactgtgttagccaggatgttcttaatctcctgacctggtgatccacctgcctcggcctcccaaagggctgggattacaggcgtgagccactgtgcccagccccctttttttttttttttgagatgtagtcttgctctgtcacccagactggagtgcagtggcgcaatctcggctcactgcaagctctgcctcccgggttcacgccattctcctgcctcagcctcccaagtagctgggactacagctgcccgccaccacgcccagctaattttttgtatttttagtagacacggggtttcaccgtgttaaccaggatggtctcgacctcctgaccttgtgatccgcccgcctcagcttcccaaagcgctgggattacaggcgtgagtcactgcacccggcctttttgactcatttttaacaagctaccttttatggcaaattattaggatggctcttagctttgaagttgcagtttactgctgaaaacatcactcagggaacctaggctgtgacttgcaggctttgcttctgtcctacaacattagcttttccaaattactccaagctcgccttgttcatcctccaggactccttttctctccagagactgaggtttagaaagtgagaaccagacaaggaagaaacttctttagaaccagaggttcatttgtatggagctgtagatgtggaagcctccagattatagactgagctgccaggtggctggggagtgtgtgtgcaactggaacactcctctgacgcatcgtgggttccgttccccgactcacttctcattgcctggaaagcataggaaaatttcagttcctgcccttgataggcagtccagcaaaacttacatatgactttgctgcctgaaattctttctggaacagggcaaggtataaataaataaataacatatcactttttggaatttaaagtgctgtgtcctttgatagcaacagcaaagcaagagaggttgactggacagccactccacacctcgatggccgttcccagttcccctctgttgactgcagacagggtcagtacctccttcatcaggaaaatggagacatccagtgtgagctcctcagagcccctccaccactgcacagtgacatttacctcttagtctcctgtgtcactggatgaggcgtccttgctgctgggcttacccttccacctctgcccttgttccctttccttcctgtctcctgtcagactgcctcatcgtttattgcctttcctgttttctgtgattactcctttttataggctcctctctctcagcctgtaaatatatgtgagcccctcacatcctaacatgagtctcccttgatcctatgtcttctaagtgtttgctgatcttcctgaggtttctgttcggcactgttgctgctttctctgtgcaactctactcctttggcctccatggtgccattactttccaggttcttctcctccctccctcactaccctttcctctctctctctccctctctccctctctctctctcccctttgtgggtttcttagtcttctaccccactctaattgtaggtgattcctagggatctactcttttttttttttgagagtctcgctctttcgcccaggctggagtgcagtggcactatatcggctcagtgcaagctccacctcccgggttcacgccattctcctgcctcagcctcccgagtagctgggactgcaggcgcctgccaccacgcccggctaattttttgtatttttagtagagaccaggtttcaacgtgttagccaggatttcaacgtgttagccaggatggtctcgatcttctgacctcatgatctgcccacctcggcctcccaaagtgctgggattacaggcatgagccactgcgcccggctgggatctactcttatcctgcagttcttttcgttctctctacttacagggcttcaaacattacctgaatgctgatgactcccaaacctacctctggtttattcctttcttctgagcttcagattctccagcttcagctacctgagggacatctctgcctatatgtctcttagctgcctcaagtttaatgtgttcaaatccaaacccatcatcttccttagccctctttgtctgctgttttctcttgagtaatcagtagcaccattatctactcagtaatcttagctggaaacctgggagtcatctttatgactgctgcctctctttcactcaccacatcgaattagtctatatctttgccttttttaatttttctacacatttcctgactctccctttgtctccatcaagactttaagtcctttaagatcttgtagtccagccagacacagaacatgctctagttagtgctcagtaagcgtttaatgaataggagggaaggatcacctaattcttctcttttttaaaaaggtgggccgggcgcggtggttcacgcctgtaatcccagcactttgggaggccgagcctggcgggtcaccaggtcaggagatcgagaccatcctggctaacacggtgaaaccctgtctctactaaaaatacaaaaaattagctgggcgtggtggcaggcacctgtagtcctagctactccggaggctgaggcaggaaaatggcatgaacccgggaggcggagcttgcagtgcgccgagatagcaccactgcactccgtcctgggtgaaagagcgagattccgtctcaaaaaaaaaaaaaaggtgggccgggcacagtggctcacgcctgtaatcctgtaatcccagcactttgggaggctgaggcgggtggatcacaaggtcaggagttcgagatcagcctgaccaatatggagaaaccctgtgtctactaaaaatacaaaattagctgggcatggtggtgcatgcctgtaatcccagctactcaggaggctgaggcaggaggatctcttgaacccaggaggcagaagttgcggtgatctgagatcacgccattgcactccagtctgggcaaaaagagcaaaactccatctcaaaaaaaaaaaaaaaaaaaaaggtggatgtcagctgggcccagtggctcacacttgtagtcccagcactttaggcggctgaggtgggtgaatcataggaggtcaggagttcaagaccagcctggccaatgtggtgaaaccccatctctactaaaatacaaatattagccagatgtggtggcaggcgcctgtaatcccagctactcgggaggctgaggcaggaaaatcacttcaacccaggagcggaggttgcagtaagccaagatcgtgccattgtactccagcctgggtgacagagtgagacttcatctcaaaaaaaaaaaaaaaagtggatgtcgccgggtgtggtggctcacacctgtaatcccagcattttgagaggatgaggcagacagatcacttgaggtcaggagtttgagatcaggctggccaacatggtgaaaccccgtgtctactaaaaatacaaaaattagccgggcgtggtggcacacacctgtagtcccagctacttgggaggctgaggtggaagaatcacttgaacccggaaggcagaggttgcagtgaggtgacatcgaaccactgcactctagcctgggtgacagagtgagactccatctcaaaaaaaaaaaaaaaaaaaaagatggatgtccatgagtggttagaattagaagaaatcttaaataaggacatgatgttgctgtggcatggggaggccacgtcagtctagggttggaagctaactaactttcctcctacctagagaggtatggagagaggctagatgctagatggggcattcagccagtggggtccacatggttggctttttttttttttgataagagaactgaatgacaggatatttctgaaacttttgtgacatttcttgaagtgattaggaacttgacagggtatttctcaactggagatgctgtattaattaaaacattgacttcaggacttcaggtaatggaaagtaattcagatctgctttgctttttttttttttttttttttttttttagggaggagatggagtcttgctttgtcacccaggctggagtgcagtggcacaatctcggctcactgtaacctgcgcttcctgggttcaaacgattctcctgcctcagcctccccgagtagctgggattacaggcacccgccaccacacctggctaatttttgcatttttagtagagacgaggtatcaccatgttggtcaggctggtctcgaactcctgaccacaagtgatctgcctgccttggcctcccaaagtgctggcccagatctgcttaagcaaaaaaaaaaaagcatttattggaaagataaagaaatatcctacagaacccagtggcaggaatgaggtgaggtctcaggagctagaaactttagttcttttttcctctctcatctcatctgtcctctctacatctccattcttattttatagattgccgttctttggtcttcatggcaggtacgcagcccccactgcttgtgagtgtatgtgacacagggccagctacctcaaggaagtgactcttagttgactgactggctcagcttgactgcctctaatctaactgtagctagtgtgggggtggagcacacaaaatctttggtacaaatatagctgttacgaatccacttctgtgtctctgaggacggaagaaggcaagtcctgagaagggggcatatcatcatgagctggttagatcctttagaaggtttttcctagagatgtgactaactcctctagagataccaaccacagtccatggggtctgtaacaaaatgtaacacctctttctatactgtttatcccttcattttatgtgtacagtaagggatactgtttatcccttcatttctgtagggcagcacagctgggtttttgtagatgctttgtaattacaatgatgaaacaggctgggcatggtggctcacgcctgtaatcccagcactttgggaggccaaagcgggcggatcacttgaggtcagcagttagagaccagcctggccaacatggtgaaatcccatctctacaaaaaaaaaaaaatacaaaacttagcccagtgtggtggcgggcgtctgtgatcccagctactcaggaggctgaggcagagaattgcttcaactcgggagacggaggttgcagtgagccaagattgtgccactgcactccagcctgggcagtagagtgatactgtctcaaaaaaaaaaaaaaaaaaaaaaaaaggaaaagaaaaagagattgatctgtggttatatcttttaatttctctctatcatgctcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtggtgagaaaccttgttgctagaggtatgggaagcagaggctggtgtacaagatttcagcctttttctggtattaagttaaaattgtacccacctctatgttctcagaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggtaaagttgtttttctccctactcactatccctagagtgattaatgaaatataaatagaattggaatttgtttttccctcctcacagctcctattacgtaccttgaatgttctatcagaaatataatgtctttcggccgggtgcagtggctcatgcctgtaatcccaacattttgggaggccaagttgggtggattgcctgagctcaggagtttgagaccagcctgggcaacatggagaaacgccatctctactaaaaataccaaaaattagccaggtgtaatggtgcacacctgtagtcccagctactcaggaggctgaggcacgagaattgcttgaacccggaaggcggaggtcgcagtgagccaagatcgcaccagtatactccagcctgggtgacacagcaagagtgtgtctcaaaaaagaaagaaaaaatatatatacatagtcttttatgtaaatggagagcctttgggatttgtgaacttaggtgccagtagtcaatgtagtttagtggaaaggatactggggtcttggaattttatccctgctttgtcatttaatacctttgcaaaaatggacaaatcatttagtctttttgagcatcttttcctgatttttaaatgagggtaatgacatctattacctcctgtgaatttacctcatggcttacatgaagctcagatttgatgatggatatgagtgcttggtaaacaaagtattctacagatgtaataatatgtaataatatatatacatattttttattttttttatttttttttgagacagcgtctcgctttgtcacccaggctggagtgcagtggcgtgatctcagctcactgcaacctctgcctcctgggttcaagtgattatcctgcctcagcctcccgagtagctgggactacaggcgcccaccaccacgcccagctaatttttatacttttaatagagatggggtttcaccatgttggccaggatggtctcgatctcttgaccttgtgatctgcccgccttggcctcccaaagtgctgggattacaggcgtgagccaccacgcccggcctgtaataatatattaatagtaatgctgagtgtaataatatattgttattttttagccataaaaagtaatctctgggccaggtgcagtgcctcatgcctgtaattactttaacaatttgggaggttgaagcagaaggatcgcttgagcccaggagttcaagaccagcctgggtaacatagtgagaccctgtctctacaaaattagccaggtgttggctgggcgcggtggctcacgcctgtaatcccagcactttgggaagccaaggccgccaaagcgggcggatcacctgaggccaagagtttgagaccagcctggccaatatggggaaaacccgtttctactaaaaatacaaaaaattagctgggcatggtggcaggcacctgtaatcccagccactcaggaggttgaggcaggaaaatcgcttgtacccaggaggtggaggttgcactgagccgagatcatgccattgcactccagcctgggcaacaagagtgaaactctgtctcaaaaaaaaaaaaaaaaaggccaggcgcggtggctcacatttgtaatcccagcactttgtgaggctgaggcgggcagatcacctgaggtcaatagttcaagaccagcctggccaacatggtgaaaccctgtctctactaaaaatacaaaaaattagccaggtgtggtggcaggtgccttaatcacagctactcgggaggcagaggcagaagaatcgcttgaacccgagaggcggagattgcctgagatcgtgctattgctttctagcctgggcgacaagatggaaattccatctcaaaaaaaaaaattagccggctatggtggcatgtgcctgtggtcctagctactcaggaggctgaggcgggaggatcacttgaacctgggtggtgaagtttgcagtgagccttgatcataccactgtactccagcctgggtgacagagactctgtttcccaaaaaaaagcaatttatctctaatttgtcacccttattttggccttgtcccagtgaattttttcttatttcttttttttgagacacagtcttactgttacccaggctggagtgcagtgatgcaatcttgactcactgcaacctccacctcccaggttcaagcaattctcatgcctcagcctcccaattagctgggacaaacaggcatgcaccaccatacccagttaatttttgtatttttagtagagatggggtttcaccacattggccaggctagtcttgaactcctggcctcaagtgatctgcccaccttggcctcccaaagtgctgggattacaagcgtgagccaccacacccggccaaattttttcttcccgtataggatgcttggttaccaagtaaaggattccaaagtggagcagcaagacaactttctaaaacgcatgtcagggatgatccgtctctacgctgctatcatccagctccggtggccatatggaaaccgacaggaggtaggtaaaagaggcttactgtcaataatgagaggttagaccacagtccatgtgtattcctcccacaggaaatgttggccttctttcagagagccagtctagttaaaggataaactatatggcagtttcatgggtattatgtagaggactgaatgttgattattagggaactttcttggatcacctggtactttaaagagctggttttgtaacagagtctaccagaggagagtctgttataaatcagtcattaaggttagaagattttcttacaagaggaatgagcaagaaattgtcatcttagaactagttgagaccttagaagccatctagatcacataccttacttcacagatggacagaacaagctcagaaagctgcagctggggttcagggctttgacttgccagcccaattaatttctcagggaatacagattagaaggacagagaaattaatagttacggagacctaaagagaaaaaatagaagttgattaaatccaagtttttattgtatgcctgctgtgtcccaggttctgtgctaaaggtaccaagaataataaataaaatgtcaataaggctaattgttaccctatggaatgcctgaaactgaagctgacacatgcatattgaagggagcctataaagaatgtgtgggaaccaatgtattgaaacattaaaaaatagaaggcgaggtagcttcaggcctgatatcccagcactttgggaggctgaggtgggtggatcacctaaggtcaggagttcaagaccagcctggccaacatggtgaaaccccgtctctactaaaaatacaaaaattagctgggcatggtggtgggcacctgtaattccagctacttgggaggctgaggcacgagaatcgctttaacccaggaggcagaggtggcaatgagccgagatcacgccattgcactccagcctgggcaacaagagcaaaactctccctcaaaaaaaaaaaaaaaaaaaaaaaaagaatgtgtgggaaccaatgtactgaaacatttaaatacagaaggctgggcgaggtagattcatgcctgtaatcccagccctttaggaagccgagacaggtgggtcatttgactccaggagtttgagaccagcctgggcaacaaggtgaaaccatgtctctaaataaaatacaaaaaaattagctgagcacggtggcatgtgcatgcctgtagtcccagctacttgggagactgaagtggaagaatcacttgagcccaggaggtgaaggctgcagtgatccatgatcgcactatagcactccaacctggacaacaaagtgagaccctgtctcaaaaaaataaaagaaaaacagaatttgtttagtttgtgttatttctgccctgtggcaggtgctagggctggatgatctggggttcatttccacttggtaatggctggatgatacactgggagtttagatttctaaacaaaatgagatcaatgataaccaagcttctctactcccagattcaccctcatggcttaaatcatggatggcgctggttggcacagatcttaaacatggagcccttgtcagatgtgacagccaccctcctctttgacttcctggaggtacgtaactcagttatcacacaagagaaggccagtggttgaggtagccttgatccactgggtgacatgaatggggaaacagcatagcatttgggcctgatagtaaaacagcatgaggttccagtgtcatacatttttcccaagctgtagaccaaccttgctttcacttttactccatactatatttacttggcttctctggatttttttcattataaagaacagaaaattgtacattctagcaaaagtgaaaagaggaatttgttttagggatatagaagggactcccaggccgggtgcggtggatcacacctgtaatcccagcactttgggaggccaaggtgggcggatgacatggggtcaggagttcgagcccagctggtcagtatattgaaaccctgtctgtactaaaaatacaaataaaggccgggcacggtggctcacgcctgtaatcccagcactttgggaggccgaggtggttggattacctgaagtcatgagttcaagacgagcctgtccaacatggtgaaaccccgtctctactaaaaataaaaaatcagctgggtgtgatggtgcacacctgtcatcccagctaccgaggaggctgaggcaggagaatcgcttgaacaggatctcactctgtcagccaggctggagtgcattagtgtgatcatagctcactgtagcctcaaactcttgggctcaagcgatcctcccacctaaccctgccaaagtgttgagattacaggagtgagccattgcactcagccaagaagacacttcttatagaagaaagccttggggtacatgccataacaaatctggaaccatttgatctatagtgccaatagttcctagttaccttaatagctcctgacgtcagccaggtgcagtggctgacagcctttgggaggccaaggcaggcggatcacttgagctctggagttcaagaccagccagggcaatatggtgaaaccctatatctaccaaaaaaatacaaaaattagtggtgtgtgcctgtggtcccagttactgaggaggctgaggttggaggatcacctgagcccagggaggttgaggctacagtgagctgtgatcatgccagtgtcctctagcctgggcgacagagtgagaccctatttcaaaaaaaaataaaaagctcctgaagtcaccatacatgaacaatgatcctgtatcatttgagaacacaagtggtattctgtatactctccttactaagtttgggaggtataccatacctttaggaaggcgtccattcattagaggaaaagaagagtagttcattaagacctgattggttaaatggagatattgccatataaagagaaatgctttagaagaaagttgggtgtttccatttattcccttgttagcaagttcagtggcattgtggttgaaatttttgataggtgtgaaagatgaagggctgattgtgctttatgaatctgtcctgtgagtgtgaattttcattttctgctctgacagtgcctgtctttccctctaggtgtgtgggaatgccctcatgaagcaataccaggttcagttctggaagatgctaattctcatcaaagaggactactttcccaggtatcaggcttgttgagcagacagcaggggattaagtaactcataaccaggcctcagatacccaagggtgctattacctgctggttttgattcaagttaaaaacacctgtactaagtatgacatctttcctactccagtccctctcgttgatatttgaataaatgcttttgaaccttaatgagagtctgtcttaaatatcattgcccaaacaaaaacacaaattaggggctgagcacagtggcttatgcctataattatgcctataattgcagctctttgggaggccacaggaggaggatcacttgagcccaggtgttcaaaaccagcctgggcaatatagcaagaccccatctctacaaaaaaaaaattagccaggcatgatggcatgcatctatagtcccagctactagggaagctgagacaggaggatcgcttgagcccaagagttcaaggcctcggtgagctatgatcgcaccaccgcgctgcactccagcctaggtgacagagtgagacaccgtttccaaaagataggtgtatatcataggtgtgattcatgtgtctttctctccctgtagaattgaagctatcacaagctcaggacagatgggctccttcatacgcctcaagcagttcttggaggtaagatgcccttagaccaacatgccccacactgttgttgggctggaatgcacctatgtctgacaagtcttggaccttccgatgctctgattgcactctcttccttagttcttccaaacccttctttttgttcctaattccctcttaacctttggagtaagggctgccatttcctcttctttatatgtatcattctctatactgcctgtgagaaagctatgctgagatgagtaaaatatatttagtgtatctcctctcattaatatatattttttttgcatgttggccaaggttattttcttagtctcaggtctggggaattggtaagtgtcatcacttttctccatgagatcaaactgcactttcagttggactcttcccctacttccaagtgccaagagattgtaaaaggttaattttgacaaagaatttagaacactatagtgggtttgccaagatagcctgctgacttttcagcttctcaaagctcgattgtgaaaatagtgattgtgaaagatgaggttagcctgtagggagacaagagtgggacaggaataataagagcatttcatttgttgtctggagcagatcatgcagaagtggacatcttatacagaaccatcagtcttactggctttttcctttttgttcactgttccatagggctgaaatatggtgttcctcaaagcttcttttaaccattaagtgttgggaacactgttatcagaaactcattctgttttcttcatctttccctgaccagaaatgtttgcaacacaaggacattcctgtccccaagggctttctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagttccttaagagatccacgtgataaaataaatggagttggcctttcttgttttttgcaaaagtgataaaaggtctttagcacttggtctcctcccttgtctctagtgtctttcagaaagttggcaataccttaacaaatgcactctgagctggagggagcccaccatttgcacccacctacccaccctcacccctgttcagatgaatttccagaaagagctaaggctcataaggttcccttttaagtattatttaatagttgaggccagatacttacatgcaagtctgggttatggttgttttgcctttctcagcttgtgaagtcattctaaagctagaggaagtatgtgatatacacatggactaaggctcaggtgacactatggctagattaacatctgggattaggactggaaacacatgtcattttgaactaagggaaactctttgtcatcctaatttggaatttggtccctggatggctagggatccatgaaccaggcaggtaccttttttgtttttgttttgttttgtttcttttctgtttgaattaagatgggctaagatggggcttgcaacattaaacatgagctgagcatccataagcattgaattgggattaaataaagatgttgggcaggaactgaacactgctaatatgatgataaatatgcctgactaaagccactacagaaatccagagattggctgttaaaatttgttttgtggaaagactaattctctttgatactgcagaggcagtggccatggatctgttcctctgtgctaaatgtcttgtggcagggtgtgtttgtgggggagtgttcactggtactcttgagtggcctgaagtgacccattctatgaattgttaattaaggtgccaaaaaaaattaataataaagcttggttttttgaaaaacccattgctgatatattggttcaatatgatcaatttcctctgccttgagctatgtaaatcatgatagtatacaagtccaggtatagagcggtatgcatttattccttttggtcttcttgacctacaccttgggaatattacttctttttctgtcatttccttttttggaattatgtactaataactgaccctattttatctagcaagagatgtgaaagtgtattaaaatctttgaaagacacaataggccgtgcttagtggctcatgcctgcagtcccaacactttgggaggctgaggtgggaggattgtttaagtccaggagttcaagaccagcctgggcaacatagtgagacccccatgtctaaaacaaatttttttggccaggcgcggtggctcacgtcttaccagcctggccaacatggcaaaaccctgtctccactaaaattacaaaaattagctgggcatggtggtgtgtgcctgtaatcccagctacccaagaggcggctggggcaggagaattgctggaacccaggaggcagaggctgcagtgagccgagatcactccagcctgggcgacagagtaagactctgtctcaaaaaaaaaaaaaatttttttttaaatttttcaggcatggtggcacatgtctgtagtcccagctactcaggaggctaaggtgggcagatcacttgagcttgggaggtcgaggctgcagcgagctgtgatcatgccactgcactccagcctgggtgacagagcaagaccctgtctcaaaaaaataaataaataaataaggtagacacaatggaatgaacactggggacggagtcaggagaccccggctcaaatcacttttaggttttttggccttgggaaggtccttcacccgctctgaacctcagtatccccacctgtaaaacaaaagaactggacatgtcactgtagttttcaaactatgcttgatagcagttccttagcgaagagcttcccagctggtgtgccttggcatgatgacctcattagccctcccagacaaggcctgtggtgggtgagcccccaggagcggttccattcacatttcctctccttacctttgccttaaaaatggcataattcatccgggtgtggtggctcatgcctgtaatcccagaacttcgggaggccgaagctagtggatcacaaggtcaggagttcgagaccagcctggccaacatggtgaaacccccccatctctactaaaaatacaaaaattagccgggcatggtggagcacatctgtaatcccagctactccggaggctgaggcaggagaattcgcttgaacccgggaggcagaggttgcggtgcgccgagatcgcgccactgcactccagcctaggcgacagaggaagactctatctgaaaaagaaaagagaaaaaaaaaaggcatcattttctaggtaccgtgacagggaataggttgggaagcaatgacttcaggacagggggatgttgagtgaatggggctcagccctgtagccagtcaacatacagaggcttaaagcaaatttccaaaaggcatcccttttccttcaagatactaccaccctctattggacaactgccctgttaataactgtacaaatctatgagtgttacagctcttttagaatttgtctagcaggttttccaatcttcactgaaaagctttaaaaaataaagtaaaattatgatggaggtcatggtacctcccagagttgtgcagctcatgttttgcacaaccatttaggggttctaatggagctctgggatcctctctgccacagcctttttgttttatgtgctgtatgatatattatggttccatgtaagattatgtatggaaaagttcatctgtcaaaaacaaaatgaaaaatcactggatgagatgatctataatttctcttccactttggatttgtattacttcatagaaaatacctcttaggctgggcatgatggctcatgcctgtaaccctagcac

SEQ ID NO: 16673 - DNA, 13959 bp, Human
tttattcattatcatgacaatagcacaggaaagaactgcacccataattcagtcacctcctaccaggttcctcccacaacacgtgagaattcaagatgagatttggatggggacacagccaaaccatgtcacactaccatgcctgacttcctttccatttttgtatatttgcttgttcttcatttgcccgagaagtaactctaaagggctgtattatttggatattagattggcattttatctgactgggatatcttgctgtgattgtccatgtataagatcagcttttctataaaccatatttttaaaaagatatattaattttttaaaaatccacctgtctaaataaatgcacaaagccccccaaaaacctagattctaagaaaaatctatgtactgccatacaatgattgatattaatatttatggtgataaattacacacaaaaaatgtgtgatctctgtttaaacaggcaaaaacaaaaaacacatgaaataaatctatggcatctatagccaaaactggaaacaacccacatatccatcaataggaaatcagttaaataaattatagtacatttatccaatggaagattaagcacatattcaatataattatttatacacacatatagatacacacatgtataaatatagagaatactgtgggtgtatgtgtgtgtgtgtttatatacatatatatacacacacagtactgttgcctaccttcttttgtcttaattctgtgaactctcattcactctgcttcagtaggatacatccttctttttggttcttagactcaccaagttgatccttgactcaagacattgcatttgctgcttcctcttcctggaatatccttccttctgatattcacatgagtagtctcttcttgtcattcagatctcaaatgtcacaatttcagagagcccatctctgatcatcatatctaaagttgtcctcattcccccatagctttctataccatgttttatttttttcataacatgtattttattactcctttctccattggaatagaatctccattagattaggaaatctgcctatcttattaatgcctgcaactggaatacttttgaagagttcttggcacgtaataaatactcaactaatatttttgtgtacacagaaataaagtttggaagaacagatgccaaattgttactagtggttacttctgagtaaaggagtagcatggtaggtaaattattaatagatgttcactttccaccaagatatgttttagttagtcttaacttacttgaaatgaaatttattactttaataattagaaacattgataaacattttagtcacaagaatgatagataaaattttgatgcttccaataagttatatttatctagaggatgcacttatgtagaatactctcttgaggatgttaggtgagtaacatgttactatatgtagtaaaatatctatgattttataaaagcactgaaacatgaagcagcagaaatgtttttcccagttctctttcctctgaacttgatcaccgtctctctggcaaagcacctaaattaattcttctttaaaagttaacaagaccaaattataagcttgatgaataactcattcttatctttctttaaatgattatagtttatgtatttattagctatgcccatcttaaacaggtttatttgttctttttacacataccaaactcttaatattagctgttgtccccaggtccgaatgttaagtcaacatatatttgagagaacttcaacttatcaagtattgcaggtctctgattgctttggaaccacttctgatacctgtggacttagttcaaggccagttactaccacttttttttttctaatagaatgaacaaatggctaattgtttgctttgtcaaccaagctcaagttaatggatctggatactatgtatataaaaagcctagcttgagtctcttttcagtggcatccttccctttctaatcagagattttcttcctcagagattttggcctagatttgcaaaatgatgaccacatctttgatttgggggattgctatagcagcatgctgttgtctatggcttattcttggaattaggagaaggtaagtaatgttttatctttaaattgctctttgattcatccatttaatttttttaccttcatttttatacagtaaatttggttttctatacttacacatattagcattatcttccttattttttaaatgaaaaatttgatttgaatttttaaagtaatatcttttttactatatctcacaagacatatgacagcttccctttttagtattggcatataccgatggtaatatataaatgtatattggtgttaaacataactgacagaaattgtataaggtctctatgtacatttatatgtgtatctaaagaggaagcccagattagtaaggatacaagtagcaagtgggaatctacaatggaaaggattgctttctctcacatggcttcaatagatactcttgttaaataaatgttctcttttaagctcattcttgtgcatcgcatagactcagcctaagcctgaacaagagcatagagcctgagctgatcattctattactgtttttaaatcaatgttaatcaactgtggtgaattgggaaagtttgctgagtgtatgtgacatcgatttcatttatttacaactggttcaagaatgcaagaaaaataaatacagtcagatccagaaccatagtttatttaacttctaattggctcaaggagtaattgtggggaggcatatagatattctctgctatgtcaatctcaaaaagagaaaataaccctaaccatctttcagctttgtagattgctatgtgttttctgccttttgcagtttctttcaggcctgatagtttttacttttaattaaactacttatcttcaaactaagaaaagaaaggtaattactttatactgtattattctatcaagaggtacagaagtttatgttggaaaataagtttacatgttctaataaaaacattttaaaggagcactgaattacaatagatgattccgtcagtgtttatcttactcaatttcattttataataagctgatttctcacatgagattcttcttctctgaaaccatccttatagaatataatatagatatctttaaactaggaatattttcaaaacctcagttctgaaatcctcccttattcagtgatctgtgtctttaaagaaaataatcaaaagaaacattttgagatatttagaaaaatgatgcttagcaaagtgataaacactagaatgtagttttgtttccgcactgacaacaagaatcttgttggtcttgtaaatccttttgcctgtatcactgggaaaagtgatgagcacatagtagacgggtgcttgttgaatgtgtatatggacggatgcatgaatggatggatttagtaatcctttccaccaacatatcatgttactaggttaatataacctattactgtagtaaaagagcagggcccatccaacaaaagaaatatctataaactatagggtttcaaagtttgaagtcagtgggaaaaattttaaaacctgatgtaagtaaaaacccaaaactgtaatcatccatgtctatcatacatttgtgtctgacaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggtaagcagttttacatttatataccattctgtttgtcttctacctttttatgtgcttgtctatttagaaattttgatgtacttagattttatgataaaggtgttgaagagagttatccttatgtggagattcttagaaacataaataaattatacatagcttcttagtaataatcatttagaaagtcaaaataggtatagatttgtcatttgttgacgagctaatgagggtgaaatacagattaaatgctctactgagacaggtggcactgtacgaataagatagataaaaattcatcacatcagcaatgtctatgcaagaatgcaagtgacggaaacctaacattcaacagttgtctcaccacacttgtgccacacagtgtttcattttgataaggaattggcaagatattttaacatcatttagatgtaataaaagaagatctgttactgagaaaaaaaaccaataactacttacttactgcaaataaatattagctttggtctttgtgactaagtagcttaaagtttggttaaaatacatctacagctggacacaatggaacacacctgtagtccctgctatttgagaggctgaggcaggaggatcgcttgagtccaggagtttgaggctgcagtgagctatcattgtgtcactgcactccagcctgggtgacaatgtgagaccccatctctaaaagaaaaagaaaaagaaatctacaaataatataaaagataactaatgattttaaaacattatcaattagtttgtgtgcaatagctgtaaataagtgcagtagcataagaaataagacatagatgacttgagtgatccaggggagtgccactgaagttggctttaaaggaaaggtacagtttggtcatttatttgtaaagtgctatgaacttgtacaagggaaagccaatttcccgtgtttaccaagtaaggaactatgaaagtatctaatccgtttttcagtcatttactatgactaggtcaggtttaacttctttttctgcatgttttatttgctatcaggcatttgggcacagaagcattgacccgatggatggaaataccactgaaaacataaacgacactttcatcaaaaccctgcagggccatgccttgaattccctcacggaaagcatgatggaaaacctccaacgtatcatgagacctccagtctcctctaactcaaagaccgctgcctgggtgacagaagggatgtattctttctgctaccgagtgatgtttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggtgactaacgccatatccatttcttttttttattttagtagaaagtagaaattaaaccactttaactttaagaaaaaaagcctcgtagtactttatcatgccgtcaatcaagaacgtagcactaatgcatgttagtgtttaacatatatgagttcattcagtccgcagaaaaacataggcagctatggctggtaaaagtgttttatagaaacaaagacagtcccagagaaagagatgtcaccccaagccacggagcttgtatgtgctggtgttgggtcaattcaggctgcctggcccagagcccttgctcttaaccccatactgttcttcacgacgccaactccactccataaatgcagttttcataatcattaaatgtatttaagtgattactgatttatggacaacaatcagggcggtgactatgccttacttatttgttcattcacagtttgttttcactcagttaggaattgctgttcttctgtttatttgaccaactatgagagctatgaatcaatcataatctattattattgataagagacttagctaggttgtgctttttaaaactgtatgtaacagaaaaaaactgtaataacatatgttttacataacatgatttctctccaaagtgttaatcttttgggaatttgaaattagaatggtctattgaattattccaattaaattagatatttagtatcatgtagacacaaaattgctcctccataggattgggaatgccaaatttctattgatggctgatgactttaggtcttataaaatattttaaaacttaatttcagatgtgagaacttattactaatttgtcacaaatgttgactatcttccaaagttattacttgaaaaagcacatccagaataaattcacatatttacagcaggcatacgcatcaatttaacatcataaaggaaattgtagccatattttatgatagtcttacaaatacttatcaaacattttgagactcaacttactgtaattttgttatgtagctccctagacatgtttaatccttgttagaaacacttatttataaaagccctgaccaggccgggcgcaatggctcacgcctgtaatcccagaactttgggaggccgaggcgggcggatcacaaggtcaggagatcgagaccatcctggctaacacggtgaaaccccgtctctactaaaaaacatacaaaaaattagctgggcgtggtggcgggcgcctgtagtcccagctactcgggaggctgaggcaggagaatggcgtgaacccgggaggcggagcttgcggtgagccaagattgcgcccctgcactccagcctgggcgacagagcaagactccgtctcaaaataaataaataaataaataaataaaaataaaataaaagccctcaccaaagtttaacttttatgtagcaaagtcccattttttaattattattattattttttttttcgagacagagtcttgctctgtcaccaaggctggaatgcagtggcacgatcatggctcactgcaacctccacctcccgggctcaagcaattctcctgcctcagcctcccgagtagctgggattacaggatcccactgccatgcctggctgatttttgtatttttagtagagacagggtttcgccatgttggtcaggctggtctcaaactcctgacctcatgatccgcccgcctcggcctcccaaagtgctgggattacaggcgtgtgccaccacggccggccgcaaggtcattttaaggcaacaattcttactaatatccaaggacataaacccaattacaaatggagtaaatgcaaacaggaatatccctttccctcctcccctggtatcttcaccatctagttaaaagaagggggaaaggcctatttgtttgcagatctcaaagtatggaaaaagtttattttctgtacatacatgttttctcttaccttttaataggaacccagaagcaatgaaagcagctactgaagaagtgaaaagaacattagagaatgctggtcaaaaagtcagcttggaaggcaatcctatttgtttgagtcaagcagaactgaatgacctgccagtattaggtgggtatacttgttatgttgagtttcattttctatgtcctactactttaacaataatgaccaacataaattatatacttaccgaattctaggcattaaactaaatatttcatatgagttttctcggttaatcctcacaactgtcctgtgacttgggactgttactatttatttgtaccaagtgaggaaactgacacctagaggttaagctgcagccagggtagaatcaaatacatcattatgtggcatcctattctctcaactaccaccctgcactgccacaccatgtttctcatattcctcttaccactaatctgatggttaatggaagcatattagtcattttcataaaataaaggagggaaaagaaccattaagaaaccacagttacctgcatggattgagtgatggatttgaaagtgctttgatttttctttgttctgcttttctatattttatggaactataacaatatgatatttttatttttatttatttatttatttttgacaaagtcttgttctgttgcccaggctggagtgcaatggtgcgatcttggcttactgcaacctctgcctcctgggttcaagccattctcctgcctcagcctcccaagtagctaggattacaggtgcacgccaccacccctggctaatttttgtatttttagtagagacggggtttcaccatgttgtccagactggtctcgaactcctgacctcaagtgatccgcccgcctcggcctcccaaagtgctgggattacaggcatgagccaccgcacccggccaacaatatgatatgtttatagtaataaagttttctttttttggttattttctttaaggaggcaagaagcttaggttccatgctggggctgacttgggagactttggacatgtcagtactcttttgggggccttacttttcttatctgtaaaataaaatgctaacattctggaattttatacacaatcatgtgatgagcaccctaaaacatgacagttaaaggatacggctaaaaggtcaggctggacctctcgcgagctctctatatttcagccattttcaggttggttctttttgtccctttatgcctttaccgggcagcggtgatcgccacgcagcatcagatagtatatggataaaaataggttcttgtaaatgttgaactgaagctgcattaaacacctagaaaaaacatatgtatgtgtcagtgctatcagtatattcaatctcagaagtcctcagtatattaaatctcagaagtgataaactttgaataatttctataaaaatgtattactgatttttccagttttattacattactcttctataaaatgatggaattttgtttcccaattatgaccaagatgattatctcttaatcaaaagattattattaactcaggatcagatttaaagatacattcaggccaggcacggtgactcacacctgtaatcaaagcacttttggaggctgagatgggcacattgcttaagcctaggagctcaagagcaacctgggcaacatagcaaaaccctgtctctgcaaacaataaaaagaagaaaattagctgggtatggtggcacatgcctatagtcgcagctactcgagaggttgaggtgggaggatcagttcagcctgggaggttgaggctgcagtgagccaggatcatgccactgcactgcagcatgggcaacagaatgagaccctggctaaaaagaaaaacaaaaataaaaaaattcagacacagttgaatcattgataacagcatagtggtaacagaaagaaagtttgggaaatttttatctgatcagcttcccataccctgttcatctttgtgttatgcactgccaggctgtctgtagttcagactctatatcatatgaccttcaaacacttggtttgttcttctcttccttcctcccttccttctttcattttttatctttttttcttttaaaatgtttagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttggtaagtgcctgcccattgaaattcaatatccaggtgatagctacctagatctaaataaagaggaaatttacaatggtagaattgattttatcattgtagtcacaggaattgtctgcttaattgtgttaaatattcatatattttggaaaatttagatagtggtctgaatttttcattttagtcctgatatttgccatcacacagtctttgctagattatatttgcagtcatgataataaacctgccactttttttttcttaaaaagcacctcctcccaaatccaggaaattggaggctaatatattgattattctagtttcttctgggaacccttctctctctagctctgcctgactaaggaactaatcgttcaagcaggataggaggtatcacaaggcttccttagctcattaagctcctgttccttattactttctgattcaatgtggagtatttgctaaatcactaatggggtagaattaaaaagaaaattactctttggagcttccaggtttagaaagagataaatttctttaaaactagcttaaaggcggttttctttgtatttttattgcagacttttaaatatgataggtatcttgatgaaaacgggaagacaaagactaccttctattgtaatggactcaagttaaagtattactacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgtgatatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgctgtgtacaacaatgctttgataaaatattttaagtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatctatgtgtatttatttatttatttatttatttatttagagaaagagtctcaccctctcgccaaggctggagtgcagtggtgcgatctcggctcactgtaactgccacctcctgagttcaagtgattctcatgcctcagcctaccgagtagctgggactacaggcacgtgccaccatgcctagctaattttcatatccttagtagagacggggtttcaccatgttgggcaggctggtctcaaactcctgacctggggtgatctgcccgcctcggcctcccaaagtgctgtgattacagacacgggccaccacacctggccgaatctatgtgttttaaattttgaattattcagagtgtttaaaacattcacccactgataagctaaacaacaacaattttattcaggattcattcaaaatactcatatattcaaatattgcaaaaatattcaatgtaataatttactcaaaaatctccctcatactacataaaatttattacaagttttcatcttgctatttaatattaccatagatttatcccttaagtaggttatcttttatattaagaaaattaaagtcatttagatgtggttcaagattaacaaacatctattttatagtgaacagtgataaactaaatttccaatgtggtttcctaatagattttatgactttttaaatgcatcccacatttttccatgtctttgttcttgtagagcaagggttggcaactgatggcacatggaccaaagggttcccgcctctgtttttgtatagcctgaaagttgagaatggtttttacgttttttaatggttagataaaaaaatcaaaagaataagaatcttttatgacatgtgagaagtatgtgaaatttggacttccacacccatcagtcaagttttattaggacgcagcatgcccattgtttgcattcttgtctgcgcctgctgttgtgatgccactgtggagctgagcagttgcaacagagaccatgtggccacaattcctgatatatttaaagtctagttctttacagaaaatgtttgccaatccctattgtatagcaatcccaaaggctattttgtactgtaattttattaactttaaagaatgtatacatgcattggtatatgaagtattttgtcttttttgaaaaaagcatgcgaggagaatacatttaaaaagccatggatggccaggcacagtggctcatgcctgtaatctcaacactttgggaggccaaggcaggcagatcacctgaggtcgatagttctagaccagcctgaccaacacggagaaaccccatctctactaaaaatacaaaaaaaaaaaaaaaaaaaaaattagccaggcatggtggcacatgcctgtaatcccagctacttgggaggctgaggcaggagaatggcttgaacccaggagatggaggtcgcagtgagccgagatcacgccattgtactccagcctgggcaacaaaagcaaaactctgactcaaaataaataaataaataaataaagctatagatataattttatcttagacaacattaagttagaactttattggagatgaaaccattccatttagaaagatatttttattttcaaaagcacctaaaagacattacaacctattataagatcaaatagacctaggaggagagattttcatggttaaatctattcagattcccatgggccagggccaggtcactactccacatgccatgcaccatcccatcatatcctcaagagtcctttgagatttgtgttactattacctctatattacagaagagaaaggcagaactccagaaaggttaagtcactggctcaaggtcacaatgctgacaggtgaaagagctgggagtattggaatccaggttgctccaactccacagccagcactcttccctttgtggcaagtccaggtgacaggctgtcttgactcaggtcattgaaaagatacgccacagtaaacaaaatccatgatgacact
